United States Patent 7,745,391 (HUMAN THROMBOSPONDIN POLYPEPTIDE) - sequence listing, part 210

SEQ ID NO: 514471 - DNA, 121 bp, Homo sapiens
agaataataacggcagaacttgttagagcctccagtcgccctatcaaggaagcgccattgtagaggggggtgccttaaaacttacgggacaccgggcgcggtgtctcacgcctgtaatccc

SEQ ID NO: 514472 - DNA, 246 bp, Homo sapiens
ctacaggatccccggcaggcaagtctcgttcctcacaatggtcacagaattgtccacgagcgatgctacgcaaaacggctgagtatcaggcaggtgagtggatcttgcatccgcctaatcaatgtgctcacagctatcacattgctgacaggaaaaaaacatcccatcacgacgtatcatcgaatattgtgtgaattgctcctagacctacactgacaccaaatacacatcagaatactcagggta

SEQ ID NO: 514473 - DNA, 182 bp, Homo sapiens
atctgtggccctaacgagcaccatggtagatacaagtagacttcaatgcgacatgctctacaagtatacagcagcttacttgctagcacctagttgggccatgttcccggatttgagtgccagacaacacaaacaatataggcacccatcgccctactctgctatggaactgcgctgataga

SEQ ID NO: 514474 - DNA, 227 bp, Homo sapiens
  misc_feature (224)..(224): n is a, c, g, or t
aacgctttatacttccacgcttatacttcctcaacgcttatacttctcaacgctttatacttcttaacgctttatacttcctcaacgctttatacttctcaacgctttatacttcctcacacgctttatacattctcacacgctttatactctctcaagcgctttatacattctcaagcgctttatacatctcgtgcgccgctcgcctcgcaccgggtaccgangct

SEQ ID NO: 514475 - DNA, 539 bp, Homo sapiens
ctcgtagagctattagtgcgggaaaagctggcggactcgggacactcgcgcctagaccatgcgcttgacccgaagcaccgatcatcgccctggtcacgacgtatactcagatcgggtttggctgtagacaggcgattggacttcgacctgatgggctgagttgaagtttcttgtacgtggcccacttcacaagccggtcccgggatctagttcaggaaatccggcccgcgttggaacggttgtcagacgtgactcgtgagacggtccatctggggatgatggatggaacgcatgttctccatgtggacaaagtggatagccctgagcgatacggcatttcctcgcgcattggcagccgggcggtgccacatctcaccagcttgggaaaggcgatactcgcggcggaatctccgcagttcgtcgacgcctatctcagaggcaagggtaggaccgcatcgccgtatcggatccaaaacgttgaggatgaaagagcggagatagagaggacgcgggcaaggggatacaggttaccgagctcg

SEQ ID NO: 514476 - DNA, 462 bp, Homo sapiens
tcacgagtcgttctagacagtataaaggaggaagatagcacactggggtgtatgacatagctacaaactatcagcgtctgttaaatggtcatgaacaggctacatcctacagacctgtcagcataagaatagtctatgggacatgtgatattcgagcaatagaattgtactcagcgacaatacgcagtatgtttctatcacgcatcatgagtagatctcaaaagcatggtgagcaagataagttagatatgtaatagaatgtggagagctagaaaatgcagaatttctggtggtcaggctctcaatagaaagcacccatgaatggtgaagacagccaagacagcatgaggaagtaccattactagagtggcagtaatgctctagcatactgattgggagtggagctcacactcgcactatctctctctctctctctctctctctctctctctctcgctctct

SEQ ID NO: 514477 - DNA, 338 bp, Homo sapiens
cgtatctggcatttgcaacccattggtacctgaaaatctattagtgtaaattggaatcataccatagggaaactaatgaaatgattagaagtcatgattttccagatcttctagggattagtataaaacgataaacactttgtttcctttgtcttttgttacagactttgagaatcactactagaaatactgccttgtggtgaaggttctaagacgtgtgatcgtttccagatgagaattcacaagctactcattgtcttgcactgtccttctgagattgttaagcagattacttccttccgttttgagccaggagttgaggtggtagtcaccattgc

SEQ ID NO: 514478 - DNA, 155 bp, Homo sapiens
  misc_feature (110)..(110): n is a, c, g, or t
ccagcggcggcggcggcgggagctggggcgcgggcccgggccgcctctcccagagcgcggggccgggcggcgggcgcgcccaggcagcggctgcgagcgccttcccgcgnccgtttcccgcgccccccgcgccgtgcccccgtttgcttggctcg

SEQ ID NO: 514479 - DNA, 121 bp, Homo sapiens
cctcgacatcgacggtatctcactctctatatacaggtatatttcaggtacctactacatagccagaactgtcttgggcacagaaggtatttcagtgacaaaaaaagaaataaattcagtc

SEQ ID NO: 514480 - DNA, 579 bp, Homo sapiens
atttttcaaattgatatttaggaagaattataactaatacatttgaatggaggtcctgggatatttggatagtaaaataaatagccataaaaggtcctagacttcttattgtgaagttcaaaatttcttattttgaaaaagttgacaatttatgagcttgtgaagattgtgctaaaatttaaaataatttatagctccaaaaacaaaaatatactgtgtatattgtcacagagaaaaaaaatgcaaaatttataatagagttacattaaccttgtgtgtttacctttcactgatttcttatatggtataacattaaagttcaggcattctatggggagaaaaggccctccccaaccgacccgccacctgccacctctgacggagtgggcagaagttagtctgtgctaagatagtactgagtccccagatgtgtatactgtaaattacagtataatgccaaatgcagcaaaatcttccagctgtacgttacaagttgtggtcatttggaagcttgacatttaagttgtgccattatgttaaaaacatctaaataggtgtagttctcaggagtagatggta

SEQ ID NO: 514481 - DNA, 417 bp, Homo sapiens
  misc_feature (43)..(43): n is a, c, g, or t
  misc_feature (98)..(98): n is a, c, g, or t
  misc_feature (159)..(159): n is a, c, g, or t
  misc_feature (252)..(252): n is a, c, g, or t
  misc_feature (254)..(254): n is a, c, g, or t
  misc_feature (335)..(335): n is a, c, g, or t
accccatttaatttcttcaaagaaaaaaaaatggaggcaggtntaagagccagagccaacttttttccccaatatatcataccagcttttggaggtanagatttttttcttattaaaaaatggcttttttttttttttggccaggtaaggtggctcacncctataatcctaggactttgggaggctgaggcaggcagattgcttgagctcaggagttcgagaccagcctgggcaacatggtgagaccccgtntntacaaaagtacaaaaattagccaggcgtggtggcacttgtctgtagtccagggtacttgagggcctgaggtagggggatcncttgaacctgggtggtcgaggctgcagtgagccgagatcgcgccactactccagcctgggtgacaaagtaagaccctgcctc

SEQ ID NO: 514482 - DNA, 496 bp, Homo sapiens
  misc_feature (52)..(52): n is a, c, g, or t
gactctagacgatcccatgatctggaaaaggggagtagggtaacaaaatctnacttgggaaaagaattggggaagaaaacaacaaatggcttcattcaagggtggggacagggaaagaggtaaggccagggaccggagcatttcacattactaaactaacttgggaagctgtaagggaccctcttccactggccttaagaagagaacccgattgctgatgggagaatccccaggagggagaagaggaaaaggaacgtggctgggaggaggcaatagcccctttctttccgggcacaggaaggcagccagggcaccaggtccaggcagtgacctcacaaggacagcacagtttttgcagcttagagatcacccaccttgtccctaactagctactcattctgcccagcgctggctggtgtagggccactctccggccccgagggagtggatggctctgtagcctggggccctgcctcttcttctgaggctgcactag

SEQ ID NO: 514483 - DNA, 364 bp, Homo sapiens
gaggatccgcccacatttgtcaggagttgacaattagtccgcctgtatccgctgtactcgatatgtacagataccattggtggccaactcgatttgatgtgtaagtggagggatcgttgacgtcgatcggtcatgtaaaggatgcgtagggatgggagggcgatgaggaccaggatgatggcgggcaggactagcttcaaacggattccgattgcctgagcgctctgagactggtgcggatgagttagatcggtcggtgatgtggaaaaaccgggggcgtacaggactaggaagcagattaggaaaatgattatgagggcgtgatcatgaaaggtgataagctcttctatgataggggaagtac

SEQ ID NO: 514484 - DNA, 191 bp, Homo sapiens
aaaaaaaaaaaaaaaaaaattcagccgggcttggtggggggggcctgtagtcccagctcctcggggggttgagtcaggagaatggggtgaccctggtgggtggggcttccagtgagccgggtttgtgcccctgctttccagcctgggtgccaagaggggggctccccccccaattaatttaatttaattta

SEQ ID NO: 514485 - DNA, 461 bp, Homo sapiens
ccccttggcacactctggctaccttctggttgtcttctctccctctcttccacctgctgcttgcctttgccactgtgtttatatcatccagatgaggtgttggcaaactatgtctcatgttggcatccttttttaaaataaagttttattggaacacagccttgccatttgtctgtctgtggctacttttgtgctacatgactagatgcaacaggccacatggtccaccaacctgtgtattcaccatttgtcccttgaggaaatttgctgacccctgctctggatctgtgctaatatgatagccagtttagtcttagaggctgttttagcttaagtaaaatttaaaaattagttccttagtcacattagccacatttaatgtgttctatagccacgtgtgactggtggctaacatattgggacaacacaggtaaaagatattttagtcattaaagaaagtg

SEQ ID NO: 514486 - DNA, 370 bp, Homo sapiens
acaatgaaattaaaaagaaaaataaatatggacaaaattgactttacattcaaactgttgatttatcttgttgtattgtgttccgagtatcggaaaataaattattaaggttcagaaatcagaagtacgtcgtatgcatgaaaggttttagctaatggaaacttgctcctccggttgcaacacaaacacgctaagctgcggcctcagcttatctttccaaatatgcaggccagatccaacgtccctttgcttgctattaatctcaaccacaaccaggatctccgttaaccggttaacctcgatattcacagtgaattccccattgtggccctccaacctcaccccccaatcccccttctgtcgtcttctc

SEQ ID NO: 514487 - DNA, 358 bp, Homo sapiens
  misc_feature (321)..(321): n is a, c, g, or t
  misc_feature (334)..(334): n is a, c, g, or t
ggtttcttggcaccataatcaatggctgcacttgatcttattggctgcagctccaatatgggggtagggttttgggttcctcattatttcatgaccttctactccaaacctctacatatcaacattaaatatcagtacatgcatcatgattgctctgcaaagccagcttcagacaagctcctaaacctccagtcagactgtggccccaggtccctgagtaaagatcttgggagccaccactgggccagatgagaagtacttgagagacccagcatgaccagcctctcctggcaggagcccccaaagtctctggagcacagnctgtgtaagaacncaaataaaacaaatacagaagcca

SEQ ID NO: 514488 - DNA, 284 bp, Homo sapiens
attggatagcggatagggtcatgattggacacaccgactcggtgaggctgcccaggaacataaggggtgacttcagcgtacacatcagcaggaatgtcatccacaccagcgactccgtggaggggtgccagcggaagatccagctgtggttccagagcagtgagctggtgagctgggcagacggtgggcagcacagcagcactcacccagcctgaggctcaagcttgccttaccaacccatcccccacgcagggccaactacctccgtcagcaagaacccaagc

SEQ ID NO: 514489 - DNA, 841 bp, Homo sapiens
  misc_feature (11)..(11): n is a, c, g, or t
  misc_feature (64)..(64): n is a, c, g, or t
  misc_feature (80)..(80): n is a, c, g, or t
  misc_feature (94)..(94): n is a, c, g, or t
  misc_feature (99)..(100): n is a, c, g, or t
  misc_feature (114)..(115): n is a, c, g, or t
  misc_feature (119)..(119): n is a, c, g, or t
  misc_feature (148)..(148): n is a, c, g, or t
  misc_feature (154)..(154): n is a, c, g, or t
  misc_feature (162)..(162): n is a, c, g, or t
  misc_feature (166)..(166): n is a, c, g, or t
  misc_feature (177)..(178): n is a, c, g, or t
  misc_feature (234)..(234): n is a, c, g, or t
  misc_feature (246)..(246): n is a, c, g, or t
  misc_feature (250)..(251): n is a, c, g, or t
  misc_feature (255)..(255): n is a, c, g, or t
  misc_feature (264)..(265): n is a, c, g, or t
  misc_feature (267)..(267): n is a, c, g, or t
  misc_feature (273)..(273): n is a, c, g, or t
  misc_feature (307)..(307): n is a, c, g, or t
  misc_feature (637)..(637): n is a, c, g, or t
  misc_feature (660)..(660): n is a, c, g, or t
  misc_feature (673)..(673): n is a, c, g, or t
  misc_feature (679)..(679): n is a, c, g, or t
  misc_feature (835)..(835): n is a, c, g, or t
tttcctctggnggttctgccactttaacttcaaaccggtcctggacgtcattggggtttttggnatcattctcgtcaggnacaaaggtggtggntaggnntttggtgccaaggnngccngcccggggcacccggtgcgggtgggtgtncgggtnctcaggtntgtngtagttaaagnngatgttggttcgctcgttgttcatcccccggccaaacagattggtggccaccaggntccgccgctggngatnnttgngctgctganngngtgagnggggctcctcctgggccatgccccggtggatggngatggccgggaagttctgctccacgaggagctgggccagggccatgcagcgctgcactgacttgacgaagattatcacctggttaaactccagcacatccaagagatcaaagagcttgcggttcttctcactgtctttgagtttgacgtagtactgctgcaggccgtgcagcgtgagcttggtctcgtcgtccacaaacacctccatgggatcctgcatgaacttcctgcacacaggccggatgtccttgctcagggtggcgctgaacatcatgcactgcttctcgtgtggtgtcaggcggaagatctcctgcacatcccgccgcatgtncagctgctccagcatcttgtcanactcgtccagcanaaagtntttcacattctttaggctgaagctcctattccgcacgagcgccaggatgcggcccggggtcccaccacgacatggggacagttcttcttcaacacttcttcatccttcttgatggagagacaccgaagacacagaaacttgacgctgggcatgtantggaaa

SEQ ID NO: 514490 - DNA, 284 bp, Homo sapiens
cggatccttgtcgacggtaccaacacacttcatccaaaagtctgttcaacagatggcaacgggtagcagtcacttcacaatctgatgcagtggttccgtgagagcgtggcagggctgtgaaaacagccatttttcctaccctaattgtgggtttgttgctcaagggaggaaacgatattacgccaattacaaaggcaggaaaatctggcaggttcctcctgctattggtggccttcagaaacacttttccaaatttttcctgggtccaaatggctcctggattt

SEQ ID NO: 514491 - DNA, 287 bp, Homo sapiens
tgtatcagaagactgtaactagggctgtgggaattatgaaccaggaacagtggatgaaaaccaatatatgtcataacactacaaatatattttactgatgtatacaattagaataccgagttctaaagtcacttcaaataattatattctctggtcattttactaattttctgtaaagttaggtttatttgtttcattttgtattcattttgagggctaaaaaattatattgctaagaatgtgtaatagctattttgaaaagttagaatacagagatgtataaaaag

SEQ ID NO: 514492 - DNA, 723 bp, Homo sapiens
acttgttccgttggtcaagttatcctagggattgcaggtgcaatcctattcgtatagtcgatatcaagaatagggtttacggactcgatgttggatcaggaatcccgatggtgcagcgctattaaaggttcgttagtcaacgattaaagtcctacgtgatctgagtcagaccggagtaatccaggtcggtctatctattcacagtaccctcccgtgtacgaacaggacgaagagacaataaggcatacttaacaaagcgcactagcccgcagagaaaatgagtatcagtgctccaacattgagcaattatacaaccaacagcccagcccagaaccagaggacggacaagactaacaacaaaacaaacgggcggcgcgagcacaaaaggagccacgagaaggggacccaaagaaacaacgcggaaaacccaacaccaaccatgtggctccacaacaagtgggcgaccccccaacgaaacggcaagcaccacacaattaaaccagccgaaagaacaacatggaccgagacgccatgcacacccgagacgaaatagggacacaccactgacaaacaagcgagacaatagcaggaaagggcacaaagaaaccacagtgtcggtggggacgagttaccacggcacctcaacgaacagcaccacgaaccacaagcagcaacaacggaacccccagtcagacagtacacacggggctcatcagccgtcac

SEQ ID NO: 514493 - DNA, 903 bp, Homo sapiens
  misc_feature (21)..(21): n is a, c, g, or t
  misc_feature (190)..(190): n is a, c, g, or t
  misc_feature (225)..(225): n is a, c, g, or t
  misc_feature (248)..(248): n is a, c, g, or t
  misc_feature (257)..(257): n is a, c, g, or t
  misc_feature (270)..(271): n is a, c, g, or t
  misc_feature (275)..(275): n is a, c, g, or t
  misc_feature (296)..(296): n is a, c, g, or t
  misc_feature (301)..(301): n is a, c, g, or t
  misc_feature (309)..(309): n is a, c, g, or t
  misc_feature (313)..(313): n is a, c, g, or t
  misc_feature (315)..(315): n is a, c, g, or t
  misc_feature (327)..(331): n is a, c, g, or t
  misc_feature (339)..(339): n is a, c, g, or t
  misc_feature (347)..(347): n is a, c, g, or t
  misc_feature (351)..(351): n is a, c, g, or t
  misc_feature (357)..(357): n is a, c, g, or t
  misc_feature (370)..(370): n is a, c, g, or t
  misc_feature (372)..(372): n is a, c, g, or t
  misc_feature (379)..(379): n is a, c, g, or t
  misc_feature (383)..(383): n is a, c, g, or t
  misc_feature (409)..(409): n is a, c, g, or t
  misc_feature (419)..(419): n is a, c, g, or t
  misc_feature (424)..(424): n is a, c, g, or t
  misc_feature (431)..(431): n is a, c, g, or t
  misc_feature (437)..(437): n is a, c, g, or t
  misc_feature (489)..(489): n is a, c, g, or t
  misc_feature (499)..(499): n is a, c, g, or t
  misc_feature (505)..(505): n is a, c, g, or t
  misc_feature (586)..(586): n is a, c, g, or t
  misc_feature (713)..(713): n is a, c, g, or t
  misc_feature (725)..(725): n is a, c, g, or t
  misc_feature (741)..(741): n is a, c, g, or t
  misc_feature (784)..(784): n is a, c, g, or t
  misc_feature (894)..(894): n is a, c, g, or t
aatgttcagtacaatgcaganaataggacagaaaatgtataaagctattgttaatattttagaaagataaaatctcttctcactaaagaaactagatgactttatgcaattaacaagcaacgatattttacctaagaataacttgagtttgtgtgatttaagtgtgaattaatatattgcacctttttanagtctgttcaagatctaaaactagaaacaatagcnacttttatttccccacataaacnatgaaactnttacatggtaagnnagangaactctcacacactgttggnagggntgcgaatnggtncngccattatgggnnnnngtacaggngttcctcnaaanattaanaataaatctatcntntggtccngcgntcttcaccctcactactgggtatatngccaaagggnatggnatcggtnggttgnggggacatctgcgctcccatgtttattggggcgctattcacaattgcgaaantatgggatcnacttanatgcccatcaacaaatgaattaacaagggaaatgtggcatatatacacaatagaatactacacagccataaaaaaaattanatcctgtcatttgtgacaacatggatgagcctggagaacattatattaagtgaaataagctgagaacagaaagaaaaatactgaatgatctcactcatatgtgaaatctaaaaaacttgatagtggntaccagagactngggagaacaggggggnggggaagatgaggagaggttggtcaatgggtataatgttacanttaggtaggaggaatacattctggtactctatcacacagtaaggtgagtatagctaacaataatgcattgcatatttcaaatagctaaaagagatgattctgaatgttcncccaaaaaa

SEQ ID NO: 514494 - DNA, 896 bp, Homo sapiens
cgggcatttctgactgactcggtattttccctgcgggtttcagacgcaatgaccactcggggtactaaacctcccacatgcttacgaagcttgccccgctccctcttcccgaacgacgtcatgtggcgctactcgtctacttgccttgcgaaggaatgatgtatctaacaggaaatgctaccatggcgcgtacttatcagtcaatgaaccgcgccaaccagagtgctggtaagtatgctactgaagtctgcctgtggcccctgcaccatgatactgattcatctccgcacttgacctcttgacttgttgtcagtcacgatcccggttgcacagcatgggaccactggcgcctcctggtgagagcctcccgctgtatcacccctgtcctctacggtccaaggtgagcttcatgtctgctctttgcatccatgtcctccagccacaccttgcatagccatctgttccacctatgacgagagcctacctagtcatgcagatcggccatcctcgaggataggccaagaggtgacccagggtggtccccagggcgttctaaaaccccacctagaccaccctccatgtcaggtactgagcaaggccccagatccttctctctggaggaagagggaagcccaggggtcctgtttgtaacaacaagcggatggcaacagctcactcttccagagctgtctctgcctttatcctgcgcagatggggaggaagccccataactctgctgtttccccgcgtggaggaagcccacccagcaagctcatctcgctaccccaggtaaaaggtgctcgtttcgcctagggtttgaattccagcgctgccacttcctctatgcacctccatggcaagtttcttcaattcccaacatttaaagcgatggcaca

SEQ ID NO: 514495 - DNA, 246 bp, Homo sapiens
acacacacacaaacaacagaatatggtaggttctctagtaccaaagtcagaggtggagggtagtacttactttcgtaagacttgttgtacttttttcattagttacctctctattctcatgtccaattaggatcaagaaaagaattgcttgagccaagttcatcatgaaagtccagatatgcaagtcaggtgctctgtatctagttagatctacatagatgacaccactaccttattcatactagt

SEQ ID NO: 514496 - DNA, 117 bp, Homo sapiens
cgctcctaccgtacataggctcaggctcaacacagtcatacatagccaacatttaacagatgttgacaaaatggttactaataatattatatacggaaccagccagagcctcatgtg

SEQ ID NO: 514497 - DNA, 405 bp, Homo sapiens
gtaataaaatttttaaaactggcctgtggatttctttaaaaaaaaaactggaaagtcttgcttgaattcatatacttggaagcgaatagttcctgtgttataaacgtgaatatgaataagctagataggaacaagatggttctaagtaatctgtatgaagagagacttctggacaatgttataaatattatgaaaattcacaagtagataaatgtagagctacagaaaaaaaagatgtcaattttatttgtgtttgtttctgtccttcttacgaattccaggtactaatagcaatgtatacttctttgaggagcagaaatgccagttgttctcactataatataatgtatttctagactatatatattcttccaaatcaagaataaacttttaaaacaaaataaa

SEQ ID NO: 514498 - DNA, 384 bp, Homo sapiens
acccccagcacgcatagatattaccggttcaaagtggaagacaagtgagagatatttcataaaaatttcggccagaacaaaaaaaaagggaaattatttttccttaaagacaactagaaagaaaagggtccccccaacccacctttttttttttttactttgaaatctcccacccagacgggtttccgggggtaaatctgtttctgtaaaccctaatttaaggcctttatattttttctttgacgagagccatccataaaaggccccttgtttttaacagggcctgccttccaggaacccacccaattccagaaccggggacctaaaatttggaaaataagttaccgggcctgaaaaacacaagccttggggttcaaggggggg

SEQ ID NO: 514499 - DNA, 1112 bp, Homo sapiens
  misc_feature (11)..(11): n is a, c, g, or t
  misc_feature (22)..(22): n is a, c, g, or t
  misc_feature (39)..(39): n is a, c, g, or t
  misc_feature (132)..(132): n is a, c, g, or t
  misc_feature (174)..(175): n is a, c, g, or t
  misc_feature (209)..(209): n is a, c, g, or t
  misc_feature (239)..(239): n is a, c, g, or t
  misc_feature (242)..(242): n is a, c, g, or t
  misc_feature (281)..(281): n is a, c, g, or t
  misc_feature (284)..(284): n is a, c, g, or t
  misc_feature (287)..(289): n is a, c, g, or t
  misc_feature (294)..(294): n is a, c, g, or t
  misc_feature (297)..(297): n is a, c, g, or t
  misc_feature (314)..(314): n is a, c, g, or t
  misc_feature (330)..(330): n is a, c, g, or t
  misc_feature (342)..(342): n is a, c, g, or t
  misc_feature (346)..(346): n is a, c, g, or t
  misc_feature (359)..(359): n is a, c, g, or t
  misc_feature (439)..(439): n is a, c, g, or t
  misc_feature (988)..(988): n is a, c, g, or t
  misc_feature (993)..(993): n is a, c, g, or t
  misc_feature (995)..(995): n is a, c, g, or t
  misc_feature (998)..(998): n is a, c, g, or t
  misc_feature (1018)..(1018): n is a, c, g, or t
  misc_feature (1023)..(1023): n is a, c, g, or t
  misc_feature (1026)..(1027): n is a, c, g, or t
tgcgaaaagtnactttcaatgnactgaaccagattattntcatagaactgggcaccaatccgctgaagagctcaggaattgaaaatggggctttccagggaatgaagaagctctccaacatccgcattgctnataccaatatcaccagcatacctcaaggtcttccaccttacnnaacgaaataacatcttgatggcaaaaaaatcagnagagttgatgcagctagcctaaaagaactnaanaatttggctaagttgggattaagtatcaacagcatatcngcngtnnncaatngcnccctggcccacacgccncatctgagggagcttnacttggacaacnacangcttaccagagtncctggtgggctggcagagcataagtacatccaggttgtctcccttcataacaacaatatctctgtagttggatcaagtgncttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttatagcctggcaaaatcttgttaatgtcattgctaaaaaataaatgaaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaacnctagntntgnataatccccacattactggnaaagnctnntttgaatgggtgaattcaaaacaggctatgtaaaatttttactaagggccttattttgaaaaaataaattttaaaatcccttcca

SEQ ID NO: 514500 - DNA, 146 bp, Homo sapiens
cgcccagaatctcgtttacactagatgacatgtacataaacgcccaaaggaagttgcttggacagtataagccatgctcttactgtaggtcacaaagttgatctgtcttatcaaggtccccaaagtccatcagagagaggcagcag

SEQ ID NO: 514501 - DNA, 780 bp, Homo sapiens
  misc_feature (23)..(23): n is a, c, g, or t
  misc_feature (107)..(107): n is a, c, g, or t
  misc_feature (656)..(656): n is a, c, g, or t
  misc_feature (661)..(661): n is a, c, g, or t
  misc_feature (663)..(663): n is a, c, g, or t
  misc_feature (666)..(666): n is a, c, g, or t
  misc_feature (686)..(686): n is a, c, g, or t
  misc_feature (691)..(691): n is a, c, g, or t
  misc_feature (694)..(695): n is a, c, g, or t
cgcccccccaccccaccaagccnacccccccggccccccccgacccgggtgatagcgctggttgtctcccttcataacaacaatatctctgtagttggatcaagtgncttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttatagcctggcaaaatcttgttaatgtcattgctaaaaaataaatgaaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaacnctagntntgnataatccccacattactggnaaagnctnntttgaatgggtgaattcaaaacaggctatgtaaaatttttactaagggccttattttgaaaaaataaattttaaaatcccttcca

SEQ ID NO: 514502 - DNA, 757 bp, Homo sapiens
ctgtgcacgggctgcttccacatgccccaattcattcggcttcactctgcacgtccgcacggaggcggctggcgactcgggagacggtgcggggccatctccggaggagagaggatttcttgaaaaccgtggaagggagggagctgcagagtgtgaaggccccaggaggccttcctcaagggaactcgatcatcccatttgtatccagaattgggcacatcgacacggcgaagatcaccagcaccgtgatcgcccatgggccacatccatcgagactagctggggtcattggctggatggggtggtgttcccaggcattgctgaatggagctcatcgcggagatccacagaaggtctctgggaagagagagagaatgcgggtgtcgaccccacgctcgctatccccaatgatccgagaagggatgcacccccagcggggagcggggcatgacagcgaatccctgggcaagagagagtgccagaggaggctaacttcatgagtgcggtccccgtggatggtcctatgggctggcatgctgcggggcatgggctggagacttgaggaggtgcatagtgcgagcttgcaatcaggtagtgaagccccgtggtcaactcactgaggcccaaggggttagggcggggttgctagctgagcgaggcccagggcttgaccgcaatggccctcccgatgctaggccagatgatggcagcaaggaaagagacagctcaggtgggctgagagcaggtgcagcggcta

SEQ ID NO: 514503 - DNA, 1072 bp, Homo sapiens
gtggagtgtgtgcagcgggtggctactgacagcaggaccgtggagtgcctgcggcaggggtggcagtggtggctggcgtgctggctggccggtggatggttacaaccgcagcagtggtggctatcaacccagaggtcgtggaggttggccggtggaggacagaggtgtgcatggcgcgtgaagatgaccccgtgagtgagctttcaacgtaacaatctctgcaggtggcaccgtcgagaggacccaagtgactcacagtctagtgcagctccggagacagggataaatttcagcacaaacagagcaccaagtcctcttgttgcaaggcgcttgggatgacgaaatgttacagattgacgatcgtgttggcatgaagttacttcagaggcaggattcggtcagttcactacaagagcagaacaatgaagaacgtggaacaagccccattgattcaagtgcggtaccacagggagccaggggaagacttggaccaaagcttgaacaggggacagagggccacacgtgctcctccttgtggagggaccccccaccgtgtccagccttagagggacaagccttgattggcacctgaggtttcctgacatggtccagaggaaattactcccgcgcaaaacttccgctagtccagaggggtctaccaattcatggcataactgttccggtccggagggagcgaggaaaccgtcgtctcgacgtccctgcgcgggaatagaataggcgcgcaaagttgaggatccggaacagcgcacagtggaccccggactggagagcacgaaagctagacggcgcaaccccaccagatttgggaccaccgatgccggaaatgcacgaatcaattggcacagtcggcttgggatggagccacacgctgagcataggacggtggcggacgaggccccgcaacccaaccgcgacagttatcccccacgtgatgcggcaatgtatttgggctgggccaagggactggggccaggagcacacgggccaaccacgggacggcgttgccggctgaacatggggacaaatatgtcaccgattacagtcccgccca

SEQ ID NO: 514504 - DNA, 110 bp, Homo sapiens
cctgcgtccacgctgccaagcctgtacgaggtttgggcctccctcccaggcgtgggagttgagggtgggcaggccaggagcaggctcatctgacagccacagattgcctg

SEQ ID NO: 514505 - DNA, 1288 bp, Homo sapiens
tagggtaaaaaatgttcatttaagggattatcacttccactacacgtgaggcctcgtgaaaagtgttcacaaattttctcaaaagcagcagggggctacacaattttttaccacaacacaaagcaaaaacagatctggccattgtgtggtcatctcgtgcgtgacgagtgcataataggtgggggtttcaaagcttttccacttgtgttataaagtgcgtgcttctgaacgttctccagtgacagaacttacacgcttggggtgacatcttttatactccacaggctacaagaggtctgaagacattggcgatatacaacacccacggagagaactcctttgagctcacacaggccaataccacccaagagatggctcacccacaatacacacacaccacgattcctcatccggagccggtctcacccctatgcacggtggtccatcacggagtagatcatcccgtggcccagctgtgatcccacagacgatatggcggtctcactgagcaaagtacaccacgacaacaaacgacatctcatcccgtgttaaaccagaccctatataaccgctcccctctccaccacacacagcacgttctcacgagcaacgctaacgcgcacagcggcgtgccatctgcccagccaacgcgggacactcgaaaaataaaggccctccccccccctgcagactcacccccacgacacacgagaccaacctgcacacccagacacgaaacgacatagctaccccccgatgccgccacacatcaccctcccccagcacgagtgagcaaaacaaccagagccctgcacacaacacaccactggccccacgcaaacaacaacaagggccccaaatcgggccccatccgagatccccctggaacaacacaaaaccacaagacaccaatacccacaaaaatcaccacatgacaacacacagacgactcagaaacaaactcccccgagaaacgaaaacacaccaacaagacagctaggtgatcaggaacaacgcccagaagagtatatagcaaataacggaccagaaagacaccgacactccgtgggacaccaaccagacgcgctatgcgaacaaaccaccgctccaaaacagaccgtcaaagacaggcaaaataccgacccccaactaagagaggctactatgtgacaccacaccgcacgcctaggcaacaccacacgcaggtgcagctaactgcgaaggagcccccccagccatcggccaaactatatacggacagcggaacagcctacgaaaggaagagaag

SEQ ID NO: 514506 - DNA, 634 bp, Homo sapiens
ggcacgaggcagtccccgaggcttggcaaagcaggagccctctgtggcagtgcttgggtgtcggggctctgaggatccggcctcacctctccacggggtcgacgggaacgtctccggatgccaggagtcgcaaagggccgaccacgatgaggaaaccccaggcggggacgggggaagcagcacgggatcccagcctcaggcctgcccggacggtgttggttggggatcaagatgagtacactgcagccgagaacaagagccccagaggaactctttgtcccacaggagagcagcggatccacgccagagaagatgcttgtatcttttcacggctcttctctgagaaatgaagccacaccacgatacagtcagcaagaggaagccgggaatgggagatggcaacagtccctgtcactggaacgctggcctccctggacaagccaccctttaggaaccccaccccttatgcctgtggcggtggcacggtgctgtatcctgcctgggctctggcctctactctctcctccctctggctctgcctcccctgtttctcaggggcctggatgcctctcgctctggccaaatgccttcaaaaaagatgacttcccagtccgtcagggagacacttcctgga

SEQ ID NO: 514507 - DNA, 394 bp, Homo sapiens
  misc_feature (60)..(60): n is a, c, g, or t
  misc_feature (95)..(95): n is a, c, g, or t
  misc_feature (100)..(100): n is a, c, g, or t
  misc_feature (123)..(123): n is a, c, g, or t
  misc_feature (148)..(148): n is a, c, g, or t
tatgtggtgaaagctctgagcctcacacctgttgtctgtttgctaaaaaggaatttaatnagcctggttttcccacagcagtttctcccatgatnatacngggatccacaccggaaccgcatntcgatggcaaggattttaagcatantgtcggttgtgagctcatacgttttgtcggggtcggtggcctgggggatccctaaggtcaggcagagcctctcaagtttcttgtgtctgggcagtttatcaaagtcgacattgaagggcaccctctggagcagcaggccctgtcggtggcagcggtgtacaatgaccggccgtgtgtcgggatcgtggcctcggagcgaacaggtgtcggaaagtctctgaacgtgaagaggttgcacgaccaaat

SEQ ID NO: 514508 - DNA, 137 bp, Homo sapiens
tcctcttctatatctacagcacagttaggcaccccctaaatgggaatcagaagctatccaccccaccccacatttacacatcccacattgatctggaggcagacgagatactccagaacgccgggacagggagctga

SEQ ID NO: 514509 - DNA, 213 bp, Homo sapiens
gagctgatgctgcaggtctttctaaggatccactaaaagctcctatattacgtatgctcctcccccacagacccgcacagcacagcccagaagcgagagtgagcaaaccaagaatgagaatgaagaagacaaactcactgacatggaataaactggcttgtctgctttgcacaaaggcagtttcccaataaacgaagttctagatccaaacac

SEQ ID NO: 514510 - DNA, 319 bp, Homo sapiens
gcaactgttgcagagatggaggtactactacggagtatatgggaactgtgcctttgagtttcctcaggctgctggagtggaaactgatgactcagacaggaaaggggaggcccacagacaatggtagccctggccatgagccttgctatatgtctatattggtttctatagaggtgggatatccctatgctgcctaggttgacctttgaactcctgggctcaagcagtctacccacctcagcctcctgtgtagctgggattatagattgttgcctccatgcccagctacagagggttgttctcctagattgaccctgat

SEQ ID NO: 514511 - DNA, 887 bp, Homo sapiens
cttgcctgttgtttagtgtgttttctctttcaaacaaccctctaaaaatgtaaaaaccatgtttagcttgcagttgtacaaaaactgcctcaccagccagatgtgaccctcaggccatcattgtgccaatcactgagaattagttttggttgtcgtggttgtcgtagttattgtgacacagagtctctctctgttgccctggttgtagtgccgtggctctatctcagctcactgctacctccggctcccggtgttcaagcagttctgtctcagccttctgagtagctgggactacggtgcgtgccatcatgccctgctagatttttcgtattatttagtagagactgggggtgccaccatgattggtcaggcttatcttgaacatcctgacctcaggtgatccagctgcctctgtcctccctaagtgctgagattgacaggcataagccagtgcagccagccgagaattagtatgacatgtatggttaaaccttggagtctagccatattttatgtcataataccatgctttgtgaagagcagattcatgagtaactctgacaggtttttagatcatgatctctgcatattcttccaaactggctacattttttgtcccgactttggatgtgactcccggttgtgccgttacgagtgtctctccgacaactggcgctcctcacagttcacttttgcttgacttgtttaaaccttgagatgcgtctgccccccattcggccttaatgcttccgggttccgctctccgcgtcctaacggccccgcacgatttccacaacgctcggcgaaggcccttcctgtgagacgctcttccccataagacacctcttgttcccccatcctctctttcttctttctttgtcctcttt

SEQ ID NO: 514512 - DNA, 368 bp, Homo sapiens
ggggccagatgatgattgtggatctgcgcagcaggcatgcacctagggcggggagcgtagcagagatgcttcgaagaagagtaatgcaccgagcactctagccgagagcatacaggggtccaccactctcagcgcatcgtagtgccactgaaagagacgccacgcttcggaggagagaaagtggcagacggtggagactaggtcaggcataagtcaagccccaggggtgtccacaccatcagcctgagcggcctctcaagctcgagcagtgtctgaggctcttctgtggcgcgtccgagatgagcctgaggagtggatctggcgagactcatgtggcagatggggggtagactgggcagagttcgcgt

SEQ ID NO: 514513 - DNA, 208 bp, Homo sapiens
ccacctctgagcgagttcctccatactacaagctgggggagacaccctggaggagtggaagaggcgtatcaggagaatcaggaccctggggagagctggccacggacaacatcattctgacctgtgcctgacagcaaatcttcagtactctgtgagaacccatgagcctgctgctcctgccagctgggactgacggtgatgcatggct

SEQ ID NO: 514514 - DNA, 367 bp, Homo sapiens
aaataataggactctggttatactgtagagtgtctctgatgaatggacagaattgtcctggctaactacaagctacggttcacagtggataaatgttggcgtgctttattactttctgactttttaaaatattgcttttatatcttgcagttccaatcaattttatatgaatgctattataaaattcagcgtaaaatctttacttgactagcttaaaacttgtgtgagactagtattaatcttcaatgatttaacatttctgaaaatgtcaagttctcttcagacaataaggggggtttaaattgatctgaattttcagttttctattggtctctaatgattaggtacaatatcttgtctcagattc

SEQ ID NO: 514515 - DNA, 115 bp, Homo sapiens
caacgtcggacagtctgctgcaagtgatcccccacaatatcgctcactacgccctggctgctatgggtgcccaacgacgccatcccctacatcgccgccggtgacaaagtctatg

SEQ ID NO: 514516 - DNA, 227 bp, Homo sapiens
cccttttcaaaaaaaaattgccaaaaaaaccgaaggtttttttataaaaaaacccaggatataaatctaggaaaggggtcttctaggttttggggtggttaaacccaaaaaaacccaaatttggccggaacaaggagttgtttagttaaaattcaaaggggcccgaaagggaaaaattcccccccgtcaaaaaagggccaagaattaaaaggcctgcccccttttta

SEQ ID NO: 514517 - DNA, 848 bp, Homo sapiens
aactctttttctggcgggttcctacctaaatagtggcccacaaccttctttttctataagcaaaaatgggtgttccccccgaaatgcttttcctctacagaaagacgttttttttctacaaaccttctttactttggtgaataatttttacaacattttacacccgcatattttcttcaccgctgctgtagaataaatgtagccactctgtttaatttcacacgctactcttgttgctattgtgcaccacactatgtttgtcacacagcgcctctctcggttttttgaaaggagtatgaacaaataagtaaatatatccccccttgggaggtcttaatcattgggagacttcctagaaagtagtgggcctccccgccacacatgacattcatttgtttgtcgaatgttgaatggtaggcacacccctctgctagtcgttgtgtggcgacacgcacgttataacctcacagacgcagatcattacatatagaaggtatagttttccatcccccgccctctccatgacagaatgttattctataaaaccttctgccattacctccgggggagtattatccagtacaactcatctgctcccgccagaaattttagagaggggcccaaaatgcgtatatctctttagctgtcccgcttacaacacagtgagggtttgtcacacagccgcaagtttattgtatcgctccgctcgcttagagataggttatgtttcataccccccacatggcatttctctgtgtgagaacagagcagggtgtcattactcccctttccctctaaccgtgcagggtagaaaaaaaaacaaataggtaggggtcaaacaaaacaca

SEQ ID NO: 514518 - DNA, 1636 bp, Homo sapiens
  misc_feature (395)..(395): n is a, c, g, or t
  misc_feature (684)..(684): n is a, c, g, or t
  misc_feature (1509)..(1509): n is a, c, g, or t
tgaaactttaaaacccctcaaaaactgtttattatacaagtgagtttggattcccaatgggcttttcggtaggattttctgtggttagcgagcgcgggccaccagggcccctccaaactttttgtggactctcccagcgacaagggtctcagcttaccaggcagggtctccggctcattacgtggattgaggattgttcttttgattcctccttctctttgagaagccctctcatctccaacatatattatctcgtggtataatatatgccgccacccacgggcctttgtggaacacatgtgagacctgtgtagcggatatagccatatataatctcgtggtgccacacgctgtgtgtaccacaccacgacccctttataacacgcgcgacaacnagcggagagtgtctctatatccaccccgagaccaaaatcttcgcctctcacttttcgcccgagagaaacagcccagacacagctgtggtgctctctccagcacgagtactttgtgtcaccgtgtgtagcgcgtgtgtccgcccgtgtctctccaaatctcacactctctcccgagtgggtgcccccgcccccccgttgtactcccacctctttgtgtagtagttgagcagaacaccccctattgtgcgcgccgcgcgttattttgttgtgcgcagtgttgtgcgcccanccaacaaagcagtgtgtagtaccggcgcggttgtagtactctactcctgttgttgcgccggtacttctccgaagataaacaacaccgttgctgcacacaaaggaaaactgtcgtcgataccgaccggggcggccccccttgtgttgtgaccaccagaggcgaatgttgtggctcttccccgaaaagccggtgtttgtgccaccttttaacaccaacaaaaacacctctctaaaacaatgttgtttcgtgtgaaggggcgggcgcggcccaaactcgccaaagactcctcttctgttggtgcgagagaaaccacacaaaattttgttaaacacaaaactacaatactgggccctttgttggggaaaggtcttccccccgaaagaggaggggtccgccccccctgttgggggaggggcatacaaccaacggatagcttgtcgtcgacgtcttccgaggggcatatataacaccgttggtcgttctccaagacgcagggaagctagaacaaatcacatcacatacttgacacgcctgttgatgagaaccccccaatatttcattggtattcttttaccacacaaaaggaacaccgtgttgggggaacccccccccgtttatcctttacaacgcacgggtgttttgacaagacaccctctcccgaaagaatgctgccccgtctaacatcgatgaatctttgcccgcaaagaaacaactcctcgcggaaaggagcggggcgccagacaggtcactctcttcctgttgggaacccccccctcttccaccaagtggagtgggtgtggaccccccacacagaggtgtggtccnagtctcatcggaagcagcactcggtggcgactagatgtagatctcccccacaaatattatcttctcccggcgacaagaggagtaggtagtgtgacccccccggagcattatgaaaatattagagtgc

SEQ ID NO: 514519 - DNA, 798 bp, Homo sapiens
  misc_feature (233)..(233): n is a, c, g, or t
  misc_feature (249)..(250): n is a, c, g, or t
  misc_feature (253)..(253): n is a, c, g, or t
  misc_feature (257)..(257): n is a, c, g, or t
  misc_feature (262)..(262): n is a, c, g, or t
  misc_feature (273)..(273): n is a, c, g, or t
  misc_feature (286)..(286): n is a, c, g, or t
  misc_feature (289)..(289): n is a, c, g, or t
  misc_feature (296)..(296): n is a, c, g, or t
  misc_feature (298)..(298): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (317)..(317): n is a, c, g, or t
  misc_feature (327)..(327): n is a, c, g, or t
  misc_feature (333)..(333): n is a, c, g, or t
agcggtcatttgggatgaccctacagcaagggaggagagagcaaggcttgccagcaatttgcagtggcctagttgtccgacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataancagatgagcatgttgnngtnctcngatcngaatgtgcaancaaaaaaaacttngtngatattncnggttttggttnaanctngngccagaaaantaattngtaaattgaggtacttcatcagtaaattgaaaaacattttcataaatttggaaatttagaattgggcgtttttttctagacatggtgtctaccattgttcttttattctagctaacccttttgtgtttgtggagttaatgcttggtttttcttcctatcatcttattttcatttaagtcttttgaattctgcctagcacatacctacatttgttctttggattgtatgagtttctttctgaattctcctattttttcttcttccttgagctttaccttaaaaacaacaattttcctatctctcatcttttttcttccttttcttctttttcacattgcatgattgacctcccattagatatatacgatttatctctggttctgcttttctcccaagtgtagcaattgctctcatgtcacaaattgggttacccttaccaatgacaattcggcttcaggcaacagt

SEQ ID NO: 514520 - DNA, 197 bp, Homo sapiens
tctctaatctatcagtccggctctgaactgggttatttctggtcttctggctggctttggaattggttgctctttttctctagttctttgaattggtgatatcagggtgttcattttagatctttcctgctttctgatgggggcatttagtgatataaattcccctctaaacactgctttatctgctgatagattag

SEQ ID NO: 514521 - DNA, 536 bp, Homo sapiens
  misc_feature (19)..(19): n is a, c, g, or t
  misc_feature (28)..(28): n is a, c, g, or t
  misc_feature (145)..(145): n is a, c, g, or t
  misc_feature (237)..(237): n is a, c, g, or t
  misc_feature (272)..(272): n is a, c, g, or t
  misc_feature (368)..(368): n is a, c, g, or t
  misc_feature (411)..(411): n is a, c, g, or t
ataggcttcaaacgggttngggttattnggaggaactcattaaatattaacaaagttttggttaaataggggaataagtttttaaaatcgattgcacagcatgggacaatagttaataataatgtaatgtatatttcaaaattgntatgagagtggattttaaatgtttcatagcacatgtaaacaacataagtaagtgaggttatggatatgttaagtagcttgatttaatcattntataatacacacatacaacgcctgggtgcagtggntcatgcctgtaatcccagcactttgggaggctgaggcaggtggatcacgagatcaggagatcaagaccatcctggctaacacggtgaaaccctgtntttactaaaaatacaaaaatttagctgagcgtggtggcgggtncctttagtcccagctactcgggaggctgaggcaggagaatggtgtgaacccgggaggcggagcttgcagtgagctgagatagtgccactgcactccagcatgggcgacagagaagtctccgtctc

SEQ ID NO: 514522 - DNA, 108 bp, Homo sapiens
agaaattaccgtgtcaatgactttttacttaatttacttacgtattctctggatcctcgggacaatcactaataccagttccctttattcggcggtggtcggcggcag

SEQ ID NO: 514523 - DNA, 237 bp, Homo sapiens
ggacagtgaagggaggtgtaaacccagagcccttcagagcaactcagaaggtatttacccggcaactcggtttagaacatgatgaaaagctagtatcctatctgtctcggttacggaacatggaaaggaggaccaaacagattcaaccttgggagctaaaccgggcagaactacaggatcggcggggtcaggccaaggtattagaaagggagttaagggatctgaccacctgggtca

SEQ ID NO: 514524 - DNA, 183 bp, Homo sapiens
  misc_feature (19)..(19): n is a, c, g, or t
cacaggggaaggtcccacngggacttcaggagggcggttggtccaggacccacacctgctttcttcatgtttcctgatcccgccctgggtctgcagtcacacatttctggaaacttctctgaggtccaagacttggaggttcctctaggaccttaaggccctgactcctttctggtatctcac

SEQ ID NO: 514525 - DNA, 747 bp, Homo sapiens
ccccggccaggctgaaaacaaggaacattccagagaagatcacaaggcatgcgaactaaaactcggagcatgcacagggcatctcttgcgcgctgtaactacgcgcaggggacacacaggggcttacggggacgggtctagcccattggactcccatcaagacccaagacccaatcctgtcaccattgaccatcatccccgttatcccaccaacctctatatcttataccacacacacggcacgacacgacttgagaacccataacgtcccctcgctccataacagcacgctgcggacctcctggcattataatatacccacattcccatccttatacctcccccttacagtcccaatacgccgaagcccataacatcataggatacattgcgcccatatcaccctattcccaatggggacacaccacattcgcgttgactaacttgacacatttcccatccattccctaggaccgaggcatgaggggagcaacgctattaaacacgggcacggcaacacaacaccgcttccaagccgcccatggggccccccacggccataggaggcgggataaccccaacgcaagcgcaacagaattccccggccgacgcccaagagcggcacccaaggaccccattcggcccccccattggctaaaccgagagcttgccaaatgggaccccaaacgagaaaacgcttccgattgggccaaaatcttggattgtacgcccaccaacgtgtccccg

SEQ ID NO: 514526 - DNA, 496 bp, Homo sapiens
ccattatgccgtgtaattgtgttggtttatgatcgacctttttacccctgtgtcatgtcttgtgaattatggggatatatgatctctgcgacgctctatattgatgaggagtataagtcgaaaatgatatcacctctccttgggtccctgtgctggtgccaatgttgtgcaccgcacctgaggtgtctgtagctgcagctgatgccacttgatgagtgttgtgcgccttgaagagagtgcatggatgtgaagcgttgatggaaaataatgtatgttgggggaccacggatgttgtgataccttgccttggtttgtgcttgttggcagccctgccaatgcctatcttcctggccccaccatggtgagcatgctagcccctggatacctgccttgtgtgctgttaatggatgttaactatctactggataaattacttatacggtgatagtgataattcctgattcccagaatgccatctgatagcgctggcataaca

SEQ ID NO: 514527 - DNA, 1256 bp, Homo sapiens
atgtcattttaggctgactgttagacggtgcatgctcaggctatgtgcaccagggatataatgaaactccagtggagggactccagcacaagcttcctccgaatccgtaggttggcgtggtgcgtacaagtacacaatctaagataccctatgcatgtcgattcccacaaggctatgactctaccatgtcgacgagttaaacaaggagatacctgagggtgaatgtacattggtcgaatcgagtttttgtgcgacgagagagtcaatagcgccatggctgtactgttgatccgcgatcaagtggctgagtgaggtgcactgtgaaggtgatacatggacattgggaatattaaaatactaccatgttgtgtgtgtaccggtatcacttggctagaatgaagatcgtactgaattgcataaggactctggtatatgctggactagtaggaagttaaataattacattagggttgttgacttgactcctgagggaatgtattagtccttgcgtggatgaaaagttagagttttgctgaattagacgtctcttagcatgatttgagattgtaccatgtatgcgtaaatgcgaacgtcaactaaatgttgtgatagttgaaaagtccttcaggtctgccagagtgactgtatactggacataaactctcatgattggcatttgtgcatcgaggtggttgatctacacaatgtgcgtaatcattatacgagtggtacaacacatctacgtgcttgttactcgctagttaaacttgtatcatttttctctcttttccccaccgatgttgctgcgagactaagcttagttgcgcatatgtctagggattacaacgacacatgtggcccacactggtctgtgatctttgcctctcacctctgttcccgattcacgtagtgcgactggttgagtttcgacagtccatgtcctaggtggccgtcatctgcgtggcgtccgccgcccgctcaagccctggggctcatgcgtgacacaccgttgactgggccctgcgcccccgtaatactggccggctcaccgacgggctcattgctccaggtcccgatactgcgcacctgtgtgcacattcgcctgtggtgcgtggttcacacgctctcacagctccggtatcttctattcgccacgcctcgggtgcggcgtcgtctcgccccacatcgcggacaccgtctgagcgcgcacccccacttcctataggcgagggggactcccccgcgctgtcgtcaca

SEQ ID NO: 514528 - DNA, 204 bp, Homo sapiens
  misc_feature (2)..(2): n is a, c, g, or t
anaggatccctcttctttgggacggcgctagcagcgacttaaactggtgcggacagtggatcgactgttaattaaacaagcatcgcgaatgccgctgcggtgttgacgcgatgtgattctgcccagtgctctgaatgtccaagtgcagaaattcaatgaagcgcgggtaacacggcgggagtaaactatgactctctttagggt

SEQ ID NO: 514529 - DNA, 111 bp, Homo sapiens
tttatgacatttttctttccatcagatttcatagtgtgatatttatcagcaatgacgttcccttgtatcttatcaattagggattatggggttcatgggatctgtctttct

SEQ ID NO: 514530 - DNA, 782 bp, Homo sapiens
  misc_feature (171)..(171): n is a, c, g, or t
  misc_feature (196)..(196): n is a, c, g, or t
  misc_feature (233)..(234): n is a, c, g, or t
  misc_feature (237)..(237): n is a, c, g, or t
  misc_feature (241)..(241): n is a, c, g, or t
  misc_feature (245)..(245): n is a, c, g, or t
  misc_feature (782)..(782): n is a, c, g, or t
gcaacttccaacctttggatcggtctctccaccgtcagtttagcgtcattccaaaaccacacccgtgcaaagctttgtactccgcaccccagatgatctccaggcagctcagatctctttcctgcctttgccctgcactgttccccggtacttcctcctttattgtagcancagctccccagccaatctgtacatncctcagaggcagcgatctgatgaattggtttttgaannccngaanggancgccatggagttggcagtcatcacggtagatggcgtatgattttgctgaattttaaataaaatgaaaaccataaaaaaaaaaaaaaaaaaaaaaaaaaaaaaaaaaatataaaaaaaaaaaaaaaaaaaaaaaaaaaaaaaaaaaaaaaaaaaaaaaaaaaaaaaaaggggcacaccaccccacgaagagacaaccggcccaaacaacgcgacggcgacggaggcgtcgcggcacacaaaaaggaagacaccaacaaaaaccgccggacactcagcagcaagaggaaaagaacacgcccgcaacaaaaaacagcggggggggagacacacagaacaagaaaaacacacggagcgcggacggaaccaaaaacagagagacttcgcggagaagaacacacatcccggagtgagagagtggatagataaggcgaggcggactacacaggggcacgtctacgccaaacgagagaagttacgcccagcccgccgcgcgcgaggaaaaacaccagacgcacccgcgccccgccacggggggcn

SEQ ID NO: 514531 - DNA, 1574 bp, Homo sapiens
  misc_feature (1167)..(1167): n is a, c, g, or t
tgtgcgcctcgggggcggtcctcgggctgcgcaccggatctcttacactcggcgcctcagaagtccgtgccagtgaccggagctggaggtggaaagcgggttccttgttgggctagaagaatctttgcaaaaatgtctctctatccatctctcgaagacttgaagggtagacaaaagtaattcagggctcaaacttggcttctccgtgcaaaccccttgccaatccaagcaattttggtcacgagagcttctggctccttaattccctcacggcatggcacattcctcctatcccagacttgtattccaggagctctcatcaataaccttgggggcttgacagtctcacacttggcggcacagacaataccgttgccaaattggttgaccccggtgggatatacccatgggttgcaacccaaaatttccagggggagacacgagttgtggatacgccagagaacccttaccaaggtacataaaccacgctactaattgggtggagacatccctttgtaagcttggcgctacattggcactgttggacaaaatacggagacgcaagcccacgaaacaatttctacagcacaacagcggcgaacttcgggctggaaaaggtcccattatgctgggtgttaacggtagaatcccaaggcatgggggaccaacaccatttggggaccatcacagggactttaacacgatttccacaattcaagcatttcaacgtgggggtgcataaatttggggtcgcccaggcctaagtatcacccaagaggaggcgttaaaattatgctttcacccaaggacccttcaccatattgctgggtattaggcgcactgtagggaccgacattttctcgggtggcgggacccccacaaatggttacacctttcgaccaagaaactatccacgattgtggggtcggaaacaaacacatgtggtgtgcgcgcaaggcgagcatttgtgagacgcctcctgtggagattatacaaaagtgggcgcgacacacagtggattgttgggctcacaaagacaacgggcgtctctttgtgcagacgacccgacatgcattaccccccattgtggactccaactttccgctgggcacaagggcgcccctttttggaaaaccggagccgaaatttacccccacttcggcattnatcggggatatagccactgtggacgcccttctgttcgggcgacacgcctgttaccaacacactgtgggagacacattacagcctccacatggtgtcacaggaatacgtcctcgtgtctgcccagagacagttgtgtcttttcccaggggcacgacaacacactctgtttgtaacaccacgtcgggcagcagtgtcttttgcagatcgcaggcgcgccgccaggtgggggacaaattgtcgacacagttgtaggccgagtataactacacagacagcggcggctactatgaaaccgaaattcaaagggtggactagcaattccatagcgagtacaaacaccttagtacaaaacaaaaggcgccaagtcacacattacctacttgtacaacgacgcagtgcaacacatt

SEQ ID NO: 514532 - DNA, 1472 bp, Homo sapiens
  misc_feature (36)..(36): n is a, c, g, or t
  misc_feature (68)..(68): n is a, c, g, or t
  misc_feature (96)..(96): n is a, c, g, or t
  misc_feature (405)..(405): n is a, c, g, or t
  misc_feature (424)..(424): n is a, c, g, or t
  misc_feature (435)..(435): n is a, c, g, or t
  misc_feature (598)..(598): n is a, c, g, or t
  misc_feature (625)..(625): n is a, c, g, or t
  misc_feature (633)..(633): n is a, c, g, or t
  misc_feature (650)..(650): n is a, c, g, or t
  misc_feature (668)..(668): n is a, c, g, or t
  misc_feature (692)..(693): n is a, c, g, or t
  misc_feature (700)..(700): n is a, c, g, or t
  misc_feature (708)..(708): n is a, c, g, or t
  misc_feature (711)..(711): n is a, c, g, or t
  misc_feature (721)..(721): n is a, c, g, or t
  misc_feature (727)..(727): n is a, c, g, or t
  misc_feature (732)..(733): n is a, c, g, or t
  misc_feature (735)..(735): n is a, c, g, or t
  misc_feature (738)..(738): n is a, c, g, or t
  misc_feature (743)..(745): n is a, c, g, or t
  misc_feature (749)..(749): n is a, c, g, or t
  misc_feature (751)..(752): n is a, c, g, or t
  misc_feature (757)..(757): n is a, c, g, or t
  misc_feature (759)..(762): n is a, c, g, or t
  misc_feature (765)..(765): n is a, c, g, or t
  misc_feature (769)..(769): n is a, c, g, or t
  misc_feature (861)..(861): n is a, c, g, or t
  misc_feature (886)..(886): n is a, c, g, or t
  misc_feature (923)..(924): n is a, c, g, or t
  misc_feature (927)..(927): n is a, c, g, or t
  misc_feature (931)..(931): n is a, c, g, or t
  misc_feature (935)..(935): n is a, c, g, or t
  misc_feature (1472)..(1472): n is a, c, g, or t
cattcagctgctgcagatgaactttgccaaaatctngaaatgtaacctcaccctacagatgaagatantagagcaagaaaaagaaattgcagaacnaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcancctcaattattttctcctntcaactctgtngaccctctgtctggtcttcctctagaaggtaccgcagaaattgatgtgtgcctccctgccctcgtcactgcccaagcccgggcctgcacatactcactggactgttccagttttgacagctgccagtcttcctgcccctttcacactgcagctgaagttcatnacctgaaggacgcctcatcatttcatnccttggcnccaaaccttctgctgcntctaagataaaagctcancctcctaacagcgcacagcgcgcnncccccanccccctcnccngccccccccncccccnccccnncnccnccccnnncccncnnccccncnnnnccncgcnccccccaccccagatgatctccaggcagctcagatctctttcctgcctttgccctgcactgttccccggtacttcctcctttattgtagcancagctccccagccaatctgtacatncctcagaggcagcgatctgatgaattggtttttgaannccngaanggancgccatggagttggcagtcatcacggtagatggcgtatgattttgctgaattttaaataaaatgaaaaccataaaaaaaaaaaaaaaaaaaaaaaaaaaaaaaaaaatataaaaaaaaaaaaaaaaaaaaaaaaaaaaaaaaaaaaaaaaaaaaaaaaaaaaaaaaaggggcacaccaccccacgaagagacaaccggcccaaacaacgcgacggcgacggaggcgtcgcggcacacaaaaaggaagacaccaacaaaaaccgccggacactcagcagcaagaggaaaagaacacgcccgcaacaaaaaacagcggggggggagacacacagaacaagaaaaacacacggagcgcggacggaaccaaaaacagagagacttcgcggagaagaacacacatcccggagtgagagagtggatagataaggcgaggcggactacacaggggcacgtctacgccaaacgagagaagttacgcccagcccgccgcgcgcgaggaaaaacaccagacgcacccgcgccccgccacggggggcn

SEQ ID NO: 514533 - DNA, 971 bp, Homo sapiens
gctgcatgaggggtccatatcggggttgttacttggattcccgtcgtagcttacagggaaattcacaactacaggtccggatcccttgatgtcctgcaaatgaaagaagaggatgtccttaatttccttgtcagcaggaacccacattaggtggcactcacttcttgcactgccagaatggaacaggacatctataaaaggaaaagtgatggcatgcatatgagtcgataatatgctcaaagaggacactgggcagaaggctttcatgtctggcgatgacgtcgtgcgatgtagtctgccatgtgaaaaccctgactgatgtacaggtgttatatcgctccaggaatactgggcagagggctgtgctgaagtttgctgctgacagtggaggcaactccaattgctggagcgcgttcactcctggaacctgtcactagagccagagttgcccgaggctaggccgttcccgagtgagtccagcgggcgtatcttctggtggtatactgatccccaggtcatgatgcatccgagggcgtgcctcaacggacggcatcttatgttaaccgtatggcctacctattgcgctgtgtacacacagattctcctctgcactatgtggacattgccatacccatgtcaaacaaacaagggagctcacgcagtgggttgattgtggtggatgctggctccgggaagctgggggcatggcggggcaacatggtcccgggaagcaccaaatgggaaggtcatgccgtgatgttggaactcctacaagaggaatcgtgcacgagatgaaactcgaagagggcagctggtgttgaaaagggccgcagccgggcggaactacggggcacggaaaggctcgaagacagaaacaccggtacccgcgggggtcacaacgggctcagtgcaagggccccggggaatccgacccagcaagtgggagcgggccaatgtcccgcccgagaccg

SEQ ID NO: 514534 - DNA, 120 bp, Homo sapiens
agagcttagggcctatagcttgttgataattgcagcttgtggcagtgtaaatatggctgaatgagcgtctaaatcgttgataccagtgcaactttgggtgcaaggctttgtttagggatc

SEQ ID NO: 514535 - DNA, 143 bp, Homo sapiens
gggattcgtgaaagcggcttgtgtatgcaggtgaggtgtgtgggggattgggcggggttatggtggatttgtatcaacgtgcagtcgagggatgaggtagtggagggggaaggcctggagcgatcgatacacaagccgcttca

SEQ ID NO: 514536 - DNA, 186 bp, Homo sapiens
  misc_feature (78)..(78): n is a, c, g, or t
agttccgggtcccccacgtgacaagcgcagatacgccacaaataccacggggtcaaaggctttcaagatatatgtgtngggggaaactattttttaaacacgggggaatacacgggaaatcttcagggaaaaacacatttaaacactttttttttttttttttttttttttttttttttttttttt

SEQ ID NO: 514537 - DNA, 108 bp, Homo sapiens
gagagatggccagcaggaaggcgggacccggggcaaggtgtgcagccaccaagaaggcccaacgtggttcttccaacgtgttttccatgtttgaaacaagccccagat

SEQ ID NO: 514538 - DNA, 355 bp, Homo sapiens
  misc_feature (281)..(281): n is a, c, g, or t
  misc_feature (346)..(346): n is a, c, g, or t
tgtcattttgaaactgtagagtccctatttcggtgtgatgaatcactgttgcctttgaaaaatcctcattatttctgggccgggcatggtggctcacccctgtaatcccagcactttgggaggccaaggcgggtggatcatgaggtcaggagatcaagaccatcctggctaacatggtgataccccgtctctactaaaaatacaaaaaaattagttgggcatggtggcatgcacctgtagtcccagctccctgggaggctgaggcaggagaattgcttgancctgggaggcagaggttgcagtgagccaaaatcatgccactgcactcccgcctggcaacagagcnagagtctgt

SEQ ID NO: 514539 - DNA, 1224 bp, Homo sapiens
ggtgccgcggacgcccgggcagccacggcggcggggccgcggcgggcgcctggctcagtccggccctttctccctgccgtcctctcccgccccgctccgcgcgccgtcgcgcgggcgtcgtgtcagcgtcccgtcagctgtcctggcctgatgtgcgcaggtagtactgcttgtagcgcggctgcctgcaggtccggagtagcatccagcggtcctggggtccttagcgttccttgcttgcaggaccccggctcgtgccgatttctcgcctctgtctcttccagcgttcttcattgaaggcccgcttggctcgatgttcgtccgtcggacggccccggcggccgggcaagggggacccaggtgcgccgccgacaatctgtaccgacgaaagaattatgcgctacaacacaacacttatctgcagggagaagcctgcttcgatgattgaacacggacagaaacccagaatttccacagttattaggtgaacctttagttgagaaaagtcacagttacaaggaaaggaagacgagtgggtaccaacgttgggagaataaacgcgaatcaggttatatttaagagaaggggcaaattgggaatcaagagcaaatgggctggcgcaagtggcgtcgagcaacgcaaatacacagtgccgtaggcatttgacgtgggggatttccaaccgcaacaattcaaggaacaaacctttcaagggattggaacacaagacccaattggactgcggaagcgcccgaattgctactctattcccggtttcatccatatttagtggaccatgtaaattaatggaagaattgtggaattggaggcgaattgtccttgacgaagggggcaacaggagtaagtggttagggaggtagattgaaaaatcaggagcaaagaagtattgaacgaaggaaggaatttcagaacgttaacctttcaggggtcacgcgcaagaaggccaaatatcattgcaccttcatatggcacgcaaactggtgtcgcaaacagtcaaggaccaccccggacgggccggaccaaacgagagacacaaggcggatagacgccaacactgtgccacagttatcggaaccagggcccggacaccacaccccggacacaacccgggacagcaccgccgaacaaacggcgcaaaacggcagcaccaaggaaccacgagtgacgggcaccaccgaacgcgaacacccccacacacgagag

SEQ ID NO: 514540 - DNA, 723 bp, Homo sapiens
acccgcgaattcggccattatggccggggtctatgcctcaggcctgttttaagagcgctctgggagaccaagactatgacggcaaacaagatggaccgcttgatcacggtcatgaagatccacgtactcgcggacaactatctctactccctgcccatgaacgaactcacgtgcattgctatgattctactagactctatcaatgacgcggtgatcaacattagtccagagcagcagtcgacccgtatctcagagctcacaaggttccagtcattacatggtaccagttacaagaatcttcacgtgaacgcggataacaagggcaacatggatctggacgacgacatctgcaaggacatcagcctggccaagcgctacaacgatctgtgcgcaaagactactagagccacaagagcgtccagcccgacactaacccatgaatgcagtctgaccatttcccttctacggtgagaagactcatgcattcagacaaagtaccagcaattgcttcagcaaagtgggctaatatgctagtcggaccttgggtacagagctcgggtcaaccgagcccttaaatgcaccgtcatcctggccactataggacccaccttgtttgctaagagccactttaacacacccctagaccctttaacgatccggctcaaccaattaacttttaccagctaccaacaccccgtcagggcctccagcgctctatgcgcg

SEQ ID NO: 514541 - DNA, 133 bp, Homo sapiens
cttggcggacatacttggggtgggcgctgtggggcaactttacgatcaaatcagggagctgcatgcacttgaaaggcatggcctgtctactcactggagtgcgaggtccatgcaccaaagcgctgttctgatg

SEQ ID NO: 514542 - DNA, 428 bp, Homo sapiens
  misc_feature (27)..(27): n is a, c, g, or t
  misc_feature (80)..(80): n is a, c, g, or t
caagctcactgcaagccttgaccttcngcgaggttccccaaagtagctgggacccacaggtacatgcccacccatgtccnagctttttgtatttttgtcaagatggggttttgactttgcccatgttgcccaggctgttatacaactcctgggttcaagaaatctacctgcttcagcctcccaaagtgctgggattacaagcgtaagccaccgtgcctggccctgtgcaggtttttaacctgatgtaatcccattcgttcatttttgctttggttgcctgtgcttgtagggcattattcaaaaaatctttacccaatccaatgtcctggaaagtttctgcactgttttcttttctttttttgagagatgggtctcactctgtcaccccggctggagtgcaatgggcaacaagagcaaaactctgtctc

SEQ ID NO: 514543 - DNA, 1464 bp, Homo sapiens
  misc_feature (628)..(628): n is a, c, g, or t
  misc_feature (653)..(653): n is a, c, g, or t
  misc_feature (747)..(747): n is a, c, g, or t
  misc_feature (885)..(885): n is a, c, g, or t
  misc_feature (962)..(962): n is a, c, g, or t
gtgtgtgttgatgtcctcaatcctaccaccttgttctagtagcctcgctggtgccttctttcgcggggatgtcacaaagatggggggatatgtgatcgtttctccgttggccaccaaggggacgtcgggttgtcaccacgaccccggcgttgtggtgggcacaccccgttggcccagcaggcaacacgtttacaccccgggaatggttaaatttcccttctgcggaaatggtcgcccccctatggagccttttttggatgtagaagcctcttctttctcccgggggggaaccaacatgggggggcccttcaccaaaaggccccaaaggaaaggggtgcccgtccaaagggaaatgttttctctcggtgggcaaagaggtgtgcgcggggtgcgaccacgcccaagaagaagtgggaccccccgcccaatgggggagagaccagacctggggctttccaacctaggcttacaaagggtggaatattaattcccttggggacccaacatcccaacgagccccacaaattataagcgtcctctcggccttaattggcgccccccggtatttggggaattgccccacacccccgcggcttacacacacttggcaacagccaagagttttgtncttcgaggactcgtaacagcgaganagaagactttgtagttccccgctgcttctgggtgataaaaacgacctgcgagaagagttgggcccgcttagaaaagtttctctttggagaaagntctttgtgctgagattagtcgttggcccaccattgtggtttgagaaaaaatggggtttctacctggggcacaagcccacacatgggtgctgttgttgagagagagccttttctttcacagagacgtatatccaacccncttttggtgggtctctcgctctttgcacactgtgtttctgtgagattaataggagagacacacagacacacagtttntccccggtttgggtcgtgtgtcactccccaaagcgccacagtgtgggacacacacagagaagggctctgtctcgggagagctcgggcgcacacaggtgcacaccacacagtgtctctgcccacacgagaaagtctctcacagagagggctaaaatgagatatgtattccctcatatatcctcgccacaccccacacttcttaaatacacgtggcgtggagaaagaccggtgtctcacgagaactcgttttgtgttcacacttggccactttaaagtttaagtagtataaagagcctggttaaatgagtaacacaatgcacatctgtaaaccttcacgagaaggaaaaggaggaaatgttttgtggagccacctttggttttcttttttgcgtgtggcagttttaagttaattatgtttttaaatcagtactttttaatgggaaccacttgacccaaaatttgtcccagaattttgagaccccatttaaaaagttaaatgaga

SEQ ID NO: 514544 - DNA, 657 bp, Homo sapiens
  misc_feature (3)..(3): n is a, c, g, or t
  misc_feature (81)..(81): n is a, c, g, or t
  misc_feature (87)..(87): n is a, c, g, or t
  misc_feature (137)..(137): n is a, c, g, or t
  misc_feature (159)..(159): n is a, c, g, or t
  misc_feature (260)..(261): n is a, c, g, or t
  misc_feature (265)..(265): n is a, c, g, or t
  misc_feature (270)..(270): n is a, c, g, or t
  misc_feature (294)..(294): n is a, c, g, or t
  misc_feature (296)..(296): n is a, c, g, or t
  misc_feature (309)..(309): n is a, c, g, or t
  misc_feature (335)..(335): n is a, c, g, or t
  misc_feature (337)..(338): n is a, c, g, or t
  misc_feature (347)..(347): n is a, c, g, or t
  misc_feature (352)..(352): n is a, c, g, or t
  misc_feature (354)..(354): n is a, c, g, or t
  misc_feature (386)..(386): n is a, c, g, or t
  misc_feature (453)..(453): n is a, c, g, or t
  misc_feature (470)..(470): n is a, c, g, or t
  misc_feature (511)..(511): n is a, c, g, or t
  misc_feature (544)..(544): n is a, c, g, or t
  misc_feature (556)..(556): n is a, c, g, or t
  misc_feature (566)..(566): n is a, c, g, or t
  misc_feature (593)..(593): n is a, c, g, or t
  misc_feature (612)..(612): n is a, c, g, or t
  misc_feature (614)..(614): n is a, c, g, or t
atntaatcatgcagaaagtgaatttcctaaggtcttatgctcaatgtatactacaaatctagcaaagctaaatgataaganaatagnaaggacaatttatttctatataacagagcatatactcccaatttgctgcnacttcaaagagcacttttagantcatctaacttttacacggctctttcaagtgaagttcatgcgacgcactgagttattaatcctatcatcaagacaaatagtaacgcaacagaagaaatatnncgcnaagcnaagcattctgttaaaaaaaaaagngntaaaagctaaccncagaatagtgtcagttttggtttgcngnnaacccctgngattntntaaaccaaaggcgttaagacaccaaatagtcngaggtaaattactaagagaattacattcatacatggtgtcatcacgcagcttatcttttagaaggtnctttgttaccatccagnaagcgttaactgcttgggttttttcgaggaaatatgtggantattaagatgtttctaaaaaattatcttttccntttgaaaatgtntctcatttgnagatagtagaattacaataaactttcnatcacggcactgctaattntnctagaacagcaacgaatgacttttaagcctatcggttatttcc

SEQ ID NO: 514545 - DNA, 211 bp, Homo sapiens
caccgagtatatggtcacaagaccggtccgtgacgatctaacgtaaacacgtacagtacagcccggcacaatggccagattgcaggcccggagcaggcgcgttcgtccacgatccctccacggacacagatcaccacacgcacccccttattgcactgagcaaaggtgtagtcatacagcaagcctgtcgaggagggcaggagacggagtg

SEQ ID NO: 514546 - DNA, 241 bp, Homo sapiens
  misc_feature (233)..(233): n is a, c, g, or t
tggacctctccctacgtatctacctgcagagcagaggagatgtatggctttatcaatgtcttggtaacactccgctgataaggccatagaaagtatgttgctctttgatcacgtcatctaaagatttaaacttgcatgatatgctgcactggtccacacaatctcctcttgtggcaatgcgcatctcatcgtgtaacattagcagaacactgtgggctcggacacaagtagcnctttattc

SEQ ID NO: 514547 - DNA, 355 bp, Homo sapiens
tgagatgaagtctcactcttgtctcccaggctgcagtgtgatggcatgatcttggctcactgcaacctccacctcccgggttcaagagattctcctgcctcagcctcccaagtagctgggattacagcacctgccaccatgcccagctaatgtttgtatttttagtcgagtcgggtttcaccatgttggccaggctggtcttgaactcctgacctcaggtgatccactcgcctcagcctcccaaagtgctgggattacaggcatgagtcaccgtgccccgcctggtgtttctttcctctttaactctcacattagtaacttcatcttcttttcttttttttttgagatgtcgccc

SEQ ID NO: 514548 - DNA, 148 bp, Homo sapiens
tctgctacctctttctggccacgcaggtagacaccagctgctgcaggcgaaggagacccagggggagaatcgcttgaatccgcgaggcagaggttgcagtgactcgagatcaccaccattccattgcactctagctcgggcgggcgtc

SEQ ID NO: 514549 - DNA, 136 bp, Homo sapiens
ggaccattgagtaacaggatctcattctacccagatgtcacgagaaatgaacaggaacctatcaatgtgaaataagggaacgatataggtggcataccgcagtgacccagtcaccctgacatgtcctactataggt

SEQ ID NO: 514550 - DNA, 138 bp, Homo sapiens
gatgatgtgcagaagggaggaagggaaggaaggaagaggaagaaaagggatttctggagatgtagagagcgtagcatttgttctgaacctccttggagtagctgatagaaagaatgaaagcttctttctcctggctgt

SEQ ID NO: 514551 - DNA, 424 bp, Homo sapiens
ccgcagtctggggcttggcagcgtgggctgcggtcactggtcccaggccgcttggggagtcgctgcactgatcgctcacgatcctgccacgctgcaggccattgtacttcatacggccattgtatgtgctcgtaccaggccagctgcctcattgaggagcgctaaaaatgcagctggtccatccggggaccctgaggagcccagcagcggcttgcccaggtggcttaagcagtgacccaggctctgtaaccgctgtgtccgctgcctacctggccagcgcgatttgaataatgccctaatggcctgtttggattatgccacgcatgcgactcctgacctcacttgcctcctcctagcactggcacatttcacgaagctcacagccggttgatatatcctgctgctgtgctgaatcaggccgccc

SEQ ID NO: 514552 - DNA, 120 bp, Homo sapiens
agctattcaggtgactgaggtgggaagatgacttgagcccctgaagcagaagttgcagtgagccaagatcacgccactgtactccagtcctgggtagagagagccagacgctgtctatag

SEQ ID NO: 514553 - DNA, 165 bp, Homo sapiens
caattgtatgttttatccaatacagtaatgtacagttgctatatcgcccagactccatactgtagccctttaacctaaagaagaatgttatacaacagcctgagcaggacatttttcatgggatactaatgctggagtgacccttagaggtctaatatgcaatca

SEQ ID NO: 514554 - DNA, 962 bp, Homo sapiens
  misc_feature (21)..(21): n is a, c, g, or t
  misc_feature (103)..(103): n is a, c, g, or t
  misc_feature (211)..(211): n is a, c, g, or t
  misc_feature (257)..(257): n is a, c, g, or t
  misc_feature (525)..(525): n is a, c, g, or t
  misc_feature (566)..(566): n is a, c, g, or t
  misc_feature (568)..(568): n is a, c, g, or t
  misc_feature (572)..(572): n is a, c, g, or t
  misc_feature (624)..(624): n is a, c, g, or t
  misc_feature (641)..(641): n is a, c, g, or t
  misc_feature (656)..(656): n is a, c, g, or t
  misc_feature (673)..(673): n is a, c, g, or t
  misc_feature (712)..(712): n is a, c, g, or t
  misc_feature (734)..(734): n is a, c, g, or t
  misc_feature (739)..(739): n is a, c, g, or t
  misc_feature (753)..(753): n is a, c, g, or t
  misc_feature (764)..(764): n is a, c, g, or t
  misc_feature (782)..(782): n is a, c, g, or t
  misc_feature (805)..(805): n is a, c, g, or t
  misc_feature (813)..(813): n is a, c, g, or t
  misc_feature (834)..(834): n is a, c, g, or t
  misc_feature (842)..(842): n is a, c, g, or t
  misc_feature (850)..(850): n is a, c, g, or t
  misc_feature (863)..(863): n is a, c, g, or t
  misc_feature (879)..(879): n is a, c, g, or t
  misc_feature (882)..(882): n is a, c, g, or t
  misc_feature (898)..(898): n is a, c, g, or t
  misc_feature (943)..(943): n is a, c, g, or t
gagtcagacccaggccccagntctcgggaagcgcacagtgtgaaaataggtaactacaaaaacacagccaatgagtgccttgaaacaagggagaacaaaaaanagaggttgtgtgcgaaaacctggaatcaaaaactaaccgcggagaaagggaggaggatgtgctagactcccagagaagagcgggggaacatccagaaaggctctggcngccgacacagccacaccccctaggtctctggagtgcactgcagggnggcccatggcagggaggggtagaccaccttaccaccaggctgcggagaacagaggagcggggtctttctgacgcgggtgccaaggcgcccagcagccaccagggctgggagtgggagggtgtgctcaggggcccagcactgagcgaaaaaatgggcgtggaagcggagggggtgaccaggatagaccagggagtcaccgccgaacttgccagcgcgcactgaggaagaagcctcgctcccacaggcctctgtggagactgtggcgcanacgtgggcggggcggccggcgtggggccagtgtttagactngnacangccagttcagggggcctggccttgaccggtcgaggcctggcagttgccagcnggacaaggagagcaganctgggcaagggggcnaccccaattagagggtnctgcttgggaagacgaggggccagcttcctcctgctctnccgaagcctgggcatcactggncttancctctttggcagcntggctcgagcnggcctcctggcttgagcnggcccctgaagcctgttctagtntctgcttnttagcagcctggccctccgtnatcttctncaggagcncctgaagacgggncttccgggccttaacngcnaaggcgctctgctccnggaagctcttctcttgctggcgctttaaggatgttagggccaggntgttgtgccgagagttttg

SEQ ID NO: 514555 - DNA, 564 bp, Homo sapiens
gtggatcataacaccagaaccacaacgtggcaatggcctaccatggaatctgtccgatattgtgaacagtggcaatctcggatggaagcaattgcacgggaggctatgcacaccagtttaaccaatgatacctctattcggattcaatgttagctgcagagacacatgacccttatggacctttgccaccaggctggaaaacaagatgtggattctgcagaccaggggtcctcactttgtgaatcatacacataaaaactatgccagtgtgaaatgatccaatgaattcaaggctttactggaatgatgaacccctgccagaaggcttgggaaattagatatactcgtgatatgtgtacaggtacttatgttgagtcattaacgacaatgaacaaacaacgattcaactggatgcctcgcaatggtgaagtcactctgtaaatcttcaaggtgcgtccacagaattgtttacttgaacgcgggttgcatgtggaaaggcttgatccacttccgattatttgttgcgaagtcctaagtgcattaccttagttcctgtaaaaagtc

SEQ ID NO: 514556 - DNA, 161 bp, Homo sapiens
tctgtgatgcaaagtgttgtaagtcgatggagctgtgaagctccttttcacaggtgcagaagagacctggtgctgcggattgatctggcccaccataaggaccaggattcaccattgcaaataaaaccccaatgtcccagctgggcactttgcatccagag

SEQ ID NO: 514557 - DNA, 408 bp, Homo sapiens
tactccacaggcgaagtctactagctaactcgggctaactcatccaactggatgccggttagtttttttctcttgcctgatttctctggctaggactttcagtacaatattgaataggaatggtgaaggtggataactttgtcttgttccagttcttagaggataggctttcagatatttccctattcagtgtgatgatagttatgggtttgttgtatgtggcctttattattttcagatatgctctttctatgcctagttttgtgagagtttttatcatgaagggatgttgaattttatcaaattttcttctacatttgtcgagataataatatgatttttgtcctttattctgttgatttgatgtatcatgtttattgattcacttatgttgaaccatttttgaat

SEQ ID NO: 514558 - DNA, 306 bp, Homo sapiens
aaaaggggaggaaattgaaactgagtggaccacgatgggaaggaggggaaagcccaggtgtacaggaggcctctgggtgaaggcagaggctagcactggggttcggagcgacctgtggccgttggcctgaccatctttggtgctgtctgtcggtctactatcgatcgatcgtgcgtatcacctgcgtcctgactgctgccattaacgaagacggtgccgcggcgacgcaacgtccaggtggtcaccgagacgaccacatccaccgacgtgtggtgcatgccccgttatcactcagcctccaagtgt

SEQ ID NO: 514559 - DNA, 245 bp, Homo sapiens
  misc_feature (43)..(43): n is a, c, g, or t
  misc_feature (108)..(108): n is a, c, g, or t
  misc_feature (135)..(135): n is a, c, g, or t
  misc_feature (139)..(140): n is a, c, g, or t
  misc_feature (159)..(159): n is a, c, g, or t
  misc_feature (164)..(164): n is a, c, g, or t
  misc_feature (166)..(166): n is a, c, g, or t
  misc_feature (175)..(175): n is a, c, g, or t
  misc_feature (182)..(183): n is a, c, g, or t
  misc_feature (209)..(209): n is a, c, g, or t
  misc_feature (214)..(214): n is a, c, g, or t
ggagactggctctcactcctccattgctgcccattgggatggnatgaacttcacagctctggtttcctctgttcttctctcagctgcaggtgatttaagcttgttggntttatataacattgggaaatggtaaantgtnnaaatttgctatgttttccnggggnangttatttanggaaggnnatttttaactcgagtgctagaagtgntaaancattataataaattcatgctattcagacttt

SEQ ID NO: 514560 - DNA, 1118 bp, Homo sapiens
ttcttttgtttcttcgtcttctctctcttgttcttcgcgttgtgtctcctcgtcttcctggcttgtctcttcgcttttgttcgtttgtcgttctgtgccgtggtgttctttgccctttcttcttccttcccctcctcttctcttcttccgctctgttcttcttccttgtcattcgcctgtccccctctgtctcctctcttctctcgtcttcttctatgtccgtccctcctgtcgttgtccttgttcccttccttgtcgtgcttctttttccttctctgtgtttccttgcccccttgtctcctttcttctgtttgtctctctccgctctccgctcgtcgcggttgcctcttgccccttcttgccctctctggtttcttctccctcctgccgttgcccctgctgttctgttccctctcctctcgtggtttcccttgtggctcatccttttctttctctggcttgcctctgtcttctttgctccgctctgcccctgccttctcgccgtgtcccttttcctccctctctatttctctttgcgccctctctctattgttggcctcgtctcctctcttgtctcacttgatgtgttacttcttcctgtttctctggttttttcgtactctcagtctccgctcttgcttctgtgtatcctctttctcttccttttttgttgcccctgttcatggcatgcctttgtttattcctggacgttcctgtgtgtagatatgtcccttgggcatgatctatatgttgtgcatgtctgatagtacttttgggtgtatttgtgtatgctattgtatcgtgtgttatctgggatggttcccggctcatccttgtctgtaaggagatcttttgtttgcttctccctgcccgccggaatccatcagtgtctctgcttctctgtgtcgccccgcccagccaccctggtgtggagggaggggtctcgtttgtgcgctgtgggtgtagctttgtgcatcctctcccagtggagcgatcatcctgtgcctcccctcctccctttgtttgctcctgtgtggttggtaaggagggatgtgagggaaataggaccccccgacttgccctcctgcctcagtcttcattacaccgggtcttcatgt

SEQ ID NO: 514561 - DNA, 987 bp, Homo sapiens
ccacgcgtccgactagttctagatcgggagcggccgcaccttgtcatgtaccatcaataaagtaccctgtgctcaaccaaaaaaaaaaaaaaaaaaaaaaaaaaaaaaaaaaaaaaaaaaaaaaaaaaaggggggggcgcggccacgcagaaaacttctccctccgggggggcgccgcaggatctacgcaccgcgcccccacgttgtttgttgtcaagagagggggcgccccgataagagggaggcgattattatataagcagtagcgtgcgcgcggggcgcgcgagcgtcgtatacaaaacacggcgctaggagatccggggagaagaaacgcgcggcgcactctggggagagccttctgtgggagaaaggaagcaccacttaattctcggggggggggaggagaacaatattgaggagagagacaacctctcctctataggaagagatttataaaagccttctgtggggggagaaatatattaaacatatttatagacgaggggattataaggggggggtctaaacaaaaagacaggggcaaaataatgatggatagggagagcggagagagaaaaaaaaattatgtggcacataactgagagaggaaaatatgtatttataatgttagaaaacagaatatttatttatatccagcgggggagtacttttctttgttatatataaataaaactaaaagaaaagaaaaacagcaaggaaaaagagagaagaaaaaagaagaaaaacaaaaacaagagacaacaaaacaacaaaaagacaacaacaaaaaagatgaaccgagaaaacacagaagaaacagcaaaaaaaaaacaaaagaggagaaaaaaggagaaaggaagaggaaaaaggaaagaagaagagaacaacaaaacaaaacaaagaacaaagcaaaagaaaaagacaaaagaaaacaccaacagaatgaaagaaaaacaaacagacaaaaagacaaaaaagacaaaagac

SEQ ID NO: 514562 - DNA, 566 bp, Homo sapiens
ccctgcatgcttgctgctgcacgtctgagtcttgaggatcccctacttttcacgggaggaaagagctgattcacgagagtctgaaacgacagtctctatatacaactgtcatagtgttgatagaagagcagtgaagttgtcctgggttttaataccttggtgaagcacggtttcattcattgagatagaaaacacagaacgagtatgctggattgaagttggggaagtgatgttttgaacttgtctcgtgactgacattcgcctcacatgtcagataagatttcaaggctggagatgcagatttacaatggaatcaatggcatataggtggtagtagaagaaaacagaagatgagctgccacagggcaaacgtgcagaatgagcagagggctgagggctgaactgtaggggaggctaaggtttgagaggaagggaggacagtagagagaagtccaaatatagagcagctggacaagaaagaaactgaggagacatggataactcagaaaacaggtgggcaacattttaaggagcagagagtggtcaagaacaccaaatgttgtgca

SEQ ID NO: 514563 - DNA, 360 bp, Homo sapiens
  misc_feature (44)..(44): n is a, c, g, or t
  misc_feature (65)..(65): n is a, c, g, or t
  misc_feature (129)..(129): n is a, c, g, or t
  misc_feature (171)..(171): n is a, c, g, or t
  misc_feature (180)..(180): n is a, c, g, or t
  misc_feature (192)..(192): n is a, c, g, or t
  misc_feature (215)..(215): n is a, c, g, or t
  misc_feature (344)..(344): n is a, c, g, or t
aaagggttaaggggaaggtcctccctgccgggggttggcctctnaaaacctcaggggttcctaancctgttgaaatatacccccccctggtggtggccccctccgatgtcccccactgatggctctganaccgtgttggtggcgatgtccccagaaaatcccacccagganagcccaganatccctaactgnttcgctggtggctcatctcgaanatccacgccagcctttctggggcggccacccaggccgcctgcccgtctgtcctccctccagcagcaccccctggcccctggagtggtggggccatggcaagagacaccgtggcgtctcatgtgaacttncctgggcactgtggtt

SEQ ID NO: 514564 - DNA, 314 bp, Homo sapiens
cctttgggccccccccgtttttccctttttttttttgggccccctcttttggggccccgggctttccggcccctgcttccggggggttgggtttggcccccttttcccccctgcccccttttcccccccccccggtttccccccgcgggggccccccccccggtggggcccccccccgggggggggcgcccccggggccccggcggtggcgcccgggtttcccctggggccgggcctggggggccggcctccggcgcgggggggccccccgccccggggcccccccccacccacaacaccaaaaaaaaacccca

SEQ ID NO: 514565 - DNA, 759 bp, Homo sapiens
agtatctatgttatcagtttgggtactggagccataaattaaaaaaaggttctgtttggttaggtgcttttcgctgtaatcttgtataaaaaacattggttattttttaaaagagcatttacaaataaagcaaattgctttattttataaaacttttttaaaaaatgcaatttccttaattacattaaaaatttaactataaaattgggtaaccacatgtttttcttagttctgaagcctgcatattaaactgaggcgtatgttggatttgtcttttcctttccagttttataattgataggctatattggtagtgacagaaagtacttccatgctaaatataaaactaaaaaggcaaagtactcaaaattatttaaaagagtactagattataaaattagctttagtttacacatatgccagttatagcggtagatggctttgaatctttacaatgcaaatacttttaaatatgtctttttttggtcgaaaagttctgtcctgtcagaatcacaatgtattaggaatgtttcacatcacctgaaacactccagccacagaatcgcagatgtgtgagaatggatgccctgttattaaaagctacaagggttagttgctcagacaaaagagtcactaactatcttcacaacggcttgtatctccatattcttcatgtaatttgccgcgtctccaagtctgacccgtacactttgcttcaaagcttttcagctaattccctcatggttcaatacgtggtaa

SEQ ID NO: 514566 - DNA, 112 bp, Homo sapiens
ctatcaggacccgttgcagcgaagctggtcagacagccgtggctccagcttcccggccctcttctcgtggttggggacaatgcaccggacaaaactggggttggtgttgctg

SEQ ID NO: 514567 - DNA, 300 bp, Homo sapiens
acggcgttatgcatggctccatctcggctcatcccacctgtcacccgggctggagtgcagtggcgccatctcggctcatcccaccctgtcactcgggctgcagtgcagtggcacaatctcggctcactgcgtcctcaaaattccaggctcaagccatcctcccacctcagcctcctgagcagctgtaaccacaggcgcatgccaccatgcctggctcacttaaatcttctgtagaggcagggtcttgctatgctgcccaggatggtcttaaaccccttggttccagccattgcactccgg

SEQ ID NO: 514568 - DNA, 671 bp, Homo sapiens
  misc_feature (72)..(72): n is a, c, g, or t
  misc_feature (527)..(527): n is a, c, g, or t
  misc_feature (578)..(578): n is a, c, g, or t
gtcactcccagactccttgcggagttcgccgcctgattctaggctggtcactactccgagcctgtgacgttngcggcagccaggccgtcgacgatgcccagtgaaactctctgggaaattgcaaaagctgaaggtggaaaaaaggggaattaagtggaagtgaaggtgatggagctgaaattgcagaaaaatgtgttttcttcattggcagtaacaatctgggggaaagactactattattctagaggtgtcttgacagagatgaaccaccaaaaccaaccttagctttggcaatatacatatggaagaagagcaaaagggcacaacacaccaaaaagatatcgctcacttgtgggaactcgggtggaggaacctctttattggacttaatcagcatacccatcacaggtgacaccttacggacgtttactctgtgttctcgtgctggatctttcaaaaccctaagtgatctctggcccaccatggaaaatctcttgcaagccaacaaaaagccatgttagaccaangtgataatgaacactggggaaagaccaaagtgctaaagcggtttctgaacntgagacacgacgaatctgcactactctggccgccggatcttctcagggaccatgacttctttgacccactccggtacctctggtcatattgga

SEQ ID NO: 514569 - DNA, 948 bp, Homo sapiens
  misc_feature (188)..(188): n is a, c, g, or t
  misc_feature (282)..(282): n is a, c, g, or t
gatcgttctgtgcgccatattgctgcccctggtgtgttgcgttgtgtagtgtctagtagtaccttgctgttcacgcttctgggaatactagccaggatgacaagggaagttccgtgtctattgatgtatcaggcttatgacaagtacaccactagtcggcgttacgcgtatcctcgagacgtctggtnccctccacatgatgagccgatgtggcctttgcgcgttcggcttctgcttacaacacgctgcatgttcaacacagtataatagctcttggaaagngattcttggcaacctgagaatagacgacactcccattccaagagctgataagtagatacactatcatctactacgtcacctgatgtctccaggggtgatcagtatgtaacatcggtgcactcagtgggcttgctaactgctgctggctgagatgggaccagtctaccactctgaagctgactctgcacgacccccggatggactatcatgtgatctggtcatggcatgtctaatgtgtgagatgcccacacaggcatattccacattatgaggatgtatagcgcatgctaggtccaccttatctggattcacagattcgactatactcacattcaagacaacactgtggctcgaggctgttgttgtggaatccggcgacgctggtggcctctcggtgctgattcctggggtctcttctcgtctcctctgacatggtgtgtcgtgctcttcgtggatatgcagtacgggcccgggcatcgtgttcagtcgtctccctgtgtagagcgtcagcacgtgcccttggttccccggcttggcggatgtgtgccgtcccctcgtttctctgcctggtgtccgacgcattgcgcgagggtccttgcttggggggttttccggcttggggcgcccgtgcggttttggattcccccgggcgtccggggcgggctg

SEQ ID NO: 514570 - DNA, 217 bp, Homo sapiens
aggcgtatcccataatcatacaaagccccagcccaataggatcctcccgaatcaaccctgaccccactccttcataaattattcagcttcctacactattaaagtttaccacacaccaccacccctatcatacatctttcaccacacagcaccaatacctcacctcctatcgcttaacccctactacaaacactacaccaagtcacctccccccacc

SEQ ID NO: 514571 - DNA, 312 bp, Homo sapiens
gaagttagttttttggcccggggcctttaatttttttaatcaccctaattacatcaggatagaggtagagtttttgtaaaaaaaaagacattaagagttcctgaaatttatatttggcatacggataggcttatattcaaaacattttagtcatacgcccataaattaaaagtggagtccctaaatagtttgcagtacgtttttaaaataagggtaggggggtatcaaaccaagacaaatgctgttcagggaaaaaagttggcaagcttaaggttaaacaaaaataaaattacatgggttttccccttccta

SEQ ID NO: 514572 - DNA, 702 bp, Homo sapiens
  misc_feature (72)..(72): n is a, c, g, or t
  misc_feature (527)..(527): n is a, c, g, or t
gtcactcccagactccttgcggagttcgccgcctgattctaggctggtcactactccgagcctgtgacgttngcggcagccaggccgtcgacgatgcccagtgaaactctctgggaaattgcaaaagctgaaggtggaaaaaaggggaattaagtggaagtgaaggtgatggagctgaaattgcagaaaaatgtgttttcttcattggcagtaacaatctgggggaaagactactattattctagaggtgtcttgacagagatgaaccaccaaaaccaaccttagctttggcaatatacatatggaagaagagcaaaagggcacaacacaccaaaaagatatcgctcacttgtgggaactcgggtggaggaacctctttattggacttaatcagcatacccatcacaggtgacaccttacggacgtttactctgtgttctcgtgctggatctttcaaaaccctaagtgatctctggcccaccatggaaaatctcttgcaagccaacaaaaagccatgttagaccaangtgataatgaacactgggcataagcacgaagatggctcaaaggccagttttctggacaatgcagtaccagagagatctgggcaagttagtatgccgcaagggatcagtcctggatcatggagattaggttgacccatttccggtaacctctggtcatgattggagagtaaatatg

SEQ ID NO: 514573 - DNA, 312 bp, Homo sapiens
  misc_feature (8)..(8): n is a, c, g, or t
  misc_feature (13)..(13): n is a, c, g, or t
  misc_feature (140)..(140): n is a, c, g, or t
  misc_feature (205)..(205): n is a, c, g, or t
aagatggngttcnactgtagaacacaggccattggagaaactgacttatctgattataggcattgtccatttgtctctctcggaattctcacttgcttctcttctcactctgataccttgttctccagcaaaaatcttanctgatagaaccaagattctgaccttgtgagtattatttctgaagcgcagggacagtgataagtgnaaagtcagtatcttctactgattttgagtttactttggattatgtttgatcaaaagctacatgtggcattgtgattcaaataaataattgttttatgtcttgtatgt

SEQ ID NO: 514574 - DNA, 133 bp, Homo sapiens
aagctttttttttttactaggatggatttagcaaggttcctgcttcattctgttactactttctttatcagaaagggttcagacaggaaatagatggtgggctccaagtggctgtcaaagagagttttaagaa

SEQ ID NO: 514575 - DNA, 833 bp, Homo sapiens
ggctgagcaaagttcagcaagtagagcagagtttggcaggcaggtgccatggaactccccttcttcctggagtgccttcattgaggaaggaaatctggcccttgggtttcctggttccactgctactgacccagaggggaatgagggctgagttatgaaaagataacttcatgaagacttaactggcccagaaagctgattttcatgaaaatctgaccattcagggttctgggatgaaggcttgtcagtcacttccagttttagaacgtcaagtgtttgctagagagcatatatggcgtgtttgtattatgatgagtaaaaggagcaatagagaaaaggcatcacttttgctggatccaggactaatttggtaaaccaatcaaagtgacaaaaagacaaacaaacgaaaaaaaggaagaatgtcatgtgaggttgaaccagtttgcattcccctaatgtggaaagaagtaagaggactactcagcactgtttgaagatgtgcctcttctacagcttctgagaatagtgtgattacactggccaagtgaaggagccccctcccaatatgtcgcgaggtcaagccctatgcatggtcctgtcaccaggcaagcaggaaacctgtgacttgtggacctcacccgatactgagacggtcttggttaagctccagcgattctcctatccatgagatagatcccataataatcatagtcaatcaactagggtgctactcaatggatgggtttggaccagtcccttctttgggttaaaacggaaaattcgtttctcttaccgcaaggctgggccttctgtggaaggttcctactgtattt

SEQ ID NO: 514576 - DNA, 790 bp, Homo sapiens
aaccgttacagccacaaccaaagtcccggtggatccgtgatgtaacacatggattgacgcgaatcggtgcccactcccacatcctggggactggtgtgtcttggactgatgccttggagcctcgtgcaggcttcgcaagggtcattggtgggctcagctggcggcacgcgcgggcggctgcgcgtggtgctggatgatgatccgtggaagggaagattgccggtcgtgcagtccttattgctggccagcccgggccacggtggaaagacggccatcgccattgggccatggcgcagtgccctggagcccttgacaacgccatatcacagccatctgccggagcagtgaaagtctttctcccctggagattgagcaagaccgaggccgcttgacgccagggccattaccggggagggtccaatcggaccagttcggcaattccacagggaggcgaagacacgaagtattccatcccgaaacgagtcgccagattatggttgccagacacccccaggcattgggattccggacccaggcaacccacgagcgaacggagcttccatagggttggcggccaaaatggtggtgccccctacaagggacccaaccagaacgaattgagaagaccccgatcttaaccgaacctttggtgcacccaaaggataggagttgaaggtccccttcccccaagggaacaacagtgtcccatgttgccgaggactttggttccccatttggaaaagaggcgactgggcaaagaatctcaaacgttgggccgcatcctttcaca

SEQ ID NO: 514577 - DNA, 255 bp, Homo sapiens
aatttaggggcgccccccgcggccccccctttaagggaaaatttttccttttgttggggaaccgccttttccgggggcccccaaatttggggggaaacccctggggtttttttttgccccccttggtttggggggggcttggcccccccccccttctgggggtttttttgggggaggggccccttttttttgttccccttccctttggcggggttaagggaaaccccccaaaatttttttttttttttttttcca

SEQ ID NO: 514578 - DNA, 1388 bp, Homo sapiens
gggttttatgggctgtaagttatattcaatgcaaaaaaatcactctccaatttatacggaggttggctgaccacgttccacgaaccaaatccgccgtctaaacgtggaattcgggtgtgctgacccagccccagcctcggacttctctgtggtcggcaccagggtggcacagcactccggtcgtggtagggtatctcgtggtaagctttccccatcttgggtgagtcttcgcaggtttcgctcacccctccaaaccttataggccgaggccgtgccagtcttcgtggacggtatacggggttaagggtgggcagtggcacaacatcctccgggggtgcaagatagaagggtaactcccgggagagaatactgggaatacccctcattgggataagggtaccaggataagaacaggtcctccagggcacaactctgtgtgatacgtcgtgtgtaccacatatacccgtgcgcgttattcaccgttctaaggggccccttggcaactcgggtgtgagatgtgtggagaaacagggtgtccacaaaatatatcctgtgcgccatattgtacagacagacgctccctaaaagcgccctagaagacatagcgcgcgcaacgggcgaacaccacaccacgcggggccacaagacgagaaactcccgggcgagtccacaataaacgcctctaaaggggggaccaacaaaacggggtagccgccgagccgcatcattaacgcctttgcccctgtataagaaaataccaccctttctacgggacacgaccacatagcatcaataatcagcagtcgtgggggcgcaagaaacgcggcacccgcttgcagcacaggctctctcggcacagccgccctttcacaggccatcattcctcaaggtgcaagcacggcacaggtgcgccctcccaccggacggggtcgcgacggattaagacaatgtccacgaccagtgggagaatcacagtggtcgacgcaaacatctcacggtggaggggagcgcccacaacacacctcttcaaacaaacgcgaacaaaacagacatctgagtgcgagcacaacaaggagaccccaaaaagagcgaaggaacaatcacgtggaggcaccccaagccaacgagggaccacacgcgccaaccaaagacggacgacacacccgccaaccccgggagtctgcaccccagactagttgagacaaaccggggacgcaccacatcgtggagcacttgagcacccccagcgaagacaaccacaaacaacgggcaaaacagagctacacaaacaactaactgtggcgaacacggaccaccaccaatccctcgcggaccccaccagaaacgcgccgccccgggctcacccccgggggacacacatcacacat

SEQ ID NO: 514579 - DNA, 154 bp, Homo sapiens
ccccatttatatgcggatagggttagtgggtcatgtcaggctgaagtcaggccgcgtaggggaagcggagcaacagcccttcgtgaggctccagtttcaggcgtccagctcaagaggggagcctcctcacggcctgggtgggtgctgagcagga

SEQ ID NO: 514580 - DNA, 399 bp, Homo sapiens
cttgaaagccttcatgtatctgagcctcggaattctctgtaaggttgaaattcaggccctccagaatttcatcgtaagtgtcagccttggtccccaggaagagcattgcaaagcctgaaccaatgctcatctgggagagaagaagatattggtcctgttgaactggtgtgccacctgccggtatagcctgaagccgaactcagccaggttggggtgtgatcttgttaaaggttggtgtgatcctgatcatggtggaatgtatctgtcttctggacagcatctccttggggatccacagacagggacacagggccgagacagcacaggcctgacagcaggagatatgccccgcgagacagaacgcggcagtgtatattctctgtcacaggtcagttgtcg

SEQ ID NO: 514581 - DNA, 296 bp, Homo sapiens
gggaaaaaccccccctttttccctttggggggggggagggacccccctaaaaggggggtcccaaaggaaaattttggggccgatggcctttttttttttccctttcccgacttccctttttttccagggggggggaggggaaaaaaaaagcgggggggggggcggggccccagggggtgttccccccccccctgggtcccttcctttgttttcccccggggaaaaaaaattccgggggggggggtttttttgggaaaagccctttttttttttttgatgtaaaaaaatttttttta

SEQ ID NO: 514582 - DNA, 911 bp, Homo sapiens
gagaccggcggaacagttgcggtggggaagctcccgtggcgctcccgtgctgtgcaggcggcatgggattcctggcggaaaatgctgatctcagtcgcaatgcttggggcagcgggctggcgttgagtacgcgctctcagtatcgtgaccccgggagagcggcgggaacgccagggaaatgttacaggagatgcactggggggaccccaagtgagcagggaggaggcggcccgggacccaagcagataattgggtggcaatctgcaagggagggcaagggccccaacgcccaggaagaacgtggccgtgagagacgacctgggcatcggatgggggccgaaagatacgggcgaccaacgcagggcgagggtccccccggtgaaaaacgagaattatgccatcccgtgtggaccgacggaaaccttttggctttgtgggcagacaggaacttccaggaggccaaggcagtatcatcttgcggtgggcccagggaaagaagtcgcggaaccgaagaataccagtgccacaggacactcctacggcggacccgtgacgcatgcccgtaggtggtgagcaccgtttcagcacaaaacccttgaacgtgacctggttaaaggtccggaagggggacagggcaggaaacgacgagcgacaagtggctgacctgaaagcacccatgacagccatgtcgctccgagaacaatacaaacgacatcacaaaaatgtggggcggccacgcacgaagagttcacaaaactctggggcgcgccccaactcaagacgtgcaagcgccaggaaccgggtgaacaggcgggctaccaaaaacgccgagcgggccacaccagcagtggccccgcacaagcgcggcaaacccggagagagacacgcagccgccaccgacagcccgcgcc

SEQ ID NO: 514583 - DNA, 1344 bp, Homo sapiens
tacggcagcactttaatttttccttacacaaggacgtgtggctgggggcctaaggttctcacataacagtaaaaaaccaaaatttggtgtggtcatctcttcaaaagaatcagaaaataggcggtacaaaacaaaaccttactataaattaaagaatgagaatactatttacagggcgtgtaaatggcaaaccggtttccaactcaaagcaatgtaacaggcccacgggggtcctgggccaaaagaaattcaggcataaagaaagggaaactgggtgtccatacgggcttggagacttctcacaaccccttggacagagacccggcaaagacaaaaccaacgtgggttcttggcgcagcgcctcataagaagaaatccacaagaaacacctacagcccctggaacaccgtgttaattaccacaaggtggagaaacaggtataatcttacaagtaccacaggggtcacaaatcagcgaaaaagtgtctctataacaaatcacagagggcgtggaatattcacagatatacaaggctttcaagggaacaaattccttttctcagaaggggcattatattctcacaagttctcggtagggggcttaagcattgagagggtggggggcgccttttggcacagggggggcaaaattttctcatattgtcctcaaatgttacacccattgtgcacgacaccatgtgcgtacccgccatttctgtgcgtgaagctccgggttataaaaaggcatttttggggggggggggcacagacgtgggcaggggggccccagaaacttggcacgaagacacaccccggtgaaggggagaaaaaatcccaacactcttgggccggggaacaggtgggggaccactgctgaaaggccccacgggactggagacacccccacggacgtcccacacaccagaagagcacaacttgggagccacctgagggcgagtgagccaccagagacacatgagagaaacaccacaagggggaggcgatgagagcgcccacagggggagcggagagaaaaccctcccactgtcggagcaacccgtagaggagaacaataggcgccggggggaaacacgcggcggtgaagccacgcccagaagaagacccggcgtatgtggggacacacggggccctagcggagaataagtccacgagaaaaccctacagagacggagagagaagaggagcgcacgagcagaagacaccagcaaagagaacaccaccgagcaagaagcgatgtaaacaaccacctagagctgaggaacacagaagcgctaggagaagcggacacaagagcagagcatcgtcttcagacagagagacacgg

SEQ ID NO: 514584 - DNA, 850 bp, Homo sapiens
  misc_feature (590)..(590): n is a, c, g, or t
  misc_feature (594)..(594): n is a, c, g, or t
  misc_feature (629)..(629): n is a, c, g, or t
  misc_feature (633)..(633): n is a, c, g, or t
  misc_feature (639)..(639): n is a, c, g, or t
  misc_feature (642)..(642): n is a, c, g, or t
  misc_feature (654)..(654): n is a, c, g, or t
  misc_feature (658)..(658): n is a, c, g, or t
  misc_feature (841)..(842): n is a, c, g, or t
ggtaccgacgttggatatcatgcagattatgtatggaatatccagttcatgtatactcttatacatcgacgcacagggacaccagaggctctacaattgtacgctagcaactaacttacagtgcttatatagagtcagtggtaaaatatctggccggtcgtcggaagatacacgcgctatgaagagttccagcagcttagcgcaggcatcgcgggaggatcactgtgagcctcatgaggtgccagaccaagcactaggcaatgtagtgacacctcatttctatttattttaaaaaaaagagagagtaactacagaagaactttaaaaataaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttanaggnaagactttaatatctatactgtaaatatttggttnattnggcacnacngtaaggttggtnttcncaaagctcttattatgaagcaaaataaaaattctagtttcctggatgaatttttggactcattcaatcctggtaagccgcccaaaaataaaagggccaaattggatatttttaaaaaccaatttaaaataaaaatttgaaggttttccggtctccaaaaaaccccatccttttagggttattnnatccgcca

SEQ ID NO: 514585 - DNA, 364 bp, Homo sapiens
cccagctaatttttgtatttttagtagagatggggtttcaccatgttgtccaggatggtctcaatctcctgacctcatgatctgctcacctcggcctcccagagtgttgggattacaggtgtgagccaccacgcccggcctgtgctactcccattttcttacctccagcaaccaagctggatggagaacccaagccctgtccccggcagctttcgaatgtcttagagagcctcccctcctctccagcttcatggcctccactctagttcaagtctcagcatcattcttcagcacttgcctccttgccagtctcctgacctccagcctcacctttgctaactaacttggcctgaagctccagaca

SEQ ID NO: 514586 - DNA, 324 bp, Homo sapiens
atgagcagtcagcgggcgtcatgtgttacttcgccatctgctgctgcctcctgctggttggctcctccttacccccagctcttctcaagcggcagtccagcgggtctggttctggatggttcccccaagggacgccgcagtggagagcatcccagtgtttggggcactgtgttcctcttcgtccctgcaccagagccgggtgcaagcctcgtggactaacagttcccagggtgggagaacaggagctagtttgcaataaacccagctggatgcaggagcccagtgtcttcatgcagaggagctcaatgtcgtggggtaggaggt

SEQ ID NO: 514587 - DNA, 172 bp, Homo sapiens
gccccccccccccccccctttggggttggggggggggggggcccccccccccccccccgggggggggttttttttctccgttgtgggggccggggtttcccccccccgcggggggggtttttttttttcgccccccgtttttttttttttttttataggggtggggggggga

SEQ ID NO: 514588 - DNA, 1361 bp, Homo sapiens
  misc_feature (1138)..(1138): n is a, c, g, or t
aaggatttcaataaagtaggtttggcggcagagatttaggaagagtccaacttaagagataatgggctcttaaaacatgtgcacacacagtttagttccaaagtccccaacatgttaggttcaacaggtcaatgcctctttctattgcactcacaattctagcacaagggcagcagaggtggtctgcacagctaagtaaatacaagtacaaccgaagcatgtcatatcatcggctggcttcaacacaacagacaacatcaaaaccaccacccaaatttaaccctgtgtaacaagccgttgcagtcaagggcattcacgcaacgcactgtggcagcaacactatgggcagccacgcacaaacacagcagcttcgggcaagcaggcaagcaactgggagcaaatctcccagagcaacacgtcccagagaacatctgtgcaagtccaacaagtgtggcaagggcacacagggcacagtgtgcattcaggctgggcattacagcaagggctcaacaagataccacttctcatcatgcagcaagcagcttcagcacggtccaggagcagccacaaatgcttgcaggggtctcgtcccgcgctttatatatttcctcctctggaacactttggacgacaaggaggaccacggacacgatgactacgagggcgccatagtacggttcttacaggtccctccccaaagccccccacaacaagcaagctcattttactgacgcatgagcagacaggggcagacaacgctcccttccggtctggatgcttcggagcctttatccagggacaacccttgcagcagcaaatttccaagcttgaatccttccggctttcagacggttgactgacggttgggggcctcacacaccatctcggacttggacaaacgacactcggggggctccagcacaccaccggcgggccccctaaacgccttgcggatacccacagcctaacctttcccggacaacatcagccatcagggaactgccaaacaaaacgtcatcggcgcggaatgcgcaccgcacacaccaaacacgcggcgggcgcgcccaacgaaatcccaccccgcgcgaggacccaagcgtagggagcaccacaggcctcgtcgtcacccaggcgtgcncccaacatgaggcgcgccgcatcacaacgaagaacgggcgcatcaaccagcaccgcggcaaacaccaacagtcgcatgagtgagacccacctgtgacgaacctgacaccaaaacaacacggcccacacacgtatagagacgaagtccgtgactcgtgacaacacaacacgcacagcgagccgtcagagctgagcagcacctgaccagccatccaaccacgcga

SEQ ID NO: 514589 - DNA, 367 bp, Homo sapiens
tcttgactaatctgtgcactttccctaccaaacttctggtccagtgtgctgtaacactcatttggcccaattaactgctaaatttgatttgtagtgttttcagccctacagaaactttttgattttttttttcctcttgagacagagtctcagactgttgcgcaggctggagtgtgcaatgatgcgatctcagttcactgcaacctccgcttcccgggttcaagccattcttctgcctcagcttcccaagtagctgagattacaggcatgtgccacgatgcctaattttggtattttttggtagagacgaagatttgccatgttggccaggctgctctcgaactcctgacctcaaatgatccaccca

SEQ ID NO: 514590 - DNA, 123 bp, Homo sapiens
ggggggggttccccccggggggggtttttttgcccccccggggttccacccctgggccctggggtttttcccccccccccccccccgggggggtttttttgggccttttttttttttggggga

SEQ ID NO: 514591 - DNA, 122 bp, Homo sapiens
ttgcgacaactcatccggtcgaactgctcgaagattgcgccgatcaccaccgtgcagcgttcgcgagcagtacctaggtcttcacgtgcttagtgttgatcgcgatgccggcaggtatggtc

SEQ ID NO: 514592 - DNA, 122 bp, Homo sapiens
ggcacgaggcatcaagaagatcttcgagttcaaagagaccctcggaaccggggccttttccgaagtggttttagctgaagagaaggcaactggcaagctctttgctgtgaagtgtatcccta

SEQ ID NO: 514593 - DNA, 680 bp, Homo sapiens
  misc_feature (27)..(27): n is a, c, g, or t
  misc_feature (38)..(38): n is a, c, g, or t
  misc_feature (237)..(237): n is a, c, g, or t
  misc_feature (629)..(629): n is a, c, g, or t
  misc_feature (636)..(636): n is a, c, g, or t
aggttcgatctagaggacccccacgcngcaccgcggtncaaaacacagaaccaccggtgtggcgtgctgggaaaaatcaaggtagagtctgcctttcacacccccacaggtgacgtcagaaggcatggaggcccagacacaaagctccgtcactctacagtgcagtttggagaatacacaagacccggtttagcatcttggtcgggaggcacaagctcagaacaaaaatctgacaanaaggaaacatgtgttcaccaaacctgtcatgacaatggaaaaaatgaccagcatgagacaaggaaagaatatgtatgtcggcatgggatcctcagaacttagagagagaatatgtatatgggatcctcagaacttagagagagaatatgtatatgggatcctcagaacttagagagagaatatgtatatgggatcctcagaacttacagagagtatatgtatatgggatcctcagaacttacagagaaccctgcaaatcaatgggaaaggaatgatgcctgcactaggagaggagcgcgtgacgagcgttcctggaaaacgagccaaaaacggccagaacaggaacgcaaagccccaacaggctcagaatgtggcatgtcagcaagccacgncgcagancccgcgcagattaaggagtctgtgggaaacaaaagcggatctta

SEQ ID NO: 514594 - DNA, 524 bp, Homo sapiens
ctgggccagtattatcaggcatggagatgctactgatgtcaggggcatcattcagaagatagtggacagtcacaaagtaaagcatgtggcctgctatggattccgcctcagttcacctgcggtcagaggaggttcactggcttcacgtggatatgggcgtctccagtgtgagggagaagtatgagcttgctcacccaccagaggagtggaagtaagatacaaacctgctttggtgtgatgcacacttgatttcttttgctttttaaaaacatgcacaagataacaaatgtatatgtttaattttcacactgcttgtcattacaactctggtataaataaaattcgttagtaattattaacgaatgatctcttctagacctctagtctagcttttgggtattattaattatactttgagccatctgatttccgttttctgtgatggtcttttgctagctaatttctcatcagtgctactttgtttcaacctttgctcccaataaaactcaaatcataaaaaaaaa

SEQ ID NO: 514595 - DNA, 108 bp, Homo sapiens
taggacatggaaggaatatgtaaagaaaagaaaaaacatgtttcttataatgggaaagtgcttgtagtatgtgtggagaaattctgatgcacataagggggtatccta

SEQ ID NO: 514596 - DNA, 1017 bp, Homo sapiens
  misc_feature (115)..(115): n is a, c, g, or t
  misc_feature (159)..(159): n is a, c, g, or t
  misc_feature (244)..(244): n is a, c, g, or t
aaaagagctaatcctcaagtcggcgtggcttttcctcatatcaaggcataactatgagtgtttatgtgtatgtgcagctgcctttcatggaagacttgcggcaatacatgttttnatccttgaaaaacagtaagaaatatgctcccaccgaggcacagntgaatgctgttgatgctttgattgactccaatggagcttggcgaaagcaagagatgagatcatactagacgacccgtatggaagnactatgtttcctaaccgatccgaatagatccccaagatccctcgcacttgcagagattatatcagtgtctgctgcacagagctcttacatccccagggatgcgcatcttactcaccctaatttcgagcaagaccatcatcttggtaatcatcgctcgtacatccttccccgttggagagctgcactactgcatagacgtcaagcattccatcatcatcttaaaaaataaaagaacccttgtgttccgtctgatgtgcaagcgccaagaagaaaggcatcaaagtgactgctcaggaacatttttccacatgaagacatcgcaatgtagagaatgggacgctgaacaggctaaagaaacctaaaaactgagtcaaggggtgagcctcaccttcacgtggtcttgcacaggtacgtcggacgtagatcgtgcagtgctcacctcttgattggaacgtgtgaatcctgctgaaaacttccgtgttctagtgaaaacagaagaaggccagctttgaggaagcgagtaaaccaagctcataacagtcacatcgaaccagtgttttggatactaattgaaacaccgtattttatgaacgagcatagactgcagtccgagccttccgggaagaagccattaagttcacagaaggagcagcgctttagcaacgttcctgaaaagcccttcacgaagaaagtgggacataaaacacatttggtcattttctgggaaactcgttgtccaggactggaattacatctgatcaccacaagaggga

SEQ ID NO: 514597 - DNA, 279 bp, Homo sapiens
  misc_feature (218)..(218): n is a, c, g, or t
ctgggccagtattatcaggcatggagatgctactgatgtcaggggcatcattcagaagatagtggacagtcacaaagtaaagcatgtggcctgctatggattccgcctcagttcacctgcggtcagaggaggttcactggcttcacgtggatatgggcgtctccagtgtgagggagaagtatgagcttgctcacccaccagaggagtggaaatatganttgagaattcgttatttgccaaaaggatttctaaaccagtttactgaagataagccaactt

SEQ ID NO: 514598 - DNA, 397 bp, Homo sapiens
  misc_feature (115)..(115): n is a, c, g, or t
  misc_feature (159)..(159): n is a, c, g, or t
aaaagagctaatcctcaagtcggcgtggcttttcctcatatcaaggcataactatgagtgtttatgtgtatgtgcagctgcctttcatggaagacttgcggcaatacatgttttnatccttgaaaaacagtaagaaatatgctcccaccgaggcacagntgaatgctgttgatgctttgatgaagtttgatttcaagtacttgagttttcataatttaaagctatttgtttatagagagaatgtgaatcaaatatttggatgtcactattgctatatatggtattaagtatggtgaccatagtttgtaactccaactgactgcagacaggaaactttgtgttagcaaggcattttttcttactgtttgaattttttgatactagataccatacagag

SEQ ID NO: 514599 - DNA, 677 bp, Homo sapiens
  misc_feature (2)..(2): n is a, c, g, or t
  misc_feature (83)..(83): n is a, c, g, or t
  misc_feature (124)..(124): n is a, c, g, or t
  misc_feature (132)..(132): n is a, c, g, or t
  misc_feature (134)..(134): n is a, c, g, or t
  misc_feature (167)..(167): n is a, c, g, or t
  misc_feature (175)..(175): n is a, c, g, or t
  misc_feature (220)..(220): n is a, c, g, or t
  misc_feature (227)..(227): n is a, c, g, or t
  misc_feature (260)..(260): n is a, c, g, or t
  misc_feature (273)..(273): n is a, c, g, or t
  misc_feature (401)..(401): n is a, c, g, or t
  misc_feature (416)..(416): n is a, c, g, or t
  misc_feature (424)..(424): n is a, c, g, or t
  misc_feature (474)..(474): n is a, c, g, or t
  misc_feature (478)..(479): n is a, c, g, or t
  misc_feature (509)..(509): n is a, c, g, or t
  misc_feature (520)..(520): n is a, c, g, or t
  misc_feature (528)..(528): n is a, c, g, or t
  misc_feature (581)..(581): n is a, c, g, or t
  misc_feature (589)..(589): n is a, c, g, or t
  misc_feature (595)..(595): n is a, c, g, or t
  misc_feature (612)..(612): n is a, c, g, or t
  misc_feature (659)..(659): n is a, c, g, or t
anacagggtctcactttgtcacccaggctggagtcacagagcgagactccagatctcaaaaaaaaaaaaaaagggaggaccantcacaggaggcaaatgttcccaaggggagactgaaataaangggcagangnagaagaaacaagaggggggaagaaaaaagcatnagtgggangaattcatggaagcaggcgaaaaccatgggggcgatgaaggaaangcccacngggggaggagtcccagcgggggaatattcgttntttgggctcacancgctgggcactgtcctgccattggggtccttcacaacgaaaacgccttcgctgaccggcagccgttccacccaattcaccttccgccccaggggattataaacgaagacctggaagcgcgccgccgtntggctgagcgggcanatgctgangatttagctgttggcaaaaggatgaagatgatctttgaagcctcttagcngcgnnaccgtttgactcagaagaacctagcaaggnccccagcctgncgcaagcnggcgcgcgttgtcgttaggccacgtgctggcgggaggggccgctgacggcgtngtgatgcnggagcncagccatcgcctcattnaggggtgcactgtctccggagccatagggtcccacgtaggccgccanccaaccagcacctacagc

SEQ ID NO: 514600 - DNA, 165 bp, Homo sapiens
tgtgcacaacctgaatgacacatgagcggcatcgtgaaaccacagggctccagagagctggctttacagagccactgtctccagtgagattggggccattcaaacaaagtaaggttccaacaccagaaggagcttcttccccactcattaccttacacaagagga

SEQ ID NO: 514601 - DNA, 491 bp, Homo sapiens
caattgagctcatcaatggatacaggcttctttagtttttaatttcaaagaccctatcacttgggacaaggtctcccactcaaaaggaatccagtaaatagtggtggaagtaaggtacttacgacaataattaagatcagaggaatatggttaatcattcaaggttaatagttaaatattggattttggataaccatttacggaataattcacctaacaccccataaactaattaacaaagagtgtcttcataaagggggtggatatcacatcaagagtgctaccgagtgtaaaattaggattttaaaattagtgtatgtcccttaagggcttcggtgactttaaggttcctctaaggtttatttaactttaatccacttaaatttctttaaaagttacccattatacataaggtaatcggactccaaatttcggattattatataaaatccaaagataggtagggataccacgtggggggaccctctaga

SEQ ID NO: 514602 - DNA, 153 bp, Homo sapiens
ttacttacaaattcattaaatctaacttttcttctccctcaccagtgccatcttttcaggtaggctcttctgtcagttatattctaaaagaatcctaacttatcctcctgctatcacactctcctccttaagaactgacttgaggggatcctc

SEQ ID NO: 514603 - DNA, 433 bp, Homo sapiens
caaataagactgcaggcctgaacccatgcactatgtacagtgtggaggaagagaggcacccgctcagatgctccttcttagatgaaaggagtgcctcagttgagccccggaataggaagggcctgcctactgagcctcctgcctcactattaacagcgctgctgtcaatactgtgagccaggttctgacagctgacttgaattaaatctcataaggcccacaggacacacgtccgtgggaaggaaggcattcctctgatcttaaatcagcagaggcagaggccccgagaggttaagtgacttgcctgaggtcacacagcctgaagggggtggagtcaggattcaaacctaggttccagggatggtgtgttgacaagcctgcactcatctgactgtatctcccttcagtcttctccaacatccccttgggggtc

SEQ ID NO: 514604 - DNA, 233 bp, Homo sapiens
ctatagctagacacgatctgctagaaaacaaacaaacaaaaaacaataaaaaaacccccaaaaaaagcaacaaaccagcttgggatggtggtagcgtgcctgtggtcccagctgtctcaagaagctagaagcgggaggatagcttgagcccaggagatcaaggctgcacttagctatgatcgcaccatcgcactctagcctgggataacagaatgagaccctgtctcaaaaaa

SEQ ID NO: 514605 - DNA, 101 bp, Homo sapiens
tggtaggacttggaggagaaatcccctggactttcactaaccctttgacaaactccccccacccagttgatggctttccgtaataaaaagattgggatttc

SEQ ID NO: 514606 - DNA, 277 bp, Homo sapiens
taaatctggatatcaaaagattgctgaagttcttctaatcagctcctaggatcttactggaggacggcctcgggagtcattcaagttagacgatcaatatcgtcggacatccagtgacattttgactacctctatatacgctattggtatctcctttatttctttgctcttcacttattgctctgggtaggcatcttccagtactcatgttgaagagtgagtggtgtacagtgggacttccttgtcttactattctagttctccacaggaaatggct

SEQ ID NO: 514607 - DNA, 107 bp, Homo sapiens
gctcctcttcatcagatcaagagtcacatgtcatcatcatctatactatctgtagctccacttctgtagtgtctaccacatcggcaggaccatatttggcccaaagc

SEQ ID NO: 514608 - DNA, 1239 bp, Homo sapiens
cagtgtaaataacaaagcattggataggtgtcacttatggtagaaaaaacttcctacaccagatgcacagtgagccagatggttacaatcgaacattctggaagggtgaacaccacacccgtaagcccaggatttgtgtacccgcgttttgcaagagtggccaagttcgttcgtgtctcccaccccagaccagaagcacatgtgcagccaacatgctcaagtgcacaaagccagtcacaacgcagccggcttcagcgctcatcagcgcagtttccaaccgtccacatcatgcagggtgcacagcattccgagattcacaatctcagcagccacttcaaggttcgtttcgcaagtgttttctaccgtaagcgaacaaggttccgtgagatccagatactttacaatacttacagacactagccagatcaggtgttcatacaacctcactctatagtagctgctgtatcctcttcaccagatagggaggagggcccatgcgcgattcgccataagcaagttacgctgcatcacataggggtatgcaaccaaagtttcctatcgcagattccctttcctctccattcagcgtatggacagtactgcacaagagtcgaggccatcttgggaggactcttccgaggcccattcaaatcgtgtgaaccatatcataccaggctatctacgccccatggtcgtccctttatccttcacgaaggggaaaaggttcaccatcgccaaggactaaacattgccgtctcccaaatcctggactgccttacgaagaatcagggcatagcctgctccacacgtcatggacctagtctccaatgtgggcaccctaggacgccaataaggcagcaccatcaagcacacggtccacaagcacatcactgaaccagcccataccgaaaacccaccaggtgccaaccgcgaaacctgggcacaggcaccaccgggaaccagacccaggcccccgtgacccattgaaacgagggggacaaagcaagacatcccacgcaccacaagaaagaacacacaacatgaggccccagagaagacgagaaacccacgaaaaaggagcccacacaccgacagcaaggagaaacacaaaaaaaagcgaagagacaacaaggagaacaagaagggaacaaggcagaacagcagcgaaccaacaggacagaacagcagcaaagaaacacaaagaggcacaccaccacaaaacgcgcccacgcccgacag

SEQ ID NO: 514609 - DNA, 149 bp, Homo sapiens
ctctggatgcaagtgtctaattctatatacagaagatccttcatggtgcaagaaagtataggagtcggtgggaagtagaaagacaaggtgaaaggctatatgattgagacgctttcttttggtctacagactcctgcaaagtattacgg

SEQ ID NO: 514610 - DNA, 182 bp, Homo sapiens
ttggggttggggtttgtggttgaaagccctgtatgagcccgggtgtggtggctcacatctgtaatcccagctacttgggaggatgaggcacgagaatcgcttgagcccgggaggcagaggttgcagtcagctgagatggcaccactgcactccagcctagatgatagagtaatatccctctc

SEQ ID NO: 514611 - DNA, 258 bp, Homo sapiens
cacgaggcccggacaccggcctcgggcagtgcgcgcagcagtcgttccagccagcgcgggccctcgtaccaccattgcccgaacagctcggtgtcgaaggcggcaacgacatgcgccggcctgccgatgcgttcggattcctcgcgcagccggcggtgcaccacgccgacgaaatccgcgacatgcttgtcgatcgccctgtcggggcgctcgggctcgtatggggccttggcctccgagggcacgttgcgacccgtg

SEQ ID NO: 514612 - DNA, 369 bp, Homo sapiens
  misc_feature (19)..(19): n is a, c, g, or t
  misc_feature (59)..(59): n is a, c, g, or t
  misc_feature (77)..(77): n is a, c, g, or t
  misc_feature (102)..(102): n is a, c, g, or t
  misc_feature (109)..(109): n is a, c, g, or t
  misc_feature (126)..(126): n is a, c, g, or t
  misc_feature (166)..(166): n is a, c, g, or t
  misc_feature (177)..(177): n is a, c, g, or t
  misc_feature (327)..(327): n is a, c, g, or t
aaaaatttaagtaatattntagtttaaatggatttggattaaggtttatggttattttngggatgggagttggattnatatattaagtgataagtttatttnaatattngtttttagaatggtttngatttagttgtgttaggtaatagaatagggttagattttngttttgttatnggtttgaagattaggattttaaaggggttggaggtagggaatatttgaaaatttagattggaattttaggttaaaagtttaagattattagtttttttttttgtttggaaaaataagtttttgtgaaagattgatttattatgtataatngtgattgtgaatgttgttgagtaaatttttagatttttttta

SEQ ID NO: 514613 - DNA, 1202 bp, Homo sapiens
tggaaagagagtcttactcggccgcccaaagcgggagtgcaggggcacaatctgggctcacgtgcaaccttctaccttccgtgggtttcagggtgattctctttgcctcagcctcccgagttggcgtgggatatacaggcagtgggggcgatgagcctggtggtcctagctgctcaggaggctgaggcaggaaaatagccgtaaaccgtgggaaactcggaggtgtgcagaagccaagaatcgccccacgtgcactccagccgtggcaaatagaccgagaacctccgtctccaaaaaaaaaaaaaaaacaattataaatttctcttttacaatttattaaagtaaagttaagaggatattattaaaagagggtttgggaacaaaaaatatctctcgatgaagatccgggagaaatattcaaagccaaaaaatttaaacaccgtgataaaactaactttaaagtgtggtgggagaaaaattttggtgctctgagaaacattttacaaaacttgtggttaccacagaatgaagagaattaaaagggattaaaaccaagagggttcaaaatataaaactccaattataactttttaaaactcgttgtaaataaaaaaggtctataactataaaaccaatttgtgggtaaaacttcttgttcacccacatggtaaatggggtaaacatgtggtaaagtgggaaaaaaagaggtttaaaaatccattggaaattatgatgaaaagaagattaccaccggggattataaaacttcaaccagggtttggaaccagacaaaacactgggcataatatacacccctaatgataacaaaaaacaccaaaagggtcaccaagaacactactacacaacgcggttaaacccaaaatcacagcgtagcaggcagtgttaacaggccacacacaacgaaccaccaaggacgggaaaatgaggggaaaaaagttataaacgaaagtagcatcaaagggaatgaagaagtgcacaaacacgtgcccggcccggggtcttaacaacgcgccaacgaccccttccagagacaaacatccacaagcacacacaggacagcaacaaaaggaacacggtgctaccaagacggaaaaaagaaagaagaagagtaacacaagccgaaagacggcaacagggccgacccgcaaagccgacaccgacagcgtaccacgacgaagagc

SEQ ID NO: 514614 - DNA, 1429 bp, Homo sapiens
agcggagaggcgcccctcacctcccggacggggagtgctggccgggcgggggggctgaccccgcccgagtctccgctcccggacggtggcggctggccgggcgtgggtggctgatcacccccagctcgcctcccggactggggcgtgctggccgcgctgagtgggctcctcacttgccatgctacggggcgtcctgggcggatggcgccccctcacctcccggacggggcgccggccctgcccccagcaccaccaagcagggcattgaactaccccctccctcctcccaaccacacgacctgatccacctaacgcgctcgcgcccccagctcggattccgaacccacccgcgccgctcaccccctaaccgctcacacacaccacgccgtctcgaacacccgccaccaagcggccaggacacttccgtcacctccaccatcgaaggacctcgcacggcaccactgtgcacgacgaaggctatcaacgggttgcagcatgaccaggcgggcgccactcaaagcacaggggcacgcacacgagacgaaacaacagagcaacgtaggcacagtggacaccacgcgacgcagacccaaaacctcacggcaacacaacaagacattcgcagcggggcaagcacgaagacgcgcacggacagaagcggcggacgaacgagtcagcaccacgcgttctggcgacgtcgacaaacatatgacaccaccagataaatacaccccgatctgtctctgaatcactctaccactcgataccactttgcggctgtcacctattcccctctcatgtggcagccactcaccaaagtaaccataaaaagcaacatataaaaaccacaacacatacccaccccacccacacaccgcaccactcacacacacacgccgcgacacaccacacacacacaactcaccactaaccactcgcacgcaacacctccgcacgatccacccaccccaaacactgcacctcactccaccacatcaccccccgccacgacatcggccactcactacagcagttacatcacctcatcaacccacgtgctaccgactcaacacagtctcaccgctgctcaccatctcgagcacagctacgaacacagctacatacaagcacaaatcgctcgccacagccgatctagcacatcataaaacacagaacacagacattcaatccctaccctcttcgcatgcctactcaaccgcaaatgtagactcgcaccgttcgctgatctactggttcacctcacccagacacacaagcttatcgcttaacaccaaccagcaatcatttcctatccccaacacattctcatacactactaccaatctcaaccaccaacaaacactaatctacaatctccaacgcaaacacgccacatagcgtcacacatacaacaacccacaaaagccca

SEQ ID NO: 514615 - DNA, 1460 bp, Homo sapiens
ggctgtggtaggacacggtgagacttggcggtgacggtcgcagtactgtaaaacgagactgaggcaacagctcgggttgcccggacacgtgcgctgggagtgtccgtgcggttgcttgtgctcgatgcggcactgcttgaaagtggccttgtccggatcatagtcctcacgactggagccccgaggggctgtgttggtgcgtcgagtgtgccgggatcccgaggatagtctgtcgttggtcatctctctcgtcggaccgctcgttgcgtctttgactctgtgtgtgcactggatcccgtgtttcggacagcagggcttcgcgtattgccatcctggtcaacttgttctcaaggttacccttgctgaccgctgcgacggttgcgcttttcgctcgtggatgcttgtgtcgctgctgtccctctggggggggttccatatctcgccatgccagtgcttcgacgcctcatcgtcgctccgcgtggtgtcccgacttcgcgcgtggagcgatggatgcgggtgggttgcttcctgtttccgccccgtgtcgctgcggggttccatgttgcccggtatcgacgcccgacccaggtcatgtcctgcagtctcacggttagctggacgcagaggacgcatgcgcgctttgtggcccaccggtgtgtttccaggtcgtagctgatcacttgcttttccattgtcgtggctcacgtgtggcaccctattcagtgtcatatctcgcttcgagcgttgacttgtgttgcgccgtcgtggaggtcgcctagggcccatcgggcccgccgaccgttggttgtctgtcgggcccatcgcggtcgttgccttaactggggctcgtctgtgtatcggcataccggtcgtgaccaatacgttattttccatagcctctctagggtatacttggctggttctcttgtcgccgactaggcgatgcaattcctccacgccaagggcgttttgattgcccgtacagaaataccccgcggagaaaaaagccatttcggttaacccacagccacaacgtggaaacacgaattggcctagcagcagtggattggcgaacgacgttacggaccgaggagaacttctttcgcacaagtttcacttggccggtattccaaccttcggggatcgagatggttgccccacagcgaaattctagggcgcggtcccatagctgggttccgttgctcctcggtggcctttccgtttggttttggccaccccttgtggatgggcccttccggtccgacccgcgcgatggtgcagtgcctcccaggtccgcaaacagggagcgtttcccaggcgcctgttatgtgtcgcgcatgccacagactttgtgtctttgggtcgcgacgggaacccgggtatgtcccccggcccgttttcgcgtgagcattcgcctggttcacacaattggcgttcgagatggagccatggctatagtg

SEQ ID NO: 514616 - DNA, 366 bp, Homo sapiens
  misc_feature (4)..(4): n is a, c, g, or t
  misc_feature (41)..(41): n is a, c, g, or t
  misc_feature (71)..(71): n is a, c, g, or t
  misc_feature (118)..(118): n is a, c, g, or t
  misc_feature (306)..(306): n is a, c, g, or t
  misc_feature (353)..(353): n is a, c, g, or t
gagntggcaataaaagttaagttgtcacctcatgggatganctgcccatcctcaaatttccctttcctgantttccctgcttttaaaaaataccccattcaagccccaggaatggtgnctcatgcctgtggtcccggcactttgggaggcccagggtggggggagtgcttgggcccaggagtttgagactagactgagcatcatggtgaaaccccatctctacaaaataaaaaataaaaaaagttagctgggtgtggtgatgcacgcctgtggtctcagctgctcggggggctgaggcaggaggancgctggagcttaggagtttcgggctgcagtgggccgtgaatcgcgcnctgcactgcagcc

SEQ ID NO: 514617 - DNA, 548 bp, Homo sapiens
agggtgagtacttacggacggagggttgtgggaagaacagaggacagagggtggtaagtgtggacggatgtagacggatgctgagtacaatgtgggtcgggtaagattactgattagctggagacctagagacagtgtaacttgacaagaatgaaaatggggtgagaataaacattcattatgaaaaatgtaagcacctctgcttacaagaaaggaagcatggtaaatagcatgtggttagcagtgataactgcagattcactgacagacatacacagtgcacgtacactgacagacagacagtacaagcgagttgtatagagtaaattagaaaagtcccattagatgctcattacaagcaatatttctttaagaaacatatataacgttatagtcactgagagacacaaaagctgtgactatattgactttgagataatattgatttccagcatcagtaagatagctatacaaggacaatacaattttaaattgatatgtaactagtataccattaaaatctaataagcaaaagaaaagaaaaaaaa

SEQ ID NO: 514618 - DNA, 105 bp, Homo sapiens
attatggggattaccatctaaaactaggtgctatatgaaacttctaaaactagggctattgaaacttctaaaactaggtgctataagaaacttctaaaactagcg

SEQ ID NO: 514619 - DNA, 133 bp, Homo sapiens
tatcaaatacataaaggaaaagtcccacttggcacatctcccacaccagatgtaaattattcatactgcatgactgaggatttgggaggcagagagagattcatctgcaatattgggaacaccactggaggta

SEQ ID NO: 514620 - DNA, 318 bp, Homo sapiens
agtactcagatccccccaagtaggtggaaggatggggagacagtgggcaaaaagctcaagggccgggcaaaagtggggtttcccctgccaggggaaaagccaacttttgctagcccagtgaccctgctccccccctgggcagccctttcatggtgggccccctgtcccctgtgctgtcataaaaaatccccccaagggagtgccccttggatggtaagggatgagctacgtttttaagttatcggatttacttttcccttttactttagcccaggccggctctcctgttatgctgccctattaaaatttaaaactata

SEQ ID NO: 514621 - DNA, 482 bp, Homo sapiens
gtctaagatccctgctgtctgctctgtatgtactaaatatactttgaagtataagatatatctaatagtatgactaaggatataaaggcaattacaacagaataggctggaggggaaaaaaaagagaactgctcagaggttactcttcgagagaatgaagacggtagtctggattaaagtcatgacagaaggaaaagagattgactaaatctaaacaacattggaaaaagatgacaatggagagctctttaaaggattaaaatatgagacatacaggagaaaaattaaagataaaccaaaagtttcactgggtatgtgggggttactccctgtgggaacgatgaagccgtggtagaaagaactggcttggggacaaaaataaattctgttaaataaataaatagaaaagacaaatgtcctgtagagaagaatcacaaataatttatgtagatactttccctgtccagaggcaggacaagcag

SEQ ID NO: 514622 - DNA, 557 bp, Homo sapiens
tgctcctcaatctgcatgtaaattatactagcattaccatctcacttctaggactactagtatatcgctcacacctcatatcctccctactatgcctagaaggaataactactatcgctgtcattatagactactctcataaccctcaacacccacatccctcttagccaatattgtgcctattgccatactatggatctttagccgctgtcgaaacgcccaggtgggcctagccctactagtctcaattctcacaacacatatggcctagacattacgtaacaattaccctaacacctactccaactgctaaaactaattagtcccaacaattatattacctaccactgacaatgacttcccaaaaaaacacataatttgaattcaacataacacccacagactaatatatcagacatcaatccctctacatatttaataagacagataataaaaacaacctatatagctgtccccccaacctatcctcgaacaccataacaaacccccctcctaatactaacttaactgactcctaccactcacaatccatgcaa

SEQ ID NO: 514623 - DNA, 601 bp, Homo sapiens
ccgatgtggtccctgactgagttggtgaagtctgtggtacggtgggaaaatggcggatatctcagagtacggtggaggagaatactgcccgtcattcaagtaacaagcttatagactactaagtcgatcccacatggagtgccacgatggtgatcaatcgactcatgttacaggaatccgtcgaggaccacttataataataatcaggagaaagaggcaaagccgtgctgcgttccagactccttcagtttcctgcaggccgatgttctgtatagtctatattataatccaagccagcaagaaccgtcttagtagcatactggtcgttcataggactcagtagccgttcagagactcaccaccaggtgtttccaaactttgtatgcaatatctaagtccgtcttacattcccactgtacatcatacccatcccagcctttgttctgacactgtatgacttttggggtataagaatcacaaccagctgtgcctccaacacatttcaactgtgggatgggatccagcctgcgggaggtggtatagcggtcatagtggagggtaaagcttttacatcccgcagcaacattctgtcaggatcgta

SEQ ID NO: 514624 - DNA, 311 bp, Homo sapiens
tctctccacacggtcacactgggaaggagttgagcacattagcaacaatgtacattaagtttggattttcattttcatgttttattttgtaaatattatctgatgtttggagcttgagatatacagcactgtaatatatagttcttgatattatgtactaagttctgtattctgtttgcctgtatagcacttagaatgtgcaactgcagacacatatctaacgtgtgtagtggtaactcttgcattcacgtgagcttgttagtcgaacgcaggtaaaatataataagaggtacagccgagtgtggagagag

SEQ ID NO: 514625 - DNA, 707 bp, Homo sapiens
  misc_feature (416)..(416): n is a, c, g, or t
  misc_feature (423)..(423): n is a, c, g, or t
  misc_feature (425)..(425): n is a, c, g, or t
  misc_feature (431)..(431): n is a, c, g, or t
  misc_feature (556)..(557): n is a, c, g, or t
  misc_feature (563)..(563): n is a, c, g, or t
  misc_feature (565)..(569): n is a, c, g, or t
ccgatagccgacagagaactccccgactaacccgacagagaactccccgactagcccgacagagcgattaccgtggtgagctccgcctcccgtcacagcattaccgtgtgagctccgcctcccgtcagagcattaccgtgtgagctccgcctcccgtccgagcattaccgtgtgagctccgcctcccgccagagcattaccgtgtgagctccgcctcccgtcagagcattaccgtgtgagctccgcctcccgtcagagcattaccgtgtgagctccgcctcccgtcacagcattaccgtgtgagctccgcctcccgtcacagcattaccgtgtgagctccgcctcccgccagagcattaccgtgtgagctccgccccccgacagagcattaccgtgtgagctccgcctcctgtcancattacngngtgagntccgccccctgtcgggctagtcggggccccgactagcccgacagggctgtttgtagctgtcgagatggttttagggctcttcgagaggataatgcctactgtgaagacatcgatgagtgtgctgnngggcgncnnnnntgtcgggctagtcggggagtcggggctgtcgggctagtcggggagtcggggctgtcgggctagtcggggagctgtcgggctagtcggggagctgtcgggctagtcggggagcggtcgggctagtcgggggggtaccga

SEQ ID NO: 514626 - DNA, 174 bp, Homo sapiens
aaaaagggaaaaaggggggtttaaaaagggtgggaaaaaaaagccttttaaaccaaaccctttttccccctttttgggttttttaacccccgtttggggggataggtcctgtaaaaaagaaaaaacccttgttttaccccttttagtttaaaagtaaaaaaaatattgggttta

SEQ ID NO: 514627 - DNA, 407 bp, Homo sapiens
  misc_feature (382)..(382): n is a, c, g, or t
ccgatagccgacagagaactccccgactaacccgacagagaactccccgactagcccgacagagcgattaccgtggtgagctccgcctcccgtcacagcattaccgtgtgagctccgcctcccgtcagagcattaccgtgtgagctccgcctcccgtccgagcattaccgtgtgagctccgcctcccgccagagcattaccgtgtgagctccgcctcccgtcagagcattaccgtgtgagctccgcctcccgtcagagcattaccgtgtgagctccgcctcccgtcacagcattaccgtgtgagctccgcctcccgtcacagcattaccgtgtgagctccgcctcccagccacagcaataccgtggcggcatcgactggganactctagatcgaccaacagcagcaa

SEQ ID NO: 514628 - DNA, 183 bp, Homo sapiens
acagcctcacacatacccgagaggcaaatacaagtgcaacttacacaacaacccatagacgaaaccaaactagctacacaaaggcaacacacacaaaccaaaattaaacctgcacagctttgtgaaactaagacagaaatatatctgcaagaaagttctgcactggtcctcccaccacaaacg

SEQ ID NO: 514629 - DNA, 564 bp, Homo sapiens
  misc_feature (273)..(273): n is a, c, g, or t
  misc_feature (280)..(280): n is a, c, g, or t
  misc_feature (282)..(282): n is a, c, g, or t
  misc_feature (288)..(288): n is a, c, g, or t
  misc_feature (413)..(414): n is a, c, g, or t
  misc_feature (420)..(420): n is a, c, g, or t
  misc_feature (422)..(426): n is a, c, g, or t
ccaccgtcgagcgcacggtcattaccgtgtgagctccgcctcccgccagagcattaccgtgtgagctccgcctcccgtcagagcattaccgtgtgagctccgcctcccgtcagagcattaccgtgtgagctccgcctcccgtcacagcattaccgtgtgagctccgcctcccgtcacagcattaccgtgtgagctccgcctcccgccagagcattaccgtgtgagctccgccccccgacagagcattaccgtgtgagctccgcctcctgtcancattacngngtgagntccgccccctgtcgggctagtcggggccccgactagcccgacagggctgtttgtagctgtcgagatggttttagggctcttcgagaggataatgcctactgtgaagacatcgatgagtgtgctgnngggcgncnnnnntgtcgggctagtcggggagtcggggctgtcgggctagtcggggagtcggggctgtcgggctagtcggggagctgtcgggctagtcggggagctgtcgggctagtcggggagcggtcgggctagtcgggggggtaccga

SEQ ID NO: 514630 - DNA, 160 bp, Homo sapiens
  misc_feature (80)..(81): n is a, c, g, or t
  misc_feature (101)..(101): n is a, c, g, or t
gcacagcaaaaaggtgcagagctggattccaactctgcctccagactccattgacatggaagaggaagcctggtgacaanncccctgcttaccaacttttnacaggtgacccttccaggctgccctgttccaaggaagtctatatccaagaacccccaat

SEQ ID NO: 514631 - DNA, 444 bp, Homo sapiens
  misc_feature (108)..(108): n is a, c, g, or t
  misc_feature (159)..(159): n is a, c, g, or t
  misc_feature (239)..(239): n is a, c, g, or t
agagtatcagagatctcgacttacctcggacttactcagagtcttaccggagcttacctggtgctgagagagagaggcactccatgtggtctagaacacgtggtcatnagcccagcgtctgtgccggtccaggtgcctgctctgggtgtgtgagtgggnactttgctccctggctcatcctagagaggccctggtgcctagtgctgaggcctctggggctggaaagcctccagcagaanggaggcactactgagcaactatgcattgtcattgtcgggtttggggctttcggtggttccttggtgactgggaattgcttgtgtgcatgtgttgggtgcatgcttccgggtctcagctggcccaggaccggaaaggcaagcccttcccatccaaagccattggtggagcttctctggaatcatttgccaaaagcccaaggcagaa

SEQ ID NO: 514632 - DNA, 111 bp, Homo sapiens
ttccacgtcatcagagagtgatgagcctcaccattctacagaatgaaaggccagcacgagcaccaccaccgctcatggcaataagagaagacacaaacaaatagaaaaaca

SEQ ID NO: 514633 - DNA, 473 bp, Homo sapiens
tcaggtgagggacaggaaagaaggaaatatggggaaatggggtgaacatcagtggatcagagagacacagtcatgggggtcaggtgtggtatcaggaataatgtgggaggccagattgaagtccgggccagaaacaatggtagttgtgggacttaaagagtgagttcagctgaaggagctggggagcagaaagtatatgcgtcaggtatgaggaagaaaatagattttggaagttacgagaaatgtagagagtgagttgagcatagtttgtgattttttagggcctctaacagtattaaagcagcggcagccgctgcatgcagacatgagggctaggctaagacagtaaggtcaatttgtttggacagaaaggctacacggtgtggtcctggctcttgtgtaagaattctgaccacactaaccatgcctaggaaggaaaggagttgttgttttgtaagggattgaggttttgg

SEQ ID NO: 514634 - DNA, 232 bp, Homo sapiens
gttaacactcaccgcgaggtccgcggcttcatttttgaagtcagtgagaccacgaaccaaccacttcgggacacataccaactctttcatgccaggagaggctccttaaaaaatttcggtgattacaggtaaatatcacttaccacctgtgctaaactaaccagttattacgtgtactacagggtattctgctgaaaatatgggcaaatataggtgtgtaaaagtccagtat

SEQ ID NO: 514635 - DNA, 1180 bp, Homo sapiens
cgggtggagttatggttccacgatagcgcgaaggttagtctgctgagaatgttactcatgtgcaaaaacaggggtcttagtgccgtgtacccggtatcttggatgtgcagagcatgcgtgatacacatgaggctcagtcgttgcaagtatccgccatggccaaactctgggaaacccgggtgtctaacgtcatattaggatacacctagctgtgtgattgtgttggtgcccgtatcttcagctaactttggaaggttaaggcatggagaatcacgtgagccccaagatgtcgagttcgcagtgacccaaaaatcaagccactgcactctagcctggatgacagagcaagactctctcggagagagaatacaagtaacctctgtgcttagtgtaacttattgctaaattccgtgtctttgtcttcttggaacagtcttctacttgttacaggatctgtccctatcttttggattcttatattagtttgtaatagtgcaatgaatatagttctatacctatatagcccactgacatggctgttagctgacctcagttccttgcatgacttggccagagccttcagtttcatgatctctagtaagaggtaatgtgtctcatcctctagggcaaggctgtgactagactggcttctcccagagggaatgatgtcgtgagagaagcagggagacgtaagaagtcaagacaaaactgcagtcttttatacccatcactacttgccatattctctttggtcacacagcccaacgcctggtatgatatgggaggctactaagctccatggggatgggatatctgggcaccatcttgaaggctcagctgacacagattattttgatgcgcgtgtcgcctagtcaatgaatttttcatggaccagagcgatcgatggactcacgcattataatcccagcactttggtgagagcgagatgaggtgagctcacgatgcgatcgggatgttcgagaccagcctggtaaagatggtgaaaccgccatctctactgaaatacataaacttagccaggcatggtggacaggggcctgtggtactcagctactcgggaggctgaggcgggagaatcgcttgagcttcgggggtacggaggttgcagtgagccgaatgacgccatacactgggctgcgacgtagttcccccccgccca

SEQ ID NO: 514636 - DNA, 239 bp, Homo sapiens
ggtgggttgcttggctgaaccagccttctgatggaacctctttgctggcaggtgctggagaaaattaggtatctacctaaggccattaaggcgtggaataacccgtccccacgtgtaaaatgtgtccttggcagagctcaagggcgttacatgcgagaaacaggtgtgtaactaggtaaccgggatctgcgttatctctaggatagagggtaacagcctcattgcaacacggtctctca

SEQ ID NO: 514637 - DNA, 1197 bp, Homo sapiens
cggtttttggtcgctgcacatcgcatcgctgtttgtggttacgctgactcgagtgggcgcgccggcgacgttggtgttattaatctccttcgtcctcccctcctgcactactgtgtgttttgtgttccgcggccgggcggggacggtccgtcgtggtttgttctgcacggtgcgcgcggtgcggtggggggggtgcctcgttctctgcccctcgccttgctagcttttatggatggctgcgacctggtttgtgttgtttgtttttcttacgcctccgcgcgcgcggtggggtgccgcccacaccctccgctggttattgattggattgcttctcctcgtcattactgcgccctccatcgcccacgtcggcgtcggcggtctgtccttgctgctcacgccgtccacgtgactcgtctccctctcctgtccggcgtgtgtatggctgcgtccctctcatctcatttcttcgtcgcgggtgtgggtgctcgattctccgctcgctctgcccgctggcgtgggggtcgtgctcactctccccccgcgagctgggaggacggacaccctctcgctccgcacgcacgtcgctctgtttcctcctcttctcgcgcgcggtgtggatgcgacgcgtcacttctcctcgactccacgacgcgacgacctctctctttcgtgtcttcgtgtctcgtgttcgcatcactctctctgtcgtgggcgccgctgttctctctcctctccaccgctctcttatctgtcgtggcgcgccgccgccctctcgcgctcgcggctggcccgtcctccacctctactccctcaggtgatccttgttgtcttcgctctcgcttcgtggcggcctgcctccctctctctctctctctctctcccctccgtcttctcttgtcagagttcgcgcggtctgggtgcagagcgagcctcgccgtctctctcttcttctctctccgcgcgcgcgccttcttttatctaataatgtgctggtggggggcgccccccctcttctcttgttctcccctgcgacagatgggccgggtctctctccctcgtctcccctccccccccccgccgctgcggtctgctctccctccgaccccccccccccgcggggggggagggagcagagagggatgtattattttttgtttttttttttgtttataaaaaaaaaagaacaagagaaccaca

SEQ ID NO: 514638 - DNA, 596 bp, Homo sapiens
gcttgggttctctccgtctctcttgttcccactcgcgtggtgctttctcctacagttccgttggtatcgttcacgagatatgcctccagccgtgctcttttcacatccccgcgcccgctgtagcattgtgtttcgtttgttgtggtcactgtaaatcccggagtcacttctgggcaccgatgcttcatggatcttgctatatttggtgatcaatttccgcgcttactcaccccgctcatggtggggtcctattgctcgaacgtggtcccaatctatggcgttgtctaacgacctctgcgttcctcgccgggcttccacggtttgtttctttacccactcttgtagattctttcctgtggattgtgatcggttgacaacgttgtcctggctctgttgtcttttgtgttaatatagtgcacctgtctcccgtatctaatgtcttcgctgctatgtaacaacccacgtttctcgttatctgaacatcctcccggcgattccttttgcctttgtcaactgtttgaactccaatgttcatgggtgcgccattcctttgggaagtgttcattgccatagttgcgggatttcccaacgttttt

SEQ ID NO: 514639 - DNA, 1442 bp, Homo sapiens
gtgaaaagcgacgacacggccgtctattattgtgttagagatggtagaggctggtcctttgacctctggggccagggagcccgggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514640 - DNA, 922 bp, Homo sapiens
  misc_feature (897)..(897): n is a, c, g, or t
tggctcacaacagcctcaacctcctgggctcaagtgatcctccagcctcagcctcctgagtggctgtgactggaggcgcaccccactacactgggctaattttttaattttttatataaacaaagtctccctatgttgctaaggctgaactcctgggctcaagcgatcctctcacctcattatccaactttaaaattttgcaatctgggctgggcgtggtggctcaggcctgtaatcccagcactttgggaggctgaggtgggtggatcatgaggtcaggagatcgagaccatcctggctaacaccgtgaaaccccgtctctactaaaaatacaaaaaattggccaggtgtggtggcacgcgcctgtagtcccagctactcaggaggctgaggcaggagaattgctagaacctgggaggtggaggttgcaatgagccgagatcgcaccactgcactccagcctggcgacagagcgagactctgtctcaaaaaaaaaaaaaattggcactctgatcggggggacaccatggcttttcacttcaaattgggcttaattatcgggaactaaactgtggcttcatataaaacttttttaccttgttttattttcctatgaacctccattctgacccatgcggtccatatgttggtaacaatactcatggatggggagcatgaaatagagccctcctttctgttgcctaaccgttaaccttttaaagaaatggggcgtgtaaaaagggggtgcttttcttagggagaaacacctcggggaaatacactatcttccccaacaacgggtggggaattacccctttcaccccaatgatatgttccgagcctccccagacatccggagtggcaaatcgtcaagaagaacggctcaacagactatgngctgacatattaccactcatatccg

SEQ ID NO: 514641 - DNA, 1429 bp, Homo sapiens
cgaaggaagggacaactactagtggctggtacggtagttttgactactggggccagggaacctggtcactggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514642 - DNA, 757 bp, Homo sapiens
tatctctgaccccctggagccatggagaagtgtaaggatccggattggccaatccattgtgggtccaacttcaaccgcaggcactggagatgatcctcacaagcccggactccagtaccagcctgtttgccacccggtagaatgtcatcccgtatttccagccggagttaattgctagatttcttgccagtcgaaagatattgttctggttgcctatagtgctctgggattctcacgagaccaaacgatgggtggacccggactccccggtgctcttggaggacccccgtcctttgtgccttggccaaaaagcacccagcgaatcccccgccctgagttgccctgcgctacccgctgcacgcgtggggttgtggtcctggcccagagctacccatgaggcacgcgcactcatgacacgaacgtgcacggtttttgagttccacgttgactgcacgaggaccactgaaagccactatgagtggcctagaccacgaaatctccacctattttaaccacgtggatagttttgctagccacccctaattatccactattcacgatgaataattaaccactggagagctttgcctgatgtctacccacgaagccctgtgtgtggatggtgaccccgaggacgtttttatgccggtgactggacatatcacctttacttaaatccgtcctgtttagcgacttcagtcaactaccgctgagtccctaggcccgaaagaccataaatttttctccttttgaaata

SEQ ID NO: 514643 - DNA, 1745 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaagcaaaaaaaaaaaaaaaaaaaaaaaaaaaaagaatacaaaaaaaagagaaaaaaaaaaaaaaagaggggggggggggaataatcaaggaccgccggaggaggggaccaccaggttacgcgaggcccccacgactcgtgcgaacagggggggcccacaaaagggagaggcctatcatatagaacgagagagcagagagagggtacaacacggcgggaacaggggacaccgagcacaaacggggagattatggtgcggaaggacgagacccactacatagcacgagcggggggggggcaacgataatatatggggggagacaaaatctaaagcgtataaggagaatttcttaacgccgtccctatgaggggaagaagtcttacagcaaacattctagtagtagggtttatatataaggggtagatcaacacaacagcgggcataagaaacttgtgtcggcgagataagagggaaaaaatctgcgccacccgaggaatatatacataagaagaagacaattattatctacgcag

SEQ ID NO: 514644 - DNA, 1082 bp, Homo sapiens
tggcgtggtcatggcgccccgagccctcctcctgctgctctcgggagtgcctggccctgacctgagacctgtgtgcctgctcccacatccatgagtgtatttctgacacctgcctgtgtccctgtgccctggcctgctggagatgcccctgcttcatctcatgtgtggctacgtggacgacacgcagttctgtgcggttcgacagcgacgccgcgagtccgagatggggagcctgcgggcgccgtgggtggagcaggaggggccggagtatttgggaccgggagacacagaaggtacaatgctgccagggcacatggctgacccgagtgagcctgctggaaccttgcgctggctactacaaccagagctgaggacgggtctcaacacaccatccagaggatgtctggctgcgacctggggcccgactgggcgcctcctccgcgggtatgaccagtccgcctacgacggcaaggattacatcgccctgaacgaggacctgcgctcctggacctgcgtggacaccgcgagtcagatcacccagcgcaaggttggaggcgggcctgtgcaggcggagcagatgagaagcctacctggaggggcacgttgcgtgagtggctccgcaagataccttggagaacggggaaggagacgctgagcgcggaagaaacaccaaagacacacgtgaccaacaacccatctctgacctgaggccaccctgaagtggctgggccctgggctttaccctgggagatccactgactgacagcggatgggagacagaccaggaaacgagttgtgaacaaggcagcagaaaggaggttcaaagtggcactgtgtgggctctgagagagcggattagttacaattgaaagagtttataacctacagagtgagagattaggaaacaatagtgatataagagaagagagaaaagcaaggaggaaatataatgagaacaaagaggagcaagagagacacgaagagaagacagaagagcagaataagtaagggtatagacgccgtctttttcgcgaagaaaagaaatcaaaagaaatagacatagaaggtaaaagagaaagaaa

SEQ ID NO: 514645 - DNA, 321 bp, Homo sapiens
atcatgaatttttgtccttgtgcagattgctgtggagtctctgtcacgacatcctgccaggtctatgtccataatgatatttcctaggttttcttctaaggtttacacagtcctgggctttacctttaagtctgtagtccatcttgaatcgatttttgtatacagtgaaaggaaggggcctagtttcaatcttctgtatatacaaaaattctaaacttgaatgtacttaataaaataggctcaaaaatgtataaagcaaaacatgaatagaattaaaacaaatgatcagactaccatcactgtgtgagacaaagggaaaca

SEQ ID NO: 514646 - DNA, 1415 bp, Homo sapiens
ttgcatttactccatggaccaaaactggatacttcaccactggggtaggaaaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514647 - DNA, 1413 bp, Homo sapiens
tagagatcgggctttgacggctacccctcaggagatgactggggccaggaacccggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514648 - DNA, 221 bp, Homo sapiens
cggacgcgtgggcggacgcggtgtgagctaagcaatgattagtagccatgtcaatatgaataacatgttgacgcactagtgattgggctagctggagttcacctagacttaaagctaacgtcgagtgataataatcgattatcactaggtagtggctcatagccatataccgacagaaggagccctgtgatcgccaaacacaagttgactgtgcgtggggc

SEQ ID NO: 514649 - DNA, 1592 bp, Homo sapiens
  misc_feature (89)..(89): n is a, c, g, or t
  misc_feature (1233)..(1233): n is a, c, g, or t
  misc_feature (1237)..(1237): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaaanaaanaaaaaaaaaaaaaaaaaaaaaaaaaaaaaaaaaaaacaaaaaaaaggggggcggcgcgcgccgcctccgctgtctagattctccctcccgcggggcccgccccccttctctcgccgccgtccccctcctcttgtttgtcaacgagaggggcccccccccggcgggggcgcgcttctttatatcatcctggcggagcggcggggcgcgccccctgtcttcttcaccagcccctctcgctgggcggcaacactcctcgtctgctggcgcggtgcctcttctctcggcgggggcgcccccctccttcccccgtgggggggcggccgccactctcgtggccgcccgctcccctgctcga

SEQ ID NO: 514650 - DNA, 773 bp, Homo sapiens
agcggactgcgagtcctcgcctactcccagaaaacacccgggtgcatacgcggtgcggccgctgattcaggtcggcgggctccaggagacatgtgtgggcagcgtcgccgttactccttcttgggcagtatattcccagacgccacgcggaggtgggccatatgagctctgatttccaggactgggtcactattcaggacacggtccagcgcaatgccgcgtaccatgtctcagggatgagtgaacatccaagcatgtggccatggacaactccaaggaaaagtggagattcctgaacccatgcatcagaggagagaggtaagagcaacctgagagccaaggagcaatgatcagaacattgggcagactggaactagccacaacgaaaatcgggagaatacacgaggagcgcagaaaaaaggaaagcatgcgcggtgacaataaagcgcacaaaggcagacgataaaaggaacaaatgaccagatgtgaaagtgtgccagaggaaacaagagacatagaatcatggcaagagaaggcaaagtgaagtgacagcataagacaccgtggaagaccaggagaataaacaaggtcaccagaagacgctaatgtcaaggcaatgcaggcaacatgaacacgcgcaacacagagggcaggattgacccccgataggaagaaaaacaatagaagacaacagacaacgcacagaagcggtgacatggccgcaaaacagccacgcccgagaaactcagaacgacgaacagcactcaaagaaa

SEQ ID NO: 514651 - DNA, 1400 bp, Homo sapiens
  misc_feature (41)..(41): n is a, c, g, or t
  misc_feature (45)..(45): n is a, c, g, or t
tgggttgctagctgctttctacccctgatacctcagtatgntctngactcataggataaccatgcgccgctccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514652 - DNA, 1436 bp, Homo sapiens
  misc_feature (81)..(81): n is a, c, g, or t
cgagagatcgagtcggcgagagggattcttctggctggtccccggcccacaacggtatggacgtctggggccaagggaccncggtcaccgtctcctcagcatccccgaccagccccaaggtcttcccgctgagcgcagcaccccccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514653 - DNA, 137 bp, Homo sapiens
ggctatcacacggtatatacatcttgatccctatttccacaacttgaaaagaaccaagtccatatagatgcataataaagatgaaagtgtaaaaagtaaatttatggttaaaaaaggaaagtgtcttcatttacttg

SEQ ID NO: 514654 - DNA, 589 bp, Homo sapiens
ttctttaaagggacttttccctttttcccatcgaaacaagtgcagattttgccctgtgtagaatttccactggggtgggctgttccagctaccgaaccagcttccgaactcagaggcacatggcaccagtggcattgaaatgcacgctccagcttacctgaaaggaattgttaatatttctgttcagtatacctaattagctctggagtactgaaatttcacagaagtaaaatttgatatatgtccatgaattcctattaatttcccaaaaaggagtccctcttactatatccaaaatttttgcatcttttacattttcattgaaaaaccactttaaaaaaaagttacatgccaatttctaagatgtttcctcacaatcagaaaaatgttgttactgtaacatccaatacaccatttccttctgactcctggggaactcgctgttggtataaaagtggaattttcaagctgtttagttgaaatagaacattttgttaagtgaagtcctaaaggggaatcccacgtataaaaccaaccagaggtgagtagctgtgactgaatcactgtgggagcatctctgtctccaaac

SEQ ID NO: 514655 - DNA, 1419 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttcccccacctcccccatgctgccacccccgactgtcgctgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514656 - DNA, 775 bp, Homo sapiens
gggactggccaggcccccaaacctccaagacccatcgtgctggatgcctgtggataagcgaggggagagctgactagtgccctgtctgcggggtaccttcggcgaggagaggcgacgaaggtctgcaccagacgatggcactggacatgtgcatgcacgggtgcatacatgaaaactgctgtaaaacgaacgaacgtttgtcgggtagttattatttatgttgatcttgtgttgtcttgggacggacttgtgggagaccccacaagaatctacattaggggaagcaaggaggacgcgagcgtctctcagccagaacgagatggctcataggggggtgaaatccacgtggatcgtgcgggaaaaaatgtcagagcgttcctcgagtagagagcggggctctatgtggcgcgatacaggtgtgaaatgctggggatagccacaggaaaagagggagtgtaatatagcgcgtgggaggacaggaaggacaacagctgtgcgcagagtcaccgtgtggctcgcacgcaagtgggggacggtgtattacgaagagtgttgggttgggacagatgatgtgggagagctgcatgcgggaaggggagtgtctacaagaagtaatgtaagggggcgcatgttggagcaggttgttgtaatgaaattaccgcaccgcgtggggactatatgtggggggagaagcgccgatattttacagagtcgttgcttagcagaggttgtgtggtgatgtagaaagagagacaatgtaggatgttgttcgagt

SEQ ID NO: 514657 - DNA, 859 bp, Homo sapiens
aaggctaggtaacgaggctggtttagagggagagcggaccagagagccttagcagccaccgcccgcggcggctagttaccatcacaccccgggaggatgccttgcatgctgccgcagcgtgccccagtcaccatcacctgcaaccatgagcagctgaggccgagacccagcagccgctgtgaaaaagagtaggacagtcagtgcatgatatgatcaccagagacccggctacataacgtgacaaggtggtagacacatttgatggaagataacagctagaggaactcaccagtcgagcagcgacatagcagagaagagaaacaacgaaagagtgatctgaaaaagaagtgctaaggacactcagataagaatgtacacagattgtaatatgagaaggggtataatgagattagacaccaacgtggtagaatgagcgagacaaagggaaagagatgagagtgtgatatagaaatagaaatgtcaaattaaaacaaagcaagataaacatgcaggcaaagataacagatgtatagatagaagaattattggagaaggaaaatattggaataatagacagccagaagagagagcgaattgaaataagtgggattgagagagcaagagacaggtggaaaagagttgcgttacagaagtggaacacaatagataaagtgatgtgtaatagtcaagtagaagatggaactaggcagagaacttgagagaggagtacacaatgaaacgagttttaatcagactgcaagtttatatagcataagaatagcagacatatatacaaagcacagaaaagaacagatagagattagctaataaattaggtaatagttgatggcataatagg

SEQ ID NO: 514658 - DNA, 1566 bp, Homo sapiens
  misc_feature (118)..(118): n is a, c, g, or t
  misc_feature (120)..(120): n is a, c, g, or t
  misc_feature (137)..(137): n is a, c, g, or t
  misc_feature (171)..(171): n is a, c, g, or t
ggccagacgtacgggcatgcaggccctcccctccagcccctcagcatccagccacatctgtggacacagccagcgcggcggagcagggctctgctaaggacagacggcatcaaggcangncctgggccgggccaggnctccctccccacagcagccctcttggcaggcagncagacgcccgtgagggtggacctgccatgagggcctgcacgccggaggccgcccactcagcactgcgggccctccggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttcccccacctcccccatgctgccacccccgactgtcgctgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514659 - DNA, 126 bp, Homo sapiens
atcaactcgcaaggccttgtgaaggagtcttacctaaaaccgaagaaatatcagggacttttgttgactatttacacctcagttttacatttaaattccaggcagtgttaatatgccaaggtaggg

SEQ ID NO: 514660 - DNA, 196 bp, Homo sapiens
atgctcagattagacaaatggaaggggccccagggagggggggggtggtttaagtaacagtttttccccagagactttgattcagctggtttggggcaaagcccaggaatccgcattttttcccagccccccccttgattttgacgcgggcaatccaaaaatgaatttggcccttaaaacaaaatttttcttttta

SEQ ID NO: 514661 - DNA, 453 bp, Homo sapiens
ctaggctgagaactggatcagaaatcaagtaccctcgaccaatcaatacagccagtgttggcagtattttctgcaaaaggtctgtgacatgcccctgcttgttgacatggagattgctgcctgttcaccgtgggcacctcacctggccagaggagaccgctgttgagcctgggttacagtggcagtgaggagagcgagcactggcctgaacacggtcgtcatggggaccctgccctacacaccctgaggccagtaaccgctaaggagagtgggcacagggcacgtgttcaggaggcccggggaacctaacagccatggcctgtcctgaggccatctttgccttcatgtgcctggggtggccctcaggtttccctgaggagctggaaacggtcttcaggctgacctgcaccacccctgtcccagcctcctcctctgagcgtcagtgtcctccct

SEQ ID NO: 514662 - DNA, 243 bp, Homo sapiens
  misc_feature (81)..(81): n is a, c, g, or t
  misc_feature (103)..(103): n is a, c, g, or t
  misc_feature (168)..(168): n is a, c, g, or t
  misc_feature (184)..(184): n is a, c, g, or t
ttgggtggacccggtcaacttcaagctcctaagcactgcctgctggtaccctggcgcccacctccccgccgagttcacctnggtgacgcctccctgacaagtncctgcttctgtgagaccgtctgcctccaaataccgttaagtggagcctcggtagccgttcctccnggctgcctccaacggncctcctcccctccttgaccgcccttcctggctttgaataaagtctgagtgggcggcaaa

SEQ ID NO: 514663 - DNA, 1093 bp, Homo sapiens
acatgttaggatggctcgccagagcttcagtgggcggggactacgacaggtgactccataccaaggaggatgagatgactgtcactggaatagagcggatgagggaagcagctcctacgaagttccctctgtggctgctgcatgatctggaggagggtgctggtccgactagtgagcttgcaatgacagcccactccaaagatgttcacaaagggtgtaggaggcatcatcttatccaccacatcagcgattttagacttgagtgaaagtggtctgtgccagtattggaggagggtcttaaagaatccacacagacattccaaacaaattgcatcatgaaaagagaaatgccctgatgtgatgaattcctcaaagcattaactattcaggtatgattcacgaaccaccttgactatgtgcatggtaaccactcacggttacaaatcagacacttcaaaggcggcattacatatcctggggaaatacggaagaactccaaccgcagacacattatatgacaacacgtataggccataatcagaacaaggacgaagatcacgttaattcaacagaaagttgatacacccaatggatgaggaaaggacatgagtgataaatgaccggatacagccccaacagacctaggataatggacaagacgtggtagacgctataaaagaagatgagtggcccacatcgatgggaaaaatttaacaccagtaccacaatcaagacgatcaagatttagtagccaatgacaagaggggaaattagggggacagtggaaaataacatccaccaagaaaggacaataacaccagttgcaagggaaaaattgtggagagagccacaaacaacaaacaaccaacaattgataacgttagcaccacataagatatagtgccacgaagcaaagacatacaagagtaaacggggcaataccaaaaacacgtggagatatacaagacagaagaacaatggaaaaaccccaatacgcggagaatgagaaccgacaaacacaacagcaaaaacaacacaaaggaacaaaatggaacagaagaattggcactaatggagaaacaatagcacagaa

SEQ ID NO: 514664 - DNA, 190 bp, Homo sapiens
agggacagtgcagcatggcacgggttgtcggtggcatgtgtaatgtgtggccattttagtggttcctgcacagcagccccaatcattggccaatgtcatcacctgtggcagacagcccaggcccaaggtcatagctttgcaaactgtcattcaagcaacagcaaccatcacatttatccagcacattcat

SEQ ID NO: 514665 - DNA, 174 bp, Homo sapiens
cttccccattttttccaattccctttccccaactttccagttccaaaggccccaggcctggaaggatccagtgcatatttaaaggggggccctttgaaaaccgttaaaaggaatatatgtttgttttcccccttaagaaaaaatggccagcttacccaatgtttaactttccga

SEQ ID NO: 514666 - DNA, 837 bp, Homo sapiens
  misc_feature (283)..(283): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (295)..(295): n is a, c, g, or t
  misc_feature (298)..(298): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (314)..(314): n is a, c, g, or t
  misc_feature (351)..(351): n is a, c, g, or t
  misc_feature (384)..(384): n is a, c, g, or t
  misc_feature (391)..(391): n is a, c, g, or t
  misc_feature (461)..(462): n is a, c, g, or t
  misc_feature (529)..(529): n is a, c, g, or t
  misc_feature (578)..(578): n is a, c, g, or t
  misc_feature (786)..(786): n is a, c, g, or t
tttataaaaggttatgggagagctttatttaaaaaaccccccccaggggaagggacccccccaaaattttttaaaggcccttccacgataggaggggtcaccaaaagccccccggtagctttcgcccactcagaatgacacgggcacttaacttcagaatttccgttacttagtggcatgtatatcctagttatcgtcataaagtgcatggctacatatctactacagatagaagtatttctcatgagtcagaacatggttcattcacaataccatcatgctnacacntntnagncanancanganagnagngngatctatgtgtactaagatgttctgtttgtaatatgngtgtgtgtgtttatgttgcttaagagatcaaanctgaaanatgagaatcagaaatgctcttgttattttttgctgtgttacagcttgttaatgctctactgtctttgttnnaagagagatttgttcactgcccagctcgttttgtgtcctgagccctatgcccagcccaccttataantcatgcctgtttagatgtttgattttgttctgtttgctattgttatctnaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctagtccgtgtctacttgtncacctgcatgcagccttcattaattttgtagcaaaatataaagtgatcatt

SEQ ID NO: 514667 - DNA, 399 bp, Homo sapiens
  misc_feature (74)..(74): n is a, c, g, or t
  misc_feature (117)..(117): n is a, c, g, or t
  misc_feature (159)..(159): n is a, c, g, or t
  misc_feature (223)..(223): n is a, c, g, or t
  misc_feature (225)..(225): n is a, c, g, or t
  misc_feature (319)..(319): n is a, c, g, or t
  misc_feature (349)..(349): n is a, c, g, or t
aaaaaaaaaaacttagctgggcgtggtggcaggcgcctgtaatcccagctgcccaggaggctgaggcgggagantggcatgagcccgggaggtggaggttgcagtgagccgagattntgccactgcactccaggctgggcaacagagtgagactctgtntcaaaaaaaaaaaaaacaaaaaagagctaaaagaccagactgggcaacatggcaaaaccctgtntntaccaaaattacaaaattttagccaggagtggtcatctgtgcctgtggtcccagctgctcgggaggctaaggtgggaggttccacatgggcttnggggaggcagaggtttacaaatgaaactgnagattgttgctaacttacactccaccctggggtgacagaggggacccagg

SEQ ID NO: 514668 - DNA, 344 bp, Homo sapiens
  misc_feature (45)..(45): n is a, c, g, or t
  misc_feature (48)..(50): n is a, c, g, or t
  misc_feature (136)..(136): n is a, c, g, or t
  misc_feature (272)..(273): n is a, c, g, or t
  misc_feature (275)..(275): n is a, c, g, or t
  misc_feature (278)..(278): n is a, c, g, or t
  misc_feature (282)..(285): n is a, c, g, or t
  misc_feature (287)..(287): n is a, c, g, or t
ctcgtgccgaattcggcacgctaccttgaaaagtgcattgcttangcnnngagccatgatcaggcattggttggggataagtcgctggcattttggttgatggatgccgaaatgtatacaaacatgagtgtcctgnctccttttactccagttattgatcgtggaatacagcttcattgattcgactcattacgcatgggcttggtggagaaggctatctcaatttcatgggtaatgaatttgggcatcctgaatggttagacttcccaagnnangancttnnnngntacaagttcctaaataattttgacagggatatgaatagattggggattggttggctt

SEQ ID NO: 514669 - DNA, 839 bp, Homo sapiens
  misc_feature (283)..(283): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (295)..(295): n is a, c, g, or t
  misc_feature (298)..(298): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(312): n is a, c, g, or t
  misc_feature (314)..(314): n is a, c, g, or t
  misc_feature (351)..(351): n is a, c, g, or t
  misc_feature (384)..(384): n is a, c, g, or t
  misc_feature (391)..(391): n is a, c, g, or t
  misc_feature (461)..(462): n is a, c, g, or t
  misc_feature (529)..(529): n is a, c, g, or t
  misc_feature (578)..(578): n is a, c, g, or t
  misc_feature (838)..(838): n is a, c, g, or t
tttataaaaggttatgggagagctttatttaaaaaaccccccccaggggaagggacccccccaaaattttttaaaggcccttccacgataggaggggtcaccaaaagccccccggtagctttcgcccactcagaatgacacgggcacttaacttcagaatttccgttacttagtggcatgtatatcctagttatcgtcataaagtgcatggctacatatctactacagatagaagtatttctcatgagtcagaacatggttcattcacaataccatcatgctnacacntntnagncanancanganagnagngngatctatgtgtactaagatgttctgtttgtaatatgngtgtgtgtgtttatgttgcttaagagatcaaanctgaaanatgagaatcagaaatgctcttgttattttttgctgtgttacagcttgttaatgctctactgtctttgttnnaagagagatttgttcactgcccagctcgttttgtgtcctgagccctatgcccagcccaccttataantcatgcctgtttagatgtttgattttgttctgtttgctattgttatctnaaaggtgtataactctgacatgccagacatcaaattaagctcaaattaagctctcgtttaaatgtttaaacacctaatttatattctaattgatcccagccactgatgcatgtactttagctacttctgctaaataagcatattaattttccacatcaggccatcagatcttgagaaccaacagttatctaagaaatttcccgtggtcttactaaatggttttcaccctgccatggccagcccttcatttaatttttggnc

SEQ ID NO: 514670 - DNA, 228 bp, Homo sapiens
gtgagggggatacaggtgtatacaccacgcctagctaattctttattttgttgtgtagggacagtgtcttactagtgttgcccacgctggtctcaaattcctgcttcaagccatcctcctacctcggtctcccaaagtgctgaggttacaggcgtgagccagcacacctggccttacatcatttgtgaaaagaagaggagcctgtctttgctcctgcgaaccatataa

SEQ ID NO: 514671 - DNA, 450 bp, Homo sapiens
agctgtggacaattatttggttctttacgtacatgcataattctagcaaaaataaaaactaaattcgaagaaaaaaagaaggaaggaatcaaggggcaaaagctgccacaggaactgaggatgttcccaaagatgtgatcccacacccacaaggcctgggagagtgttaggttgcagaggcgcaaagatcccgcataggacacctgctggcttccctgctttcatgggcatgcctcaggcagaggtgatgcctgcatgcctgggaggatgagagcgtcgttcctcttctggcaggagaatctgttctgtgcactttcagaatgactgttaggagggaggatcaaactaaatgaaagatgacccagccctctccacacctttttaaatggaaggttctttgctaaaagctccagcgtattttcatgcatggccagggttgcatgggtaccg

SEQ ID NO: 514672 - DNA, 204 bp, Homo sapiens
ttttctggtacattcgtctccttagaaggagacattagaagcagtaaacatcccagagatagtaactttcttcttcagaactttttccaacaaatcactcgcattggctgatgaagaagaagatgactgaaaaggtttatactttctgggagtaccactatcttgcgctgtaattcctgtaggtatttctggacttcatatggc

SEQ ID NO: 514673 - DNA, 189 bp, Homo sapiens
ctacgacataatggcagctgcctccactgagcttcaggacgtcatcctgatctccgtgggaacattttcgttgctgtcggtgctggcaggatgctgtttcttcctggtcctgaattatggaggcctgatttactactggtttcatactaccacgaagccatccctattactagatagaagagttattta

SEQ ID NO: 514674 - DNA, 836 bp, Homo sapiens
tatggtttgagggggaatgctggaaattgtaaggggtatggagacatgtcatataagtaatgctagggtgagtggtaggaagtttttaacataggaggtgtatagagtgggtcgtagctggaactcagggggtatgctagtccggaattcatcaaaaacatgggaggttaaaagtcagggctctggtggtgcaacacaacatattgttgtgttgtacgacgtttcacgtggggacgagttgcgtcatattgtttgtccctaagtgaagatttgtcagttgggttgaggggtgtatcattcatacataaaagtgttgtggtgtatacggctatgacaaaatagtggcgaaagggcgcctgcggcgtatccgatgttagcaagccttgagactagttcggactccccttcggccaaggtcagaaagggggtcacgagagtggtctactgactagttgttggagataaatcattatatatggccaagtgggtcatagaaggcgcaaggggaagtaaactccagagggtggtccctctgctagctggcagaccacggggctggacagacgtgttaaaaggagcccactatataaaaacagtgtcgcaatagtaaaatttgcgtggctaagggttgcacttcattattgaagatggtcgcggggctactagctcccgaatgtgcagccgacaaaggcgaacattggcttcggatgctacccctgaatccaaagggattggctacaacggcaaggacaagggggttcgaaaacatgtgagcccggtgcaggttacccgggatagtaaaggagaggagcacacaaacgtatgaaacaaccagg

SEQ ID NO: 514675 - DNA, 104 bp, Homo sapiens
ctcggtaccacatttctaggggagtgggtccgctccaccagtatgccagcaccggggcagtgcagctcagtagccctgtggcggactacagtgacctggggtat

SEQ ID NO: 514676 - DNA, 855 bp, Homo sapiens
ggacgatcaaagctactgtcctcaaggttggaacaggcacgagagtgtcgcgagtcctctatctagatagcacggaatggcagtgtatatgggctacctagcgtggacacgagcaagggcggcatacacggatgcttgataaccgttgagaatgccagcgtgtgtcgcaagtatcgtctgagtcaggcatgcagaaccgtgagggtggtgacgtggactgtcacagctactatagcaaacgcatactcccgaggccctctatgtaggagccaaggccattcagctagaacagtaatagtgattcaagctctgcgtacgtctcaaggggaggcagcacgttagtgaatcatgggccaggagatccacaggaagcgaagtaagtccacgtttcgtggcacggcccatacggcgtcgcaccttgctcgcttagatcgttatggaacggtcttagtcgaagtgttagcttgagcctccaagcatgtattacgaagaagcaatggtaatggctaacaacgtagtacaacaactctggggagcaaatgcagcagaaccttaccctgttagccagccgtgggtcttgaagagccagtgacacaggagaaagccaaaagcgattgataagatagaagccctgagccaggaggccatgattacatcaaaggctgtggtgaaaaaacgcagaactacttagcagagaacagaactatgacgatggaattgcttatgctgaggaacgcactggctaatcagagtgactggtgtcctgcatcggatcctaggagaattccttgtaagctgtccactgagtatcaggaggcacatggaccgtatagtataagacctaagaaggaccca

SEQ ID NO: 514677 - DNA, 990 bp, Homo sapiens
gcgattttcaagattctaaagctcaatgcaacgtgacacagttaagtgataaactccagatctgatcaagagtccggattctaacagtcctatgctgggggggtgtgctgacaactgaggctcaggtgccttacatctttgttctaatcacagtgtggcatatgagcctgccctcactccctctgcaggaatccctttagcgacctgagaccctactgaagctggctgtgtagaaataaggggcctgcagttggaggattatcaggtatcacgatttgcatggattcccttctgggcttcatgactggaaactttggtgagggctgctttttcttaagtgcccacatatgatggacgcggtggaacataacttgtgaatgtataagagtcgataagattctcagggtctacacatcagggagtgacaagaaatgggggctccttgtgttagatgggcgtgaatttttacctcggtgagtatgagggaagatgtctctggggctgcattctcctcgttgataatggtgattccctcacaatgtatggccaccctgtgaacaggcggtaaaaacacaacggcgaggtggggccatttggttactgcccggatgttaaaacggccatgggccttcataccaaaccgatgtgttgacccaacctgtacgtgggccgggtggtataccgcttgcggaaagtgccgcttactgctaattggacggggcccagtgtttactcgcttcgtgtcaaaagggggggcataatatattcagctggaccatacccgtaagagaggggcaatgtttcggaaggcaattgacctaatgcgtttggagaacaagccattataggggactcccttgaatgaacaaggaaattgctcgacaacgaacctgaagaatattctttaaataaattcgggaagatgtccccaccctgaaacttgagtatgcccggtgtagttcgccaagattgcgtgttacataagctata

SEQ ID NO: 514678 - DNA, 547 bp, Homo sapiens
  misc_feature (22)..(22): n is a, c, g, or t
gggtttggaacaacccccctgncttcccggcgagggccccaaccagaagtgtggcccatccgcttcctgaatgctgggaaggcgcagaaattccaacccaagtttgaagaatgccggaaagggttcgaaaagaaaaaaaaaaaagggtccggccaaaattgtccttcccaaaaaggggcggaaaagctaaaagctctctcggttaaggaggagccccaggaggatgctgaggagaaaccataaatcgtctttttttatttttttttcccctccttccccccccctttttaaaaaaattttaccccgcccccctttttcgggttggttttattttttcctttttcaaaggggcgttaaataaaaaactggaccccaccctccgggtggttttttttttggttttaaggttttgccccattgaaaaaggcttcagaaaatcccttcccccgtcatgaaaaagggctgggctaacctttttttccatagtgggaacccttttttatagtcctccaaaatagtgaataaaaaacccctttgggacctggga

SEQ ID NO: 514679 - DNA, 157 bp, Homo sapiens
tgcacacatcaagacgtctacatcataagcatcctacaaagccaatatgacattccataagacatggtttcggcccactctccattcagtcgtaactaataaaatatatgttgggtcgaaaccatctcaaatggatttcatatagggaaagaaggct

SEQ ID NO: 514680 - DNA, 171 bp, Homo sapiens
acctgatgcctctgattactctcatcgctacctccctggacagcgcctatagcgctcgaataattcttctcaccctaacaggtcaacctcgccttccccacccttactaacattaacgaaaataagccccaccctactaaaccccattaaacgcctggcagaagcaggaag

SEQ ID NO: 514681 - DNA, 329 bp, Homo sapiens
gcagtcaggtgaatgcataaggggcttacctccttgtgtggagcacaggatgatgaagtgcgtcattctatctctgttgacgtacacagaaggtgctgcgcattccgcctatgtgatcatatgcgatattggttgttctctgtggagaatatatcttaaaaacccatggggtttcttctatccccgaatcccccgggatgaagcttttgggggctactaccaggagcaagttaatctccaggaacggaggaaatacctgaaacacaggctcattgtggtctctaatagacaggtggattaactggaaaaaacggcgtttgaaagacgca

SEQ ID NO: 514682 - DNA, 697 bp, Homo sapiens
ggtagacccacaaccttgggacctaccactccgcgtagtaatataatgaaaatatacttcaaatcccgttttcttctttctcctaaacaacttctgtgtcgccggacagccgctctgtcgcggtggtgcgtaccaatgcccaccattgttctcactactgcatagggtcttctcacccacagagtatctaatcctcgtatcgaagagagagctggtcgtgtgcagtgtgctgagagaagcgtgtcccactgcacccatgtggggccctcctcagaggagacgtcgttcacacaggcgtccacacactgggtagcacctcgtggcgacttctcttacccctcgactctcgcgtcacactccccctacgtttctgggtttatgattcacttggggtatcacttgttgttattgagaatatgagaaaagatgaagagtataaagattgatctgtgttaggtaattgttagtcctggagacagtactcttcaaagtagatattgggaggttttgtcacgctgtgacgtgtcaggcatttacccttaagattaaagtcggggtttccaataaataaataattatttttgttagtaatttgtcaggtgtggtgatgcatgcatgtagtcccaaatacattaggaggctgaggtggaaggatacatgaggcaaggaaggtcaatacaacagggactgtgatatg

SEQ ID NO: 514683 - DNA, 1203 bp, Homo sapiens
gagctcggtacccccccgactagcccgacaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514684 - DNA, 135 bp, Homo sapiens
cttcgattacgtaaactacctttgcttagtgatggctagctcgtccttgtgcttctgcaggtcttttccattcagctctgttcccataacttcttccgctccctatttgccgtccgtcatcgaagcaaccattag

SEQ ID NO: 514685 - DNA, 177 bp, Homo sapiens
accgatattgacgcgtctcctgggttgggccggatccaccctgtaaggtacatcacgcgcccggagctggcctccagcgaggggttccagacggcccagcgaaccatgtgcatgcaggccaaggtggacgaggcggtgaccgacgctgcctagaaggggaacaaggcacaccagtcg

SEQ ID NO: 514686 - DNA, 1438 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514687 - DNA, 151 bp, Homo sapiens
aggactcactgagtagcgtactgtctgcggaaaaataaggatcggcatggtacgccacatacatgcccggtaccagacggaaaatttctgataaatcccaggctccggaatcgcggatcatctgatggtcaatgacggtgactgcaacggg

SEQ ID NO: 514688 - DNA, 1445 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514689 - DNA, 106 bp, Homo sapiens
cgcccttttatctcattttccaaatcttttttatattctttctccctcagaaggttggtgatgtactttacatgtaaaaattctggagtcttgtctaaatccagtg

SEQ ID NO: 514690 - DNA, 311 bp, Homo sapiens
cgtcggattagcgaagccaatatccagctgatcgttgccggccgctcgatgctgccagagcctgctgtcgaccaaccatgccgcgcgcgaacaggcaaccactccagccaaggcagcgcttgagaaaacccgtgcactgatcctcaaggcacgcgccagctttatcaccaaagaaggcatggcccagatcgaccaactggaaacgccgctcaagaactacgaaaacctgctgctgcaggtgttgaccctgcatcagctatccagcctattgcaggataccagcgacgtcaccgagctggcttatccgacca

SEQ ID NO: 514691 - DNA, 1533 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccagcgatagacatgtcaacttactgctgaattctcacgactaaggagtgatgacatgtagccctatgccacaattcccatcaatctcacagctataacctcctaatcatctcctcaaagtcgtatcatatgctgctaatcatcctctcattgctagtgatctcgcctgattgatcacgtgcacgcgtatcacgtgacgcttctgaagtgatcacttgactcattatgtgattcagcaaggcagacatcactcgactgatgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514692 - DNA, 1224 bp, Homo sapiens
  misc_feature (89)..(89): n is a, c, g, or t
  misc_feature (1211)..(1211): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccaattataanccaagcagcaaat

SEQ ID NO: 514693 - DNA, 90 bp, Homo sapiens
gccctgtatctctgtgccagcagccaattgactagcgggggcagtagcgatgaacagttcttcgggccagggacacggctcaccgtgcta

SEQ ID NO: 514694 - DNA, 424 bp, Homo sapiens
tctttatctgatataccaagcgccaagaaacatcctgtaatatgagggagagatctgcctatacttcccagtaggatttctagggaattcttattattctgatattccgtgcaaaacagttctattcgctctcgtgtcaaatttacagtcttctagatgagtgcttagagttgacttgtcaagctcggtgctttcctgcctctagtatgtcagttgcagctgctgcctgacaatgttgtaaaaccactgggtcgatatgtttcaagtctggatgatctaacacggactcgtccggctgggtgtccaggagactctggaatgccgcccggagtcgaagcgtgaaggcgttggagtcgaaggaagcggggatcccgacagcatctggaagcctttctgcacagagtccgagaagacccattgtgag

SEQ ID NO: 514695 - DNA, 244 bp, Homo sapiens
cggaaagtgaatagaggcaggtcttactatgtgcccaggctcgtctcaaattccggggctcaagtgatcctcatgcctcctaaagtgcggaattacaggtataagccacctcacccagcctgattcactatactatttttatttttatatgagatggagtctcgctctgtcacccaggctagagtgcagtggtgtgatcttggctcactgcaacctctgcctcccaggttcaagcgattctccg

SEQ ID NO: 514696 - DNA, 422 bp, Homo sapiens
atcccatcatttatccgaggatcaagccgggcgggcagatccaagtccagagccaacttcaaatggcgtgcggggcgtggctcgtatccaacgccacgcacgtgcttgagagcgagacgcccaatggccaatggtttaccggcattcttgggagtctgaaaattggctgatacacaggaaaacgcctacctcggggctgccaatcaggccaccggagcggaccccaacaatctgcaatctttcctgatctggcagattctgcggtcgataagcggcgccaaactcgtcaaggtggttggcaccaagaacaacggcggcgtgagcccggtcggcttcgtcgacgtgcagcccttggtcaaccagcttgacggatggaataacgcgacgcctcacggcaccgtttatcacctaccgtacttccg

SEQ ID NO: 514697 - DNA, 1347 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgccctgacgctgtaaactgccctgacgctgtaaactgccctgacgctgtaaactgccctgacgctgtaaactgccctgacgctgtaaactgccctgacgctgtaaactgccctgacgctgtaaactgccctgacgctgtaaactgaggtgaacagc

SEQ ID NO: 514698 - DNA, 153 bp, Homo sapiens
  misc_feature (7)..(7): n is a, c, g, or t
  misc_feature (11)..(11): n is a, c, g, or t
  misc_feature (19)..(19): n is a, c, g, or t
  misc_feature (49)..(49): n is a, c, g, or t
  misc_feature (57)..(57): n is a, c, g, or t
  misc_feature (136)..(136): n is a, c, g, or t
ggaaagngggnccttgggnccccccctccccccttttttttcccccccnttaaaggntttaagggtttttgtttccccgggggggggggggggccccccggggtttccttttcccttttttttggcccgttttatnaaaggggccccccttta

SEQ ID NO: 514699 - DNA, 1248 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagtctcggcgccggccactttttaacaaacccaggcgggcgctttgatattaaaaatcttcccattggctcccttatgtct

SEQ ID NO: 514700 - DNA, 1222 bp, Homo sapiens
tgggttgttctcctggagttttgctgaagtgtcagtgctggtgcaaggagctccgggggacgaagacggccgtgcacaatggagctgggtgagaactgagctcgcagtgctgcagtgcctggacatgtgatgtcgggccgcaggccatgcagtaccaggtcctgaatgaggtggtgatattgacagaggcccctcctcctacctgtaccaatgtggatgtctacctggacggacacctcatcaccatggtgcagggcgacggagtgatacgtgtacaccccgactgggcagcaaggatgtatgacggacgcgagacgggagactccatgcatccaacccaacgtgcctggaccatcatagatacacgcccatactagacacccaactacgcatgatccataacacgagaaccaatacgatggaaccaccgaaaaggaagatcagcagcagtagaagaatcaatgcaatgaccaccatgacagcacacggacaacaacagaaacttgggcatgaaccaataatgacccggcgcacagggacacgacagaccaacgacgcatacaagcacaatagagcagaacaagcgatcccagacaatccaccgaaaccaacaatgagactccacacaacataccgcccacccactcctcggtgtagccgggagacaccgcagaaagaacgacacgccccaggggacaggacagaaagacccaacgcacgaaagacggcactagcaaatagtgcacaacagattacaggagacagacaccggcaaaagagcccgacacaacgaagggacgagacgggagcgaacacagcgaaggcaggcgacggaacgagcgcacacaagggaaacaaaagcacaaccaaataccaagagtaccagaacaacgaaccgacacccgccaacaacagcagcacacagcgagaaccactacagaaggagacacagcaaccacaaacccagggaaaaccaggaacgagggaaaaaccgcacagttcgcaccaagacgggcgcacaggccacaaatcaaccatagagacaagagaaagccaccgaaacaaagaagacacgggggcaacacgccgccagaagggacccaccaaaacagcacaaacaacaaaaaaaagaaccgaacacaaagatagaagaagcacaacacacaaaacgaacaacgaacaacaaaacacaaagcaaaggacaagaccaggcagaacgaag

SEQ ID NO: 514701 - DNA, 1837 bp, Homo sapiens
  misc_feature (89)..(89): n is a, c, g, or t
  misc_feature (1453)..(1453): n is a, c, g, or t
  misc_feature (1478)..(1478): n is a, c, g, or t
  misc_feature (1482)..(1482): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcggattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtccggggcccatctggcaacagggagggcccccagtactgagcgggagccggcaaggcacagggaggaagtgtggaggaacctcttggagaagccagctatgcttgccagaactcagccctttcagacatcaccgacccgcccttactcacatgccttccaggtgcaataaagtggccccaaggaaaatgnaaaaacaaaaaaaaaaaaaaaaaanaaanaaaaaaaaaaaaaaaaaaaaaaaaaaaaaaaaaaaacaaaaaaaaggggggcggcgcgcgccgcctccgctgtctagattctccctcccgcggggcccgccccccttctctcgccgccgtccccctcctcttgtttgtcaacgagaggggcccccccccggcgggggcgcgcttctttatatcatcctggcggagcggcggggcgcgccccctgtcttcttcaccagcccctctcgctgggcggcaacactcctcgtctgctggcgcggtgcctcttctctcggcgggggcgcccccctccttcccccgtgggggggcggccgccactctcgtggccgcccgctcccctgctcga

SEQ ID NO: 514702 - DNA, 1410 bp, Homo sapiens
  misc_feature (89)..(89): n is a, c, g, or t
  misc_feature (1339)..(1340): n is a, c, g, or t
  misc_feature (1348)..(1349): n is a, c, g, or t
  misc_feature (1352)..(1352): n is a, c, g, or t
  misc_feature (1362)..(1362): n is a, c, g, or t
  misc_feature (1376)..(1376): n is a, c, g, or t
  misc_feature (1379)..(1379): n is a, c, g, or t
  misc_feature (1382)..(1382): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcggattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtccggggcccatctggcaacagggagggcccccagtactgagcgggagccggcaagccaggagagtgtggggacctnnggaaaacnngtntgttgcaaancagcccttaagttngancgnctataaaggtccagagaaaaaggcccgg

SEQ ID NO: 514703 - DNA, 1318 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggaggagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcggattggcagatgccgcctccctatgtggtgctggacttgccgcaggagaccctggaggaggagacccccggcgccaacctgtggcccaccaccatcaccttcctcaccctcttcctgctgagcctgttctatagcacagcactgaccgtgaccagcgtcgggccatctggcaagaggaggcccagtactgacggagcggcaagccaggagagt

SEQ ID NO: 514704 - DNA, 485 bp, Homo sapiens
gtaacaatttgcaggggtggttcatttgggatggtttttggccatctaggcccggaaagacgtacaaaaggtcccttaccagagctggcttctggtaatttccatagtaccacccgtatccccttctctccgggacctggtcatgtggcgagacacagcacgggggacacctttggaggtagtggctggtgaagaaggctgattggcagttaaagtccatgcgagtcgtgaccccaagggctgtcgaaggcaatctcctactccgggagctggattagacggtccggggaggagagaggggggcgcaggcgcggggccactggagggcacacaggccaatggctggtggatggccatggctggcccacgctggccggagctcggggcggacggggcactccgatctgggtagctcaggggaagggtctgaggccgggcatagtagtagggggtggagggggcatctctaggtaagagccgggcaa

SEQ ID NO: 514705 - DNA, 297 bp, Homo sapiens
  misc_feature (21)..(21): n is a, c, g, or t
cttttcgtggttccagtgggnagagaagaggaagtaggagcggggtggcaggggggggaccgccgcggctgctgccaccgccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtg

SEQ ID NO: 514706 - DNA, 119 bp, Homo sapiens
ctctcacgtgggggcaaggggaaatgccccttgtgttgtccaccctcattcgtccccttccctccccagaaatggccactggttgccctaggaaccacccaggctcttcccaaaggacc

SEQ ID NO: 514707 - DNA, 307 bp, Homo sapiens
tcgagtctgctccagtagattgaagatctggcgataaacctccatgacagcagaatatcttctcatccacgaggttgagtttatctaaatccgccaccaccgcctctgctcgtggcgtgggaaaggaggtgtgagtcccgggcgcgagccggcggcggcgccgctgcgggagggtcggcggtgggaaggcgatggcggatttagataaactcaacatcgacagcattatccaacggctgctggaagtgagagggtccaagcctggtaagaatgtccagcttcaggagaatgaaatcagaggactgtg

SEQ ID NO: 514708 - DNA, 177 bp, Homo sapiens
  misc_feature (1)..(1): n is a, c, g, or t
  misc_feature (11)..(11): n is a, c, g, or t
nttcagtgaanccaaatttcatcctcatctgttagtcatactcccgttcaccgttctcaactactcatacatgcccgtgctcttctttacactgccggtttacactgtttctccaagacatcacagctgatatctcctggtgctatccccaaactgccactctaaactcttgaagta

SEQ ID NO: 514709 - DNA, 205 bp, Homo sapiens
tttctttcccaaaaatggttaattacaacttgttaaattgttgaacatttaagttgaggcacaagaacaattgcgccaaggcaattgttctttcttattattgtggatctcttaccctcggccaaaccaattccttaatttaatccctcaaaggccttaccccttgtggaggggaaggcccttaatagagggggaggaacaccaa

SEQ ID NO: 514710 - DNA, 468 bp, Homo sapiens
ctacatatttacatttagccatgtacgtagggatatattccttaactctgtcctcaaatttaagatcctccacaaatttttaattttctacactggttacagttaagaaaaactgtaaacatctttgggaaaggtggcataatagaatggttagatcacagactctggcttggcttggtggtgcaggcctattgtcctagctactagtgaagccgaagcaggagaatcacttgagcccaggagttcttggctgtagcacgcaacgagcgttgggtgtcctcagtttggcatcaatatggtgaccccacaagagccagggaccaccatgttacctaaggaggtgtgaagcggctcaggtcagaaatggagcaagtcaaaactcccatgctcaccagtaatgggatcatgcctgtgactaacactgtactccagcttgggcaacacagcaagaccctctctccgtgaaaa

SEQ ID NO: 514711 - DNA, 126 bp, Homo sapiens
atgagctcatctccataattgaccctccacgggctggcgttcctgagtgccgtgggcaaatgtcgaagtgctggggagaaagaagagggtggtcactaacttgtctcttgtataaaacatacacaa

SEQ ID NO: 514712 - DNA, 272 bp, Homo sapiens
gattttggatgccatcgacttaagtgaagttgcccgggctgaggtggagattatacatccatgtcacctttcttggattgatcaaaaaattgtccgcgtacaccagcaagatatgtttttggtcccaaaattgagaaattcacattcaggtctgcaatcaaattatgtccaaggtttgcctgggatatcccatgtgttgaagttgcagatgcgcacaactttgcaatgtttaaccgaaagctgtgagttgaagcaagcatttcctttattga

SEQ ID NO: 514713 - DNA, 358 bp, Homo sapiens
  misc_feature (43)..(43): n is a, c, g, or t
  misc_feature (353)..(353): n is a, c, g, or t
  misc_feature (355)..(356): n is a, c, g, or t
ccccatcctgtgggttgtgttttccacctttatccgataatgncccttagaccatataataaatttgtattttaaaagtgacttgatttggctgtgcaaggtgctcacgcttgtaatccccagcactttgggagactgaggtgggtggatcatatgaggaggctaggagttcgaggtcagcctggccagcatagcgaaaacttgtctctactaaaaatacaaaaattagtcaggcatggtggtgcacgtctgtaataccagcttctcaggaggctgaggcacgaggatcacttgaacccaggaggaggaggttgcagtgagctgagatcatccagggcaacagaatgagactnannat

SEQ ID NO: 514714 - DNA, 188 bp, Homo sapiens
  misc_feature (59)..(59): n is a, c, g, or t
  misc_feature (86)..(86): n is a, c, g, or t
aaaaaagccatgaaagaagttagaaggaagaggtggaaccgtcccaaaatgtcctcgcnggagcagcaggaattctcgcgggagcngcaggaattctcgcgggagcagcaggaattctcgcgggagcagcaggaattctcgcgggagcagcaggaattctcgcgggagcagcaggaattctcgcgggg

SEQ ID NO: 514715 - DNA, 232 bp, Homo sapiens
cgatccttaagaatctgctgctaatctcccctgggctatccccggggaatctctctgccatcctgcgaggtctaggccctttaaggaagctccgtctctttttccccaacagactgtcttcacccttgggctttgaaagccagacaaagcagcaggaattctcgcgggagcagcaggaattctcgcgggagcagcaggaattctcgcgggagcagcaggaattctcgcgggg

SEQ ID NO: 514716 - DNA, 170 bp, Homo sapiens
gaggacccgatcatcctgctgctgctgctgctgctgctgctgctgctgctgctgctacggtggtggcggcggcggtggtggcggtagcagcaggaattctcgcgggagcagcaggaattctcgcgggagcagcaggaattctcgcgggagcagcaggaattctcgcgggg

SEQ ID NO: 514717 - DNA, 782 bp, Homo sapiens
cagccattgctgtacattgagctccatagatgacagcgccggaggccatgtgacgagccgtggacggcactgtcgcgactctgtcgcctcgctgcatggatatataattagactaattgcatgggcaggaggagtatccctaagcataaggccgagacggcccaaatgtcgatccactcatgccttgttgttgtgcaccctagttcgtggcgtgcgcttcagtacttcgagctcccagatgcttcagtcaacgtcctcagtaggtttatcatagatgaagtgctcagcaagaccgatgcgaaagaccatgctcttgctaagacgagaacaggagcacttgtgaagatatggtcaaagcggactatgtccgtgtatgaaggagagactgaatgaccttattacttcccttcccaaagggcgcatacaagagatcagactgttcagaggatcccaattggcatccgagaggcctccttcggccttctgtcctcttctgactctgagtatctgcccatagaagtcacatggagaactatccctggcctgtcctattgcgtggatttttgcgaataaaactgggagcagaatgtggtcataaacacttgcttgccggatgaccaaggcagcccttatgaacaagaggctggcgacagctgacgtgaactctaccgcccatgtatttttgctgccatttcgagctaaaggaaacccttatggggcaaacaaacgggagtgtcaggggtaaaaacgctgaatgcaggaatggccggccttgtaatcag

SEQ ID NO: 514718 - DNA, 217 bp, Homo sapiens
ttacaaaaaactgaaaaattagccaggtttggtggcatgcacctgtggtcccagttactctggaggctgaggcggggggattgcttggcctgggagattgaaggctgcgttgagctaggatcatgccactgcactccagcctgggcaacaaagcaagaccctgtttccaaaaagaaatctacgtttatgaagataagtttgtttcccaagtttaaaa

SEQ ID NO: 514719 - DNA, 605 bp, Homo sapiens
taataatctttctaatctttctacgctcagattttccactttgagaagtttgcaaggtgtctcttcagatagacctggttagatagtggtcccaactacttttcagctgtgaggctttgggctcaagttacttaatatccctgcacttccattttctcatatgtaaaattaggattttttcttcttagagctgttatgaggattaaatgagataaagtatataaagtgtctcagctgctgatgtaaatttagttattatcattagacgtgtccaatgtctacctcattagtggcaacactaggaccaaaatcctagtctccaaattcatttacagctttcttggcactgtactaataagtgacagtggtgacttaaggatggatggtaacaaagagatgatctcaggtattggaaggcctgttatgtgctgtgtgtacatccaggctagacttggtgcaggtaagggagagggtggcaggttgcacaaccatattggacattgtctagttagttcctttcctgggaacttgtcttcttcactccttaatctctcctcctacttggcttgtgtttcaggagctacagaaggcccaaaaaaaaaaaa

SEQ ID NO: 514720 - DNA, 356 bp, Homo sapiens
cggtccaggtctttccctcaatgatcatagacaagaagcaaaggcaatacagggggaaagacagtcttgtcaacaaatgatgctagaacaactggaaatctgcattagaaaaaatgaatctagacgaaggctttaaactcttcacaaaaatttactcagatagatcacaaaactaaatttaaaacacaaaacaataaaattcctagcaagataacataggagaaaaatctagatgacttagggtttggtgctgactttttacatacaacaccagagacatgatccatgaaagaaagaactgataagctaaactttattaaaattagaaatttctgcttagaggggaaaagaccctg

SEQ ID NO: 514721 - DNA, 1236 bp, Homo sapiens
actggccctgcgtctgtaggccatgagcccctgacatcagcccctttagtgtgtgctcgccggctgtcatgggattgtggggtgtatgccatgccccggaggactcgtgcttcccctgctaaccctgacctgccgcacccacccagtgccagtgtcagagcagtccaccatgggatgggtgactgggggtggagtgctgcacccctgctgcccacccatccaccatgcagccgtcttatcgcctgctgtggtcacctgttgtcatttctctggcctcctgctggacctccttggacttcacgctgctgctgcccctgctgcccgtgctgtttgagacgagccactggcctgtgcccactgaaccccatctattggctcctggcaagggcaggggtggacatggttatgccagactgccatcggaagatgccagtgtgacaacgaggtccacacaatgtgtacccttggacagaacgtgtctccatttgggacatcgcgacatttcatcatgatagcatgacagacaccaggtgatgtcggccacatcaacttggaggtgccaatactcatgcaccttgacttatccgagacaggacaccacgcatgacatgcttgctgctgacctgaaatggccctatggccccaaattacataattgccaagtcctggggcaccacgcccatcgtctggtaaccattttgcctgagccgctattacctgtgagcacttcaccaggggcgcttggacttagctgcgggccacactaccatcacgagtggggtgaacggatcacagcacgcacaatcccacagtgtgccacatcttgtctagcatgaaacccgtgggggcataccacacatcgattgggtccccagacagaaaagtggcacttggagtaggaacaaaacggacaggttaggaacaagtaagcaacactggacctgatacaaccgaatgtgagccaccatcttgagaaacgaaagcccaaacccatgaagccacaccggggataaaccagtagaagcgaactggagccgaaagagcgcagagcgaacactagacgagagagcagcgcgaaacaacatgaacaagaagaacgacacaagcaggagaacaaggcgcacaagaagaacggtgacccacaggaagcagaaacaggaaggcagacacagaaaaaacgtacatatgacgacacacaaaagaaatgagaaaggatatagaaaggcaaaacgacca

SEQ ID NO: 514722 - DNA, 328 bp, Homo sapiens
acctagaggatccgtgatgtatcgcccaacacacactggctaattttgtatttcagtagagacggggttcacgatgttggtcaggctgatctcaactcttgactcaattggatcacccacttggctcttccagtgctggattacaggtgtgagccaccacgcccagccaaatttcttaaaagtttctaaaaggttttctggatagaggtgtggatttttgtccaatatatttttttgcatcagtggagatgattatatattttttttctttccattaaatgcgatattattcatcaattgtttttcttggtgttgggggataacatca

SEQ ID NO: 514723 - DNA, 204 bp, Homo sapiens
acgccaggcgatcgatgttggaagatcctttaggggatcaaaacagaccacatatttggccgttttctacggttgcactatgcccgcgtgtttatcttcttctgacacgagaacacacgtggcaaaggatgactttaacatgttcataaccaggtcgttggagaggacgtccagcttcttaacttgatcgccttggcgttgtag

SEQ ID NO: 514724 - DNA, 890 bp, Homo sapiens
cacttcaatccagaaagcatgagaagataccataggagggaatgagaaggtgcagaagcgaagaagactgtaccatgatctctagaagctgaggcacggcggcagagcggctggtgcaacaggaagtctcagtgtggaaggggtcttttctctccactgccaatgtgagtagaatgtcctagattcagtaggagagggcgctgtatgacaatataccacggtgctctactgcttttaagttataggaactgttacgtgtgtagatttccgatgtaatcgattggaggttatcgacctcaaataagaaagacatattgtgtgatcagtgtacggttctaattgcaaagcattccagtagtatcgaacacaataatgtctactgtggtatagtccacttgaataagaaagtagaggcagttttaactatgttgccgttaggctggataggaatgtgggttgttcgttgagcaaatatatcagcatctaattgaaatgacgaaatagcattcttagagttgtgtattatgaatataattgatatttagatgaatgtcttgtacacatatgtgtactttcatatctgatacaaaatcgtacatttataaccgtgtaatggatattcctagtttaaacggagatagaacagccaatatacgctagatatggtcactgaatgataacgattttgcagctttagaccaataatcatctctagaggattcacaacgttaactgtcttgataagaagtgaaggggctgaaattggcctttaccgtcatactgagatctttagaacttggacacggttacttgtggacttccctggtgagaataccctgaatttccttcggacaaaaaaataactgacctaagctgcggacagcgttaaa

SEQ ID NO: 514725 - DNA, 102 bp, Homo sapiens
  misc_feature (79)..(79): n is a, c, g, or t
aatatggatggcatgttacttaatgtaagttgtacactgtcatgttgcatttcgaattgaacacatagatgcttgcctngtctgcttgggtgaatgcctctt

SEQ ID NO: 514726 - DNA, 305 bp, Homo sapiens
aagccatttgaatttttaaaaaatttcaaacaggcaatgggatatagatagggatatcccccatataatatatatggtaaaggataaaggggaataataatggcaataaacaaacccctgggggcctaccaccccccttattgcctttcctttgagggaccggggggggtttcctgaacctatttttatccctgtttgaaaaagggaacccctggattgaactttgggttggccaaagcctttttgttttttatccctttatttccagggatggatccttaaagaataataaatgggatttaact

SEQ ID NO: 514727 - DNA, 952 bp, Homo sapiens
  misc_feature (89)..(89): n is a, c, g, or t
  misc_feature (887)..(887): n is a, c, g, or t
  misc_feature (916)..(916): n is a, c, g, or t
  misc_feature (927)..(927): n is a, c, g, or t
  misc_feature (945)..(945): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcaaaatccggaaacacattccggcccgaggtccacctgctgccgccgccgtcggagggaagcttgggcccttgaaacggaggttgggtgaaggttgaagttgccttgggaatttggggttttnaagccccaaagggttgttggttgggtttnggttggggttngaaaggggttgaaaaggnagttttt

SEQ ID NO: 514728 - DNA, 460 bp, Homo sapiens
  misc_feature (7)..(7): n is a, c, g, or t
  misc_feature (66)..(66): n is a, c, g, or t
  misc_feature (88)..(88): n is a, c, g, or t
  misc_feature (102)..(102): n is a, c, g, or t
  misc_feature (104)..(104): n is a, c, g, or t
  misc_feature (112)..(112): n is a, c, g, or t
  misc_feature (140)..(140): n is a, c, g, or t
  misc_feature (145)..(145): n is a, c, g, or t
  misc_feature (150)..(150): n is a, c, g, or t
  misc_feature (153)..(153): n is a, c, g, or t
  misc_feature (161)..(161): n is a, c, g, or t
  misc_feature (166)..(166): n is a, c, g, or t
  misc_feature (174)..(174): n is a, c, g, or t
  misc_feature (212)..(212): n is a, c, g, or t
  misc_feature (241)..(241): n is a, c, g, or t
  misc_feature (271)..(271): n is a, c, g, or t
  misc_feature (281)..(281): n is a, c, g, or t
  misc_feature (458)..(458): n is a, c, g, or t
ctttggnaacatgattatgttatacaaagccttggcaaatccaacagcatacagtgcactgggacnttccccaagggtctgggaggtnttgccgatggggtngntggggatngggggcgaggggggggggagtttggggnctggnggggntgngctccgcnttcangcgagtgngcatagccaagtgccccatccaccagcgaggtgcttcngtgctgaggacgcacgcatagccaggggngtgacgggcaaacgtgacatcaaatccganggcggctgtnggctcccttcctgccagccccagcgggcaccccgtcaagttctcgctctgtaggcagctggagtctcaggctcctcagaacgatcactgggctctggcacctctccccacacctgtttcaaccactggtccgcctcgctctcctccctcaggtagcaccagatgatcagcgccacgngg

SEQ ID NO: 514729 - DNA, 1389 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgctaaccgccaccctctcagctggccctgaacgagctggtgacgctgacgtgcctggcacgcggcttcagccccaaggacgtgctggttcgctggctgcaggggtcacaggagctgccccgcgagaagtacctgacttgggcatcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514730 - DNA, 1163 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgcgagaagtacctgactgtgccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514731 - DNA, 809 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatggaaccatgggaagaccttcacttgcactgctgcctaccccgagtccaagaccccgcatcgctaggcgatctcatatttcgcacgttcatgggttttcctacaggagaacagtatac

SEQ ID NO: 514732 - DNA, 717 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccaaccgtggaatagtggtaccgagctcc

SEQ ID NO: 514733 - DNA, 223 bp, Homo sapiens
  misc_feature (16)..(16): n is a, c, g, or t
  misc_feature (26)..(26): n is a, c, g, or t
  misc_feature (56)..(56): n is a, c, g, or t
  misc_feature (169)..(169): n is a, c, g, or t
  misc_feature (176)..(176): n is a, c, g, or t
  misc_feature (210)..(210): n is a, c, g, or t
gcgctagcggcattantgaacgattnccttacacatcagtctgggagaagcaaggncttctttattcctcagagcagaagagtgaaaggtaacaactctgaaataattcccagtaaagtccctggaggaaaaagccaccatatgctgagccctgctgttctttggacantgctcantggagccctcttcctgacactggtcgttcacttnatgccgctagcgc

SEQ ID NO: 514734 - DNA, 142 bp, Homo sapiens
  misc_feature (16)..(16): n is a, c, g, or t
  misc_feature (44)..(44): n is a, c, g, or t
agaagacgacagaagngacggctgcgagaagacacagagggtangctgcgagagacgacgagggtacgctgcgagaaccgacagaaggacgctgcgagaagacgacagagggtacgctgcgagaagacgacagaaagggtac

SEQ ID NO: 514735 - DNA, 733 bp, Homo sapiens
  misc_feature (89)..(89): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgccgggctgtgccgagccatgaaccatgggaagtcttgctggtggaaggtaccagctcata

SEQ ID NO: 514736 - DNA, 257 bp, Homo sapiens
gagatcgaaccatcgcattccagccttggcgacagaatgagacactgtttcaaaaaaaaaaaggaggaagaggaagaagaagaccaaagaaggaaggggggttaatgagcagggggggcctaagcaaaggcactggctttcagccaggtggagggtctcggtgagaggactgaggttgaggaatggaagcccgcccggtctgagggatagggcctagtgagagatgcggcacagtggaatgggagtcacttgcagac

SEQ ID NO: 514737 - DNA, 320 bp, Homo sapiens
ggggccctgcccgctaggtcatgcatgtgcttgaggcgaccaaccttaacctaagtgtgggagatttcttgcgagccatgaaattggtgtctggggagtctgaaagcaaagtgactgcccatggtaaattttttaacacccttcaatcttaaggtgggaaagacttccttttttgtaacccttttagaggggcagcttcagaacggtattcaggctggcattattgctttagaaagaatcaaacccgggacttgtttgcctgaatttcttttaaggcctcaagctttactagggaccttccaattcacaccttaaggatt

SEQ ID NO: 514738 - DNA, 797 bp, Homo sapiens
  misc_feature (89)..(89): n is a, c, g, or t
  misc_feature (619)..(619): n is a, c, g, or t
  misc_feature (699)..(699): n is a, c, g, or t
  misc_feature (718)..(718): n is a, c, g, or t
  misc_feature (730)..(730): n is a, c, g, or t
  misc_feature (751)..(751): n is a, c, g, or t
  misc_feature (782)..(782): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctgggacggccttcaagtggggaaggagcgntgtttcaagggaccaacttgagcgttgaacttttgttgggttgttaacagggttttccagtttttcttgccggggttttncctaggccatgggaaccangggggaaggacntttatttttgcatttgtttgntttaaccccgagtttcaaaggaccccgtttntaccggcaacttttt

SEQ ID NO: 514739 - DNA, 156 bp, Homo sapiens
ctagaggatccccaagcgatacatcgggcccaaccgagggcctagctccaaaacggcaaaaaaccctctgctaggagctgcattctgcaaagggaaaccgtgctcggggattaaacctcagccccgatgcagcttggctcaggatcgcagcgcttg

SEQ ID NO: 514740 - DNA, 631 bp, Homo sapiens
  misc_feature (89)..(89): n is a, c, g, or t
  misc_feature (613)..(614): n is a, c, g, or t
gccgtgtattacttgtgcgcgagggggctacgattttcggaggcctaaattctactactatagcatggacgtctggggccaagggaccncggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgcccatcgtgcggggatcnntagagtcaccgtgggaa

SEQ ID NO: 514741 - DNA, 762 bp, Homo sapiens
  misc_feature (81)..(81): n is a, c, g, or t
cgagagatcgagtcggcgagagggattcttctggctggtccccggcccacaacggtatggacgtctggggccaagggaccncggtcaccgtctcctcagcatccccgaccagccccaaggtcttcccgctgagcgcagcaccccccagatgggaacgtggtcatcgcctgcctggtccagggcttcttcccccaggagccactcagtgtgacctggagcgaaagcggacagggcgtgaccgccagaaacttcccacccagcccggcaggagcccagccagggcaccaccaccttcgctgtgaccagcatactgcgcgtggcagccgaggactggaagaagggggacaccttctcctgcatggtgggccacgaggccctgccgctggccttcacacagaagaccatcgaccgcttggcgggtaaacccacccatgtcaatgtgtctgttgtcatggcggaggtggacggcacctgctactgagccgcccgcctgtccccacccctgaataaactccatgctcccccaaaaaaaaaaaaaaaaaaataaaaaaaatctcggagggcgatcatattgtcgggggcgcgggagaaaaggggggtatgtagaatgggggacactgggggcaatagggcgtggtttccttggacccaagttttttttgtaacaaggtgggggtaagattcgtggcgggagtcctcccaatatatgggaggccggatataaaatatcggataaggccagtgttaccctgggtttattgg

SEQ ID NO: 514742 - DNA, 566 bp, Homo sapiens
  misc_feature (429)..(429): n is a, c, g, or t
  misc_feature (441)..(441): n is a, c, g, or t
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccccnacctcccccatnttgtcaccctcgactgaggcttgaccggcccgccctttgtggatctgttttttaggttcaaaagcgaactctaatgtgcacaacttgatcgttttttgtgataaagccctttgggggtccatcca

SEQ ID NO: 514743 - DNA, 177 bp, Homo sapiens
ctagaggatcccttggatcgtgatactcaaatatgttcccaatttccttgctttgtctccctctctttcagggatggcaatgaatcacatattttgtctctttacataatcccatatttctcagaggtttggtttattcgctttttattcttttttttcttttttctggactggagc

SEQ ID NO: 514744 - DNA, 547 bp, Homo sapiens
  misc_feature (185)..(185): n is a, c, g, or t
cccccttttttttacccaagtggtccccccccaatgtgtccttccccctttagggagaggtttttccccccattttttttcccccccccagaggtttttcccccaaaataaggggggccccgggtttgttttttttttttccctttcacaaagagaccccccccccccccttttcttcttagaanaccccccaaaaaagaaagggccccgggggttttttttcaccagcgcccccccccccctttttaaggggtttttccccccaaaagggggaacccccttggggggggtgggcccccctttgggtttttttccccccccggcccgggggcccaaaggggaatatttttttcccccttttatttttttttaacgttttttttgcgccccccttttttgaaaaccccccccccccttttttttttggtttttgggaaaaatttttttttttggggaaattttttggggggggggggtggttggggggtttttttttttttttttttcccttttggccccccccccaaatttacccccccttttttta

SEQ ID NO: 514745 - DNA, 193 bp, Homo sapiens
tggggacccaaacttttggccccagggttggcccccccagccccaccccctatatctccgtgtgctcctgggtgttacttccctttcatataaggggacccagccccgggggaagggaggagggggtgggcatgggcccaaaggcttttccagtgggtataaatccatgaaaataaaccccccctgcccccca

SEQ ID NO: 514746 - DNA, 270 bp, Homo sapiens
ccaagcgtacccactgaatgtagttactacatatgagagtcattatatgcatatgcattctacctttcctgctttatgagtagtgtgaaagctatttagttacaaggttatatgcagaaaatatttcccagatataagtgatacatctgtagacctaagaaactattttcgtctatgtagattcctcttcccagtctacccaatatactacagacgaaatgttttctacattggccactatcagggattcgtcatctattggagtgactc

SEQ ID NO: 514747 - DNA, 911 bp, Homo sapiens
gcttctcttctctgccttcccctttaaaagttgtccggggaagaatctggggaccttgaagcatgtatatgaaggattggggacatctgcctttcacagattgagcagttattttcggtgacttctcttcaatattatcataaaagctttgcagctgttgaacactaaaatgagacttctctactacagcagcatagtattatggagaaaataattggattgtttctaggcaatatgtcagatggtgtggcaataactcattcttggaatgagtagagtgaagctgaatggtaactgctttcatccttgtttccttgtacatggaaggatatgattggggaaattttcctgaaggtagaagagtgaccagtctagagataattttacttagctcgtagtgagtggatcatgctctgcgtgtagacattatcacattacattataattatctgtctcctcctctcaagtgataattccttgaggaccatgctgttcattttgtatttccagtgcctagaagaatgcttagcatgtagtaagtattcaatgaatgtttcggaaataaaagactttaatattatactttcactgcattttctttttctaaaagcaacccattagggttggttaagaacacattgtttattctcactggtggtcctcttaaaaaacaaaaaattgcttgggcaatctgttatgttaacagtgggcctttacttggtgaaattctccactctacgaactgtcctctaacctcgggtgtgttgcaagggggacacaggactctacatccgccaacacatggtcgccagtgtgacagagaagctatcaacacggcggaccagtactcaaagaacagcgggtttctcaacagagggattcgcacggcgattattcaaaaggcttcagac

SEQ ID NO: 514748 - DNA, 340 bp, Homo sapiens
  misc_feature (15)..(15): n is a, c, g, or t
  misc_feature (91)..(91): n is a, c, g, or t
  misc_feature (98)..(98): n is a, c, g, or t
  misc_feature (133)..(133): n is a, c, g, or t
  misc_feature (187)..(187): n is a, c, g, or t
  misc_feature (206)..(206): n is a, c, g, or t
  misc_feature (216)..(216): n is a, c, g, or t
  misc_feature (221)..(221): n is a, c, g, or t
  misc_feature (226)..(227): n is a, c, g, or t
  misc_feature (243)..(243): n is a, c, g, or t
  misc_feature (248)..(248): n is a, c, g, or t
  misc_feature (251)..(251): n is a, c, g, or t
  misc_feature (255)..(255): n is a, c, g, or t
  misc_feature (309)..(309): n is a, c, g, or t
gtggtcggcggggancttggggctaggcatcctaattgtaattccatatcttaaagaagcaattctaaatataggaaatgcttcacaaatntggttgntttttgcagagttacctataaaagcaaaaagttanaaacactgtaaaaccaaccataggaaactatgttaattaaggtacattcacttnttagactatcatacagcantaaaatgatntttanaaagnncttataacaatatggnggggnggntttngccatattgttaagtaggaaaataactgaatacaaaatcaaatatgttacatcnccattcaaaggtataataatgacaataaaaa

SEQ ID NO: 514749 - DNA, 884 bp, Homo sapiens
ggctgcctttgatgattagccccaggtctgcggagctgctggccgatgagcccggatgagccttcctgtgtgagtgcagttcggggccgagcccgagctggccgtgatcagctgcctgggccgcgtcaacctcatcggtggaacacacggactacaaccagggcctggatgctgcctatggctctggagctcatgacgtgtgctggtggtgcaagcacccgcaatggatgtggctgagtgtctcgtcactcaccacactctgaggtgtgccagagtgagccccatgctgcgcatgcaagtttatccacatgacccacagacaccagctgctctggctgtgagccattgtgtgaccttcctcctggatggggcacaaagctattgatccacagtgagacagtcgatatcaagtggtaccgttaccaccatgcatgaccacaccaccctacacacattggggacctatacaaggagtggcaaagaggggtgaggatccaaaggcattccaaggatagaccctccaatgaagagtgagggggatgtggccattgggtccccaatgccgtaccaaagcgcaacttcccgttatgcgacaaatgataggtgacccacagagtataccgaacacccttaatccacgatacgcgacgagcaaggggacataccttggattcacaacgaaaaccattacggaggtgacaacgaaaagtaaacggacctagggagccacctgcaggaccacccaaagcgagatggcatggattcgcaggacacaggcgagccctggaagaccaccaagacatattctgacaagtggggaatttggcaccctggagtggacaacataccaattgggaccccaagattataaatacgtcaacaaa

SEQ ID NO: 514750 - DNA, 262 bp, Homo sapiens
  misc_feature (156)..(156): n is a, c, g, or t
cgcagcggcttcctagtttgggggcgccccggtgggtttcagctttaggggttgcaggaacggctttggcattctcttggagcttacgaagcgggaagagccccgccccagttctgccccttcaaagctttcggcggggggtggaggtaggttatnaccttgtccctacccccgcctttccctccgccgcagggattcgggacccgcccccgcggagaggacggggggcttcggggaggggctgttcggggagcgggcggga

SEQ ID NO: 514751 - DNA, 478 bp, Homo sapiens
acaacggataagaaaatgtggcacatatacaccatggactagcataaaaaaggatgagttcatgtcctttgtagggacatggatgaagctggaaactatcattctcagcaaactaacacaggaacagaaaatcaaacactgcatgttctcactcataagtgggagttgaacaatgagaacacatggaaacagggaaggaaacatcacacaccggggcctgtcagggttgggggctaggggagggatagcattaggacaaatacctaattcatgcagggcttaaaacctagatgatgggttgataggtgcagcaaaacaccatggcacacatttacctatgtaataaacctgcacatcctgcacatgtaccccggaacttaaaagaaaatgttgaacaacgggtagagaagagtgatttacatacttcattttccaattagtgcatgtgaaaatcattcatcttggcagtattgtccag

SEQ ID NO: 514752 - DNA, 485 bp, Homo sapiens
acaaaacaagaagggcctttatcagacacacacaagcttcatgatgacctggattgaagagcagacacaggtgcacacggtgctgtgtacctctcagcaccatgtatgatcccaacagcacataaagtgtgtttgaggtgttgacaagaaaaggctggacctggctgtgatgttggattgactgctagttctgggtggtgtaaacgattcaagaatcgttatgtcattagataatgggagagtggtgagttggtgagtgctgatgtaaaggcagcggaagaatttggggaaactctagattagctgagtctggaggaaaatcacttgccagaacgaagattttcaatatggatgaaacctttctattctggaaacagatgcctgacaggacttggatccatgaggtagaccaaagctatgacaggcttcaagtcttttagggactggatgacagtcttgcttgggggcgatgttgccggtcacaa

SEQ ID NO: 514753 - DNA, 630 bp, Homo sapiens
agcggagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgata

SEQ ID NO: 514754 - DNA, 939 bp, Homo sapiens
agcggagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgata

SEQ ID NO: 514755 - DNA, 298 bp, Homo sapiens
  misc_feature (7)..(7): n is a, c, g, or t
  misc_feature (14)..(14): n is a, c, g, or t
acttganaccgtanacttgacgtagaggtgcaggggcagcgtctcgttggcatcgtgggacagctttggggtccgaaaggcgaaggtcccagattcctgcatggtcaccggctccatgaacttgagcaagtcactgcccacgtgcagggaggaaccctgtgtctgcagaagcctctgaacgtcctctgtgggtttcccacggccacctccaccactcatccacaccttcacggtgtccaggttcttgccctggaagttcacatctgtcttacggtttcaagtgtaaggaatccgtgac

SEQ ID NO: 514756 - DNA, 1200 bp, Homo sapiens
  misc_feature (183)..(183): n is a, c, g, or t
gaccctgtattgttgtggaacttcgggtagcgtgtttgttggaatcctggtgatgaactccaggcgatactcgagaacatgatcgtctgtgtgttccacgtatacatctacacaacatatttatatccatttcggtatcacagctaatgtaaccaggtctactggcatgagattgccatttancattgcatgcgtagtatgcgcggattctatacacacattcggcaacaagtatgactagggtctacgtttcacatcgaaatgagtatttcaatgactttatctccatgtggagttacaaagactccgttggtccccggcacatcattaacttagttaccagacatattcaggtggctcatacttgctttagactacttgattccgtttaaacatccaagactaattaggacatcgtgaattatcgcatcactaatactgctcacagtatcgggacagaagctcctcttagaccataggtatcggttggtccctcacttgacattttctgtagcttcagttgctcgctcactaaaaattatcaccaaattgaaccttccctcgaatgagatttgcgagccaatataagtacggccaaaagaacctctagcggtcttcgttctcaaacgcaaaaagcgccacatagttaagtctggggagacagagtttgcggtccttacaatcaagaggttcagatttacagtgtgctaaatattggcgtactaaattctctttggggtcccagtcgtgagtgccctggagggactacttccaagaaaaaacgtctacgcaaaaacgttgttttccgtgagtagcgcaattatacggtactacgaattgctttctataaacatagttattaaccctaagaggcatcgaatcccgaggttggtttttcaacttttcaactctttctagtgaaacgttccacgaatttgtctattccccttttgattgtttccggaaaagttggaggatgtgcaccttccatctcaacttgggatccgtatgagcctcgtggcaagcttggcccttacttttaaaattgggttgcctttggaagtttgaatggccctggggcatgcttctttgcaccttggtgggagccgaaataaagtgagcaagcttcccgtaagtgatttctcccatagggtaatgggaaggattcctcgaggactgtggaatcccggaggtgtcccg

SEQ ID NO: 514757 - DNA, 264 bp, Homo sapiens
acgtgaacagtcccggggtgacatgagaattatactatatgtactagtgtcgactctttgaatctctgatgtggtgtatcatcaccatttatttaggggatcttaatttcatcactagttttctagcttttcacgtaaacaacgtactgacatttgttagactttatacctaaaatgttctttttattgttgatttcattagtgttcattagctaatatatagaacatacattcattaacggccaggtgcagtggctcacacca

SEQ ID NO: 514758 - DNA, 1029 bp, Homo sapiens
agcggagatctttcgtggttctgtcagggagacccttaggcactccggactaagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgata

SEQ ID NO: 514759 - DNA, 1739 bp, Homo sapiens
gaggaggcggaaagttgaaaagtgatggacggttgacagttgctgatttttgactttgcttgtagctggctccccgacactcgccgtactttcgcgtgatcggcgaccggcactggtagatttaacaggaaacttccaagaatggaaacttatgtcgtttgccccagtatagtaagtgtaagcgtgtagattgtgatgtcatatgtcgcaagtaagatcttaacgaggagctgatggtaagaaagcctcaccaagaatgatctttatccgaagatccaaagcctgaagtcattgcacatgatctacatgagagccttacaaatagtatatggaattcgactggaacatttttacatgatgccagtgaactctgaagtcatgtatccacagtttaatggacggcttcttaccattcagcaatttacgtgtactcatctggactcattttgcctatctgcgggtgaatgactttgagactgctgatatgctatgtccaaaagcaaaaaggacaagtccggcttcaagtggcattatcaactttattcacttccggagaaggatggccggaaacctatatggcacttcttgcggcaattaattcctctgtgcgcagcacatggcaccagtttaacagccggcaccaggaggctaatgcactcggcgcaactgataccgtcccctggaagcgcaaggtcaagccttctcacgtctgccggcgaacacacacttcatccgtttctcacaccaacggtggcgaagtacacaagaattcatatcacacagcgcgtcgacactgcctcttcacacacaagccccttaaccataccttctttcttttctctgttttttattttttttgtatctctactctccccgaccaccactaccaccccaccccacctccacctccccccctcctcatcccctccccacaccccctaacctcactccccacccccacaccctcccacccacaccaccacccaccctcaccaaccaccgagcgcggcacacctggacgcccacaacaagcacacacagaccgaccaaccagcaggcaccccgcgaaacgcaggagagcaggaagaccacaccaagagacgcacacacagcaagcagaggcaggcggaagcaagcacggacgaggtagcgacgatgcaagacgagcgcgacaagagcgaacaggagcagcgagacagaccgagtcgcgagccacagcaagacaagagaggcgcgagcgagaaagcacggagacacgcagcccgcatgaaccgagcacacacgacgagtgaaagagagagacacaacaaacgaccgagaccacacagagaggaggaagagacggcaggaacgacgagaacgcagcgaaacgggacgaaggaaagatccagcggacgcgacagcgcgggcgaggacggccgcgcacaaggaaagtggacgcaaaggagcatgacgaacggcaggccagcgtcgacctaggacacggagcgaccgactgacgaagggacgaaagaggaaacacacacgagcgcaaagcaggcggacgcacgaagcgtagggctgcagacatgcgccgcaggcgtgcacggtgggactgaggcagacgcatcgaaaacagacgtcaaggaagaagatcaacggcacgccgaagcagaacagcacacgaacacgaataccgaacggacaaacagcacgacagagcgcgcagccagcagcacaccatagaccagcccacacac

SEQ ID NO: 514760 - DNA, 1513 bp, Homo sapiens
  misc_feature (1029)..(1029): n is a, c, g, or t
agcggagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgatatataaatattgcaaaaaaatcgagcatatcgacctaaccaaccgtcttggtcgttggcagtctgccctgacgtgcgccggaccctccgancacatgcaattagtcgcgtcgcgcccgtcgtgccctccgtccccccccattcggaactccttctgcgagcctcgttctgtagcggtccgcgattaaaataacgccgtcggttcacatgttaatgatgaggacgaccatctcctactaaagctcgtccaatacctcaatacggggctcgctatgtcgcccgcaaacggtctgtggtagcgcgacggtgaactttggtgtccccctctcgacaagatccgcgaactctgtataaagaggatgcggtagcttccacctcgatatggctatgactagcgtgccacacaaaatgaacccatgaacggttggccggaccacacgcccccagatatcaatgagggttcgtcagcgagaacgataatgagcctcctctagcaactccacgccgcgggtaccgagtacgccctgtctcttcgagagtgccgcgctcctacaagcggaccagtagtcgtgtgcg

SEQ ID NO: 514761 - DNA, 1128 bp, Homo sapiens
  misc_feature (465)..(465): n is a, c, g, or t
tgcctttttgtctcaaagtttccatcaaaatcagtttcttttctctgatactttcaatccttgagaacagagaatgtctgcatatttactggcttaaaatttcataccctaacatcattagcatatcgaaatgttttagtgtactcatctttatcaccagatgttgagttgattggtattccctaatttttcttcagataatcaaatgaatgtttctgtcatcaatttcccaaaatatatctccataccaagttacatgttctttctatagttttatgtttttaatgaaccatgtagttaaaatcattctgttttaatactcgtacttgcatggctataaaatttctactcttgatgtttttatatgtaattatttctaggatctgaagaagatgatgaagttgtggcaatgattaaggaattgttagatactagaatacggtacgtgctcctctctctacctgnattcagtgctttggaggcatttttcattatagcaatatagttttagttggccatgagattatagtagattttcaaaataagtgcaagttaatgtaaaccacaacaggtagccgtgacaattgaatttaaagcctgtatcttctctacatttactcaaaattttaaaacatccaatttatttaaacatattcaatgaagaaatgtattcttcacagtctcaatttagatttgatattgttataataccaaatttcttaaaaagaaaaaaaaagacttaatgtttggcaaggttgtgaagagagaatgagtacctattttcagtatattgcccatacagaataaatgttaagtgagtggagaacagcaggcttctacttttgcttgtagcagaccaatagtcatgctgagaactcccagaaaagctggataaagtacaataaaaagaatttgtttgaaagcattagatagctgccagagcaagcaagatgtgatggaaacaagaatgaccatagaataaggaatttgagtgcggtacccttgatagcacaatctcgcagcgacagcagagatgtaagtttatcagcagacgtgcaacccgcggctgggagatgggatccaagatatgttactcgagattgtcttaatgtgaggtcaaaccatcat

SEQ ID NO: 514762 - DNA, 555 bp, Homo sapiens
gtcctgtgtgaattggttctccaccatgtgtccactcgtcatccactacacattaaaaacatccaatttatttaaacatattcaatgaagaaatgtattcttcacagtctcaatttagatttgatattgttataataccaaatttcttaaaaagaaaaaaaaagacttaatgtttggcaaggttgtgaagagagaatgagtacctattttcagtatattgcccatacagaataaatgttaagtgagtggagaacagcaggcttctacttttgcttgtagcagaccaatagtcatgctgagaactcccagaaaagctggataaagtacaataaaaagaatttgtttgaaagcattagatagctgccagagcaagcaagatgtgatggaaacaagaatgaccatagaataaggaatttgagtgcggtacccttgatagcacaatctcgcagcgacagcagagatgtaagtttatcagcagacgtgcaacccgcggctgggagatgggatccaagatatgttactcgagattgtcttaatgtgaggtcaaaccatcat

SEQ ID NO: 514763 - DNA, 114 bp, Homo sapiens
tagctcggtaccctgtgatccccccacctcggcctcccaaagtgctgggattacagtcgtgagccactgcgcccggcctcaaagtccacttttaagcacgcaatattatgaata

SEQ ID NO: 514764 - DNA, 116 bp, Homo sapiens
  misc_feature (31)..(31): n is a, c, g, or t
cagcagccggcctgagaggagcgtggctgtntcctttctccgccatgggtgtgctcgccactgatatcggtgtactccgaaaaggggggaggtcatcttggcaaaaaatgtcactt

SEQ ID NO: 514765 - DNA, 702 bp, Homo sapiens
  misc_feature (26)..(26): n is a, c, g, or t
  misc_feature (84)..(84): n is a, c, g, or t
  misc_feature (86)..(86): n is a, c, g, or t
  misc_feature (100)..(100): n is a, c, g, or t
  misc_feature (102)..(102): n is a, c, g, or t
  misc_feature (113)..(113): n is a, c, g, or t
  misc_feature (130)..(130): n is a, c, g, or t
  misc_feature (135)..(135): n is a, c, g, or t
  misc_feature (143)..(143): n is a, c, g, or t
  misc_feature (153)..(153): n is a, c, g, or t
  misc_feature (168)..(168): n is a, c, g, or t
  misc_feature (172)..(172): n is a, c, g, or t
  misc_feature (194)..(194): n is a, c, g, or t
  misc_feature (208)..(208): n is a, c, g, or t
  misc_feature (210)..(210): n is a, c, g, or t
  misc_feature (229)..(229): n is a, c, g, or t
  misc_feature (255)..(255): n is a, c, g, or t
  misc_feature (257)..(257): n is a, c, g, or t
  misc_feature (277)..(277): n is a, c, g, or t
  misc_feature (348)..(348): n is a, c, g, or t
  misc_feature (381)..(381): n is a, c, g, or t
  misc_feature (404)..(404): n is a, c, g, or t
  misc_feature (412)..(412): n is a, c, g, or t
  misc_feature (422)..(422): n is a, c, g, or t
  misc_feature (445)..(445): n is a, c, g, or t
  misc_feature (447)..(447): n is a, c, g, or t
  misc_feature (449)..(449): n is a, c, g, or t
  misc_feature (560)..(560): n is a, c, g, or t
  misc_feature (576)..(576): n is a, c, g, or t
  misc_feature (602)..(602): n is a, c, g, or t
  misc_feature (624)..(624): n is a, c, g, or t
  misc_feature (685)..(685): n is a, c, g, or t
agacgatgcgtgcgctccggaccganccgggctcctcctctgcgtgctgctgctggcggcgctgtctggaggcggcgctagggntncccgtaaagaatcngnggctccgcggnattacggcctggtatcntcaanatgctcgnagaggtactnagcctccccagattntatntttctgaaggaataggagtagncaccactgctcccnanaaaccacctgcaggcaganccacatccaacatggatgctggactntnactgagccagcagccatgancccaggcaacaccacccctcccaggaccccagaggttactccgttgcggctggagctgcagaagctgccgngattggccaacacaaccttgagtacccctaacnctgatacccaggcttcagcctcnccagatcntaggcctctnattggaagaggaagagacacgantncncaccagaacccacctgcaggtagagctattaccaacatggatgttggacatgtcactgagacagcagccctgaacccagggaatgccacgcctcccaggacacaggatagntactccattgctgctngagctgcagaagctgccagaattggnccacgcaaccttgagtaccccnaaccctgataaccaggtgaccatcaaggtggtggaggacccacaggccgaagtgtaaatcnacctataggctgcgaca

SEQ ID NO: 514766 - DNA, 893 bp, Homo sapiens
agcggagatctttcgtggttctgtcagggagacccttaggcactccggactaagatggcggcgacggccaggcggggctggggagctgcggctgttgccgccgggctgcgcaggcggtaggtgacgagcctggagctccgaataggtgtgccgctgggcttagccagcggagcggtcgccgccttgcagaccctctctcgaggcgggttctgtcatatgttgaagaatccatacaccattaagaaacagcctctgcatcagtttgtacaaagaccacttttcccactacctgcagccttttatcacccaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggccaactgtgcaggaagatggaggggatgtaatctacaaaggctttgaagatggcattgtacagctgaaactccagggttcttgtaccagctgccctagttcaatcattactctgaaaaatggaattcagaacatgctgcagttttatattccggaggtagaaggcgtagaacaggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgata

SEQ ID NO: 514767 - DNA, 129 bp, Homo sapiens
  misc_feature (19)..(19): n is a, c, g, or t
agcacatttcactacgggntatgtgcattctgggcttagtaatgtcaaatcactcttctctccagcttggccattcctcattccttgcgggcctgccctgtagaccacaggctaatggaatgtcccggt

SEQ ID NO: 514768 - DNA, 1286 bp, Homo sapiens
  misc_feature (623)..(623): n is a, c, g, or t
agcggagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggtacgtgctcctctctctacctgnattcagtgctttggaggcatttttcattatagcaatatagttttagttggccatgagattatagtagattttcaaaataagtgcaagttaatgtaaaccacaacaggtagccgtgacaattgaatttaaagcctgtatcttctctacatttactcaaaattttaaaacatccaatttatttaaacatattcaatgaagaaatgtattcttcacagtctcaatttagatttgatattgttataataccaaatttcttaaaaagaaaaaaaaagacttaatgtttggcaaggttgtgaagagagaatgagtacctattttcagtatattgcccatacagaataaatgttaagtgagtggagaacagcaggcttctacttttgcttgtagcagaccaatagtcatgctgagaactcccagaaaagctggataaagtacaataaaaagaatttgtttgaaagcattagatagctgccagagcaagcaagatgtgatggaaacaagaatgaccatagaataaggaatttgagtgcggtacccttgatagcacaatctcgcagcgacagcagagatgtaagtttatcagcagacgtgcaacccgcggctgggagatgggatccaagatatgttactcgagattgtcttaatgtgaggtcaaaccatcat

SEQ ID NO: 514769 - DNA, 164 bp, Homo sapiens
tggggatcacgacatttcttaaggagagtgagtgaagttcggattgcatttggtgtaactgacggatattccaattccaactgaagctagcaatgaagggcagacagtattcctgaacatgtgggaaatatcaagcttgaacctgttgtacaagcgtgcattgg

SEQ ID NO: 514770 - DNA, 766 bp, Homo sapiens
agcggagatctttcgtggttctgtcagggagacccttaggcactccggactaagatggcggcgacggccaggcggggctggggagctgcggctgttgccgccgggctgcgcaggcggttctgtcatatgttgaagaatccatacaccattaagaaacagcctctgcatcagtttgtacaaagaccacttttcccactacctgcagccttttatcacccagtgagatacatgtttattcaaacacaagataccccaaatccaaacagcttaaagtttataccaggaaaaccagttcttgagacaaggaccatggattttcccaccccagctgcagcatttcgctcccctctggctaggcagttatttaggattgaaggagtaaaaagtgtcttctttggaccagatttcatcactgtcacaaaggaaaatgaagaattagactggaatttactgaaaccagatatttatgcaacaatcatggacttctttgcatctggcttacccctggttactgaggaaacaccttcaggagaagcaggatctgaagaagatgatgaagttgtggcaatgattaaggaattgttagatactagaatacggggttatggatgatgaatcagatgaaaaagaagcaaactcaccttaaaataatctggattttctttgggcataacagtcagacttgttgataatatatatcaagtttttattattaatatgctgaggaacttgaagattaataaaatatgctcttcagagaatgata

SEQ ID NO: 514771 - DNA, 473 bp, Homo sapiens
acgtcttcatcatactacccttttcatgcatcatggttgtaacatttttctttgtactcagaatgccctaactggcaaaaattcccaggcttcaaaaaggcccttaaaaaataatggttccgggctctgttctgcctctttattgcacctgttgtaccatgatgacatatttcccgtctgcctcacctgtctgcattccttagggaaacttgtctgccttcgaaatcgtcagcggagcttttgaaagggcagatcgggtctccgacccaggagatcgattcagcaggtctgcggggactgaggcatggcagggaaactgcccaccatctcaagggtgaggctaggagttggctagtgtgtatgtattccatccagaaatatttagctaatgttcaccaaacaaaataaaaacacacaagaaagcatgaagcgtaatacccacggggtaagccagtcaggtaggtatgatgaag

SEQ ID NO: 514772 - DNA, 489 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaactccacctacctcctcaggggatactctagaataactatcagcatcacggtgcactgc

SEQ ID NO: 514773 - DNA, 705 bp, Homo sapiens
  misc_feature (359)..(359): n is a, c, g, or t
gaggtattcccgagatgtgctgggtgcgtgggtggttggccccagagcgctgcgctggtgttgtgccagggtccagtgttgtcgtcgcggccagacgcgtgagtggaagttgtaaatggaccaaggttggctttggtgctgccgaaggacctgtagcgccagtgcctgactggaaaggtgaatgcatgaagcgtgagttgatggccgtggaggacaccacagctttgtggtagctacgacgtgggatcgctgcaccgtcaacggtgagtgaagcaggcgtgtgttggtttcttctgcactgcctggggacacaggattacgtttatacgaccagcctgtgtggttttgctgtgcaagtngcatcagttggagttatcgagccggatggccatgagctgtggtctctctcgcctcgaccctctgctttgattcttctcggtcacaacaatcatatattatacggacgacatggagcccatgatgatggccattattggaatcccctctatctcgacgtctgaaccccttaagaccgtcacaaagtaagacaaaagaatatacataaaacaaataaaaataataaataaataatataagaaaaacaaaaatgaatcataaattaaaacacatataataaaaaacaaacacaatcagaatgaattaatgcatgaaataaaaaatcaaaaaaacaacccatcatgtaca

SEQ ID NO: 514774 - DNA, 556 bp, Homo sapiens
  misc_feature (439)..(439): n is a, c, g, or t
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcactgtagatntccttcccctcaacttcaagtcagcccaaatactacttcctattcccctagtcctcactgactttcaaggttctgatctcgtacctccatttgagagtactgttttatttttcagta

SEQ ID NO: 514775 - DNA, 1241 bp, Homo sapiens
cgtgacgcgtgggtcgacccacgcgtctgggaagctggagctgtatgcggggtccgcgtgtggaagtcttgtgcggtggagccatggtctggccaactgagcgagggggccattgcggccatcatgcagaagtggggatacaaacataaagcccatcctccaagctcatcaacatcctgtcccattactacggggaatagtccgtcgcgttatcgactgctcatgcagtgatggattgaacactctatcctctttcatgcttggcgacacagctcgcaaccctcctcgctggagcgaagaacaactccgtccagcaacctgctgtactgccacgacttcacagactcactcgctcgaacactcctgcaaccaccggaccgcgcaccacctacccactccttcgatgcgcactcccacagtcccccgcccctcacccctcgcccccaccccgccagctgaaccactcgcgcaactccacctgcccctactacccgcaccccgaccctccgcggccgccccgcccacgctaggccccctcccacccgcccatccagcccacgccccccaacccgcccagccagccaggcccccagcccggccacaccccggcacacgcatcgcgcgaactcgagggtccgtacctggccccctaaacgggccccactcgcgcgcctccccacaccaaccaccccggcacaaccgcctgcccccggcacccccagccccggctcaaccaccacatacactgccggcgcacccccacggcccaacacgctggccgcccccacaccagcccacgcccctcaccccccctcaaccccagtccccaccgacggcaccccacccacggccgccccccacgccacacccacacacaacaacggcacgcctccccgcacccccgcgcaggcacacctccccccaagcggcgcacacgcgaccacccacacgccccccagcaccgcggcaccccccagcccgacgagagcccccccacccaacccctccactctcaccacacctccccacctctcctcctccccctccacctcaccacctctctacccccccacccccccccccctcccacacccacctcccccccccacataccaccgccccccctccaccccacctccaacacctatcacacccccccaccccccccaccacccccccccatccccacaccccccacctccccccctcccacccacacaccccccacccctctacccaag

SEQ ID NO: 514776 - DNA, 471 bp, Homo sapiens
  misc_feature (432)..(432): n is a, c, g, or t
  misc_feature (439)..(439): n is a, c, g, or t
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtgactgtgccctgcccagttccctcaantccactnaccccactcctcgccagtccgtctctgctgag

SEQ ID NO: 514777 - DNA, 314 bp, Homo sapiens
ccggaatatgggacgtctggatctttataaagagcaaaaggcagacgcagtactctctcgagcttcatatttgtctacctggttaccatgaacctaaccataggacttgtgtcttatttgttaaatcttatacttaaaaaacaatagtagtttagattcatttccctttgtttttgacaggtgtcttattagctctcccagcatatcactttaaaatgcttcggcaaagaaagcatcacacacattgcattaggtttaatccacacccttggggcagtgagctaactttttaaagtatcctaattggaaataca

SEQ ID NO: 514778 - DNA, 237 bp, Homo sapiens
ccaaaatcgaattaagttgagatttaaaaaataactttaaaaaatttggctgggtatggtggctcatgcctatgatcccagcactttgggagaccgaggtgggaggatctcttgagcctaggagttcagtaccagccctggcagcatagtgagaccctgtctctacaaaaaaattaaaaaattagctgggggtggcagcacacacctgtagtcccagctacttggttggttgaggtg

SEQ ID NO: 514779 - DNA, 712 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtactgtgccctgccgagttccccacctcccccatgctgccacccccgactgtcgctgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtccagcctagacagtgcaccatgccacggaacaatggggagaccgttttcccgcactgcaagcgcaacacaccgga

SEQ ID NO: 514780 - DNA, 188 bp, Homo sapiens
gtctatagacgcagttctggggacctttccaccattggcacctacgaaagcaaatgatagataagccgggggcgccaactccaacgtgctcttcagtagttcgaacagacccaaatacaggaagttaaggatgacttcactatcatggaccagagcagggattgacttcattgacaagatcatctgag

SEQ ID NO: 514781 - DNA, 268 bp, Homo sapiens
  misc_feature (151)..(151): n is a, c, g, or t
ctgttcccccccctcccttttttccaccccacagttcctcctggaatctccccctccacttaattggagcctccatcccctagtagatccatcatgccacagctcctgctaactggtatgaacagtcacgctcacagctggtttcgcctgngccacccgagcgacgaggctgacactggaaaatgggtttttgcactgtttttttttggtttgtttttttgttcttttttgtttttttcctttaaaataaaaacaaagaaaagctctg

SEQ ID NO: 514782 - DNA, 686 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtccacctcccccatgctgccacccccgactgtcgctgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgagcgtgacctctgtggctgctacagcgtgtccagtgtcctgcctggcgtggcccagccagggaaacagtggcgaaaccacagccaaagggaaacatggcgaaagcg

SEQ ID NO: 514783 - DNA, 181 bp, Homo sapiens
tttttttcttgtctctcccgcagcgcgcgcctctcgcggcgctatctctcgctctctctcgctctctcgagctctcgagatatagccgagacacgagagctcgctctctcccgcgcgaagatctcacccccgcgcgctcgcgcgatatatatctcctcgcgcgcgcgccgagcgcgcccct

SEQ ID NO: 514784 - DNA, 891 bp, Homo sapiens
  misc_feature (6)..(6): n is a, c, g, or t
  misc_feature (53)..(53): n is a, c, g, or t
  misc_feature (55)..(55): n is a, c, g, or t
  misc_feature (67)..(67): n is a, c, g, or t
  misc_feature (73)..(73): n is a, c, g, or t
  misc_feature (97)..(97): n is a, c, g, or t
  misc_feature (102)..(102): n is a, c, g, or t
  misc_feature (116)..(116): n is a, c, g, or t
  misc_feature (229)..(229): n is a, c, g, or t
  misc_feature (231)..(231): n is a, c, g, or t
  misc_feature (248)..(248): n is a, c, g, or t
  misc_feature (250)..(250): n is a, c, g, or t
  misc_feature (252)..(252): n is a, c, g, or t
  misc_feature (254)..(254): n is a, c, g, or t
  misc_feature (276)..(276): n is a, c, g, or t
  misc_feature (278)..(278): n is a, c, g, or t
  misc_feature (280)..(280): n is a, c, g, or t
  misc_feature (299)..(299): n is a, c, g, or t
  misc_feature (325)..(325): n is a, c, g, or t
  misc_feature (337)..(337): n is a, c, g, or t
  misc_feature (386)..(386): n is a, c, g, or t
  misc_feature (397)..(397): n is a, c, g, or t
  misc_feature (400)..(400): n is a, c, g, or t
  misc_feature (414)..(414): n is a, c, g, or t
  misc_feature (431)..(431): n is a, c, g, or t
  misc_feature (458)..(458): n is a, c, g, or t
  misc_feature (462)..(462): n is a, c, g, or t
  misc_feature (503)..(503): n is a, c, g, or t
  misc_feature (518)..(518): n is a, c, g, or t
  misc_feature (520)..(520): n is a, c, g, or t
  misc_feature (655)..(655): n is a, c, g, or t
  misc_feature (657)..(658): n is a, c, g, or t
  misc_feature (707)..(707): n is a, c, g, or t
  misc_feature (723)..(723): n is a, c, g, or t
  misc_feature (735)..(735): n is a, c, g, or t
  misc_feature (751)..(751): n is a, c, g, or t
  misc_feature (810)..(810): n is a, c, g, or t
  misc_feature (813)..(813): n is a, c, g, or t
  misc_feature (818)..(818): n is a, c, g, or t
  misc_feature (888)..(888): n is a, c, g, or t
tccctncccaccatccctcttcagcatgctcggacgggaccctgaagctcaananagcagcctccanggaagnagatgtaaaaattgtaataaaaanagaantccaggaagaggangtggtggccacacccgtacatcctactgacctagaggctcacgggaccctgtttggaccaggccaagccacacggttcttccctagtcctgcccaggaaggagcctgggaaancnagggcagctccttcccnancnangaccctgtgctggggctgcganancncgcccggcctgaaaggganatgggtgagctcagtcctgctgtggnccaggaggaganccctcctggggactggctcttcggaggggtccggtggggctggaatttncggtgtaaacngcnagtgggcctgaacncgaggacggggcccgangggcttccttactcctccccggacaangganaggccatcttggaccccagccaggccccaaggccattcaangaaccctgtaaatanantggccggaccaaaggctttggccacaagacagggctgaagaagcaccccgcggcgccccccgggggccggcccttcacctgcgccacgtgtgggaagagcttccagctgcaagtcagcctgagcgcgcaccagcnanntgaggcgcgcccgacgggtcgggcccgggcacaggcgggtggcggcacnggcagtggcggcggcnggtggcggcacngctggggggcagcgcncgggcatggcagcgccctttcggtgtgggggagtgcggccgttgcttcacgcgccccgncancctcntccgccatcgcatgctgcacaccggcgagcggcccttcccctgcaccgagtgtgagaagcgcttcaccgnacg

SEQ ID NO: 514785 - DNA, 574 bp, Homo sapiens
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgaagcactacacgaatcccagccaggatgtacggtgaacgccctcagttccctcaactccacctaccccatctccctcaactccacctaccccatctccctcattgcgaaaacatcttcccaggattatgggaagtgcccaagatgtggttacgggtgtacaacagacagttggcttctgtgtagccactgcgccttaa

SEQ ID NO: 514786 - DNA, 438 bp, Homo sapiens
  misc_feature (383)..(383): n is a, c, g, or t
tggtgctgtgagacttgagaacggctgtctattcatgtgtgaaagactttagaggcggtatagtggaaggtccctttgatcactggggccagggaccctggtcaccgtctcctcagcatccccgaccagccccaaggtcttcccgctgagcctctgcagcacccagccagatgggaacgtggtcatcgcctgcctggtccagggcttcttcccccaggagccactcagtgtgacctggagcgaaagcggacagggcgtgaccgccagaaacttcccacccagccaggatgcctccggggacctgtacaccacgagcagccagctgaccctgccggccacacagtgcctagccggcaagtccgtgacatgccacgtgagagcancacacgtatcgctgacagtattgtgcctgtgtctaagcccaggcctacgaaatcg

SEQ ID NO: 514787 - DNA, 346 bp, Homo sapiens
cgaaggaagggacaactactagtggctggtacggtagttttgactactggggccagggaacctggtcactggtcaccgtctcctcagcatccccgaccagccccaaggtcttcccgctgagcctctgcagcacccagccagatgggaacgtggtcatcgcctgcctggtccagggcttcttcccccaggagccactcagtgtgaagaccttggggctggtcggggatgctgaaggagactcgtgaccagggttacctggccgccaggggtcgaggtagtaatgggggaaaagttgtttgtagacaaaggcgccaagggtgtacacgtaatacggaggctatatctg

SEQ ID NO: 514788 - DNA, 334 bp, Homo sapiens
ccccacttgatgcccctggatgcagttgggtggtagcagctaagagaatcactgtcttggtcccaaacaagatatattgtgagtttctaattttattcccttcttgagcctattattcagaaaaatgagaaccaaataggcttcatggcttttacttcgacttctttaccttcttttgacatggctggtcatgggacttcacacccgcaagactgtttctccccctctttctttctcatcgccatttgagatttaagtgatgatttgtattttcacttttgtctggggacagtcctagttttttgctcgttgtcccgcatccgagtgctcgatg

SEQ ID NO: 514789 - DNA, 309 bp, Homo sapiens
  misc_feature (81)..(81): n is a, c, g, or t
cgagagatcgagtcggcgagagggattcttctggctggtccccggcccacaacggtatggacgtctggggccaagggaccncggtcaccgtctcctcagcatccccgaccagccccaaggtcttcccgctgagcgcagcaccccccagatgggaacgtggtcatcgcctgcctggtccagggcttcttcccccaggagccactcagtgtgacctggagcgaaagcggacagggcgtgaccgccagaaacttcccacccagccagatgcctacacggggacccatgtacgagaaggggatacctcaagga

SEQ ID NO: 514790 - DNA, 168 bp, Homo sapiens
gaattacggacaagaggtaagtatctacgccatgtaaggacctccgggcacgtttacggagagtacaaggtgagttggttcgtctgcctgcccacccccaaatgccacacgccgcccctctaccgcatgcgaatctttgcgtctaataatgtcgtcggcaagtcccgc

SEQ ID NO: 514791 - DNA, 125 bp, Homo sapiens
catatcatgcatggggtggactctccttcacagtgtgcggcgacttccatggacaatttctatgacctccaagagctgttcagcagtaggtggcgacgtccctccgaccaactacctcttgcatg

SEQ ID NO: 514792 - DNA, 891 bp, Homo sapiens
ccgaggacagggggtcctctccgctgtcgcgtctgtctctgtgattcggtgtgttgtgttcgttttgagctggcgtgtctttcggtcgtgctgacgctttgtgagtggtttgttaggtccttctgtctggtgtgttgccgcgcttgtgttcgctcgctatgtttgttgtctctgtctctcgttgtccgctattggtggtgcggcgcggcgcgccatttttccgcggatcccccgcttctggggggacgccgttcgccccctctccgggggtttccccccccccggtgtttgtttacgcccccccctatgggctgtttttcccctcccgtggacccggggcgccgtatctcttggttgctgcagaccgccgcgataactttcttgtggcccgccaccctttaccgaaggttccctttgtccggtcccgcgacaatttccccgggttgttgcgccctttctgccgccggcccctgtcgccgtgggtgtcaatctgtgtcccccgcgcccctttgggagtagtatcaagcccggggtcttgctccccccggagcgcccccccttttgggcaggcctccccggagggactcccctctgggaacggggcgagatgtacgcttatcacaaaagggggggaccccccgcagcgcacagccgaccccggtcggggtgccccgacgcctggcctggccgagcaaatttctttcagaaggtccatttccaaccagcctgttcagaagcctcttttgggaccccgccgatcatttcattggccccccccctgaatcatacagggtttttcagagactcgcgttgcttccccccccccaaggacccgtttttaatccccccccttgggccccaaggaaaaaaacctttaacccccacaaaaca

SEQ ID NO: 514793 - DNA, 131 bp, Homo sapiens
aaaaggtttctttttttttccttttttgtctaagaaggtgccggttattttttttggcctggttgatggatgtgtgaaacaatgttgtccaaccataaacaggaattttattttgctgagttgttctaaca

SEQ ID NO: 514794 - DNA, 179 bp, Homo sapiens
tcagttagtcggggcagtgctcaccacaacccttggagcccccaagcatcccacgactgctccccagtacacccaactcactcttcttatgctgggcctgctgcaccgatgccctcaaggctgacctgatgctgccggtggagtgtgagccaaggtgccagtaccaaggttgagggtac

SEQ ID NO: 514795 - DNA, 261 bp, Homo sapiens
catgagttggcttggggtgatagggtatcaaggtatcgatagaatgagctcttcctgaatgtgctggaaagatgtgaacctgatcatgtccccacaagggttcgtgctgattgtccatatgtcggtgtgggtggtgaatagtatataggtgagtgttatgcctgaatgcaggtaggggatgaatgacgtgattgtcagagaacagcatgggcgaaggcacagctgatgaaacaagcaagagcgggaagcaatcaattgcca

SEQ ID NO: 514796 - DNA, 272 bp, Homo sapiens
ctcaagatgatcccgggttgttaagagagaaggagaggaatagcaacttggaaaatatatttgaggatatagtccatgaaaatttccctaatctcactacaaaaattgatatgcaaatccaggaaatacagagaaccctggttagatactatatgagacgaccatccccaaggcatgtactcatcagattcaccaaggtcaatgtaaaagaaaaaatcttaaaggcagctagagagaatggtcaagtcatatacagagagaacccaatcagg

SEQ ID NO: 514797 - DNA, 618 bp, Homo sapiens
  misc_feature (183)..(183): n is a, c, g, or t
  misc_feature (200)..(200): n is a, c, g, or t
  misc_feature (240)..(240): n is a, c, g, or t
  misc_feature (305)..(305): n is a, c, g, or t
  misc_feature (316)..(316): n is a, c, g, or t
  misc_feature (335)..(335): n is a, c, g, or t
  misc_feature (363)..(364): n is a, c, g, or t
  misc_feature (544)..(544): n is a, c, g, or t
  misc_feature (612)..(612): n is a, c, g, or t
agttcgacggagactctccgaagtaaccaggaagaagttgaatggctaaatagaccaataacaggctctgaaattgaggcagtaaataatagcttaccaaccaaaagaagtccaggaccagatggattcacagcgcggattctaccagagtgtacaaggcaggagctggtaccattccttctngaaactattccgatcangtagaaaaagggggaatcctccctaatctcattttatganggccagcaccatcctgtataccaagagcctggcatgagacagaaatcaaaagaagagaagtttcnagaccaagtanttccctgatgaactgtcgnatgcaaagaatccaagaataaaagtccnntggcaaagccaaatccagggcagcacatcaagaagagcttatccacgcacaagtgaagggttggcttcatccctgggatgcaaggctggtttaacatacgcaaatcaataaaagtaatccagcatataaacaggaccaaagataaaaaccacatgattatctcaatagatgcagaaaagngccttgacaaaattcaacagcgcttcatgctaaaaactctcaatatattagatattgagagtctccgncgaact

SEQ ID NO: 514798 - DNA, 133 bp, Homo sapiens
tatgtggtcgttgagggcatgccagccccagcgtcaaaagtggaggagtgggtatcgctgttgaagtcagaggagaccacctaggtgctcagtgtagcccagagatgccctattagaggggccctccgtacgc

SEQ ID NO: 514799 - DNA, 514 bp, Homo sapiens
  misc_feature (144)..(144): n is a, c, g, or t
  misc_feature (170)..(173): n is a, c, g, or t
gcagccacactcaaatttttaaagcatgagagaagatttaggattttatggcataatactttcttccgacatgggaaagattgttggtatgtgcacctcactttataaaccccgacatttaggtcaaaagaaacttgcccttgnggaaagagaatctgtacaagtccggnnnnaatttgcggggatggggaagggtttgggacactcactttggacatctaggttaatcagagttactgcataatggctccccttctattttgcttccctttatgtatgggtttgtttagacaaggagcagcatgactcttgtatgttgccatagcacatcaaataggaaaaaaaaatagcttgaagaagttggtgaggaaggagctatttaagtcagaactctcagagtgacaaactcaactaaaattaaatttcacaaaagtcaatttattagctttcataaacgataattgtaatctcctagggtgacagtggcctccggcatagctggatccagaagctc

SEQ ID NO: 514800 - DNA, 439 bp, Homo sapiens
acaaagagaaagacacaagaccatcacacagcaagtctccccaggacacacagaaagactctgcagcagtgaggtaggaaccctgccctagagggacaatcaacgtcacatgactatgccatctcctaatagagcaaaaagtggtcagtggctgtaaaaacctctacatctgacacagtgggacatggcggaagcattactactttttaaattattattatactttaagttctggggtacatgtgcagaacgtgcaggtttgtaacacaggtatacacgtgccacggtggtttgctagcacccaccaacccgtacatctacattaggtatctctcctaatagctctccctcccctaacaggcccatcaacaggcccggatgtgtggtgttctcctccctgtgtccatgtcttctcattgttcaactcccacttacgagt

SEQ ID NO: 514801 - DNA, 750 bp, Homo sapiens
  misc_feature (2)..(2): n is a, c, g, or t
  misc_feature (100)..(101): n is a, c, g, or t
  misc_feature (239)..(239): n is a, c, g, or t
  misc_feature (242)..(242): n is a, c, g, or t
  misc_feature (250)..(250): n is a, c, g, or t
  misc_feature (254)..(254): n is a, c, g, or t
  misc_feature (271)..(272): n is a, c, g, or t
  misc_feature (334)..(334): n is a, c, g, or t
  misc_feature (440)..(440): n is a, c, g, or t
  misc_feature (444)..(444): n is a, c, g, or t
  misc_feature (458)..(458): n is a, c, g, or t
  misc_feature (465)..(465): n is a, c, g, or t
  misc_feature (509)..(509): n is a, c, g, or t
  misc_feature (524)..(525): n is a, c, g, or t
  misc_feature (530)..(530): n is a, c, g, or t
  misc_feature (547)..(547): n is a, c, g, or t
  misc_feature (556)..(556): n is a, c, g, or t
  misc_feature (740)..(740): n is a, c, g, or t
gncatatcggtgcgggggtggctttgggggatgggggactcaggttcttcactggaacctggggtcatgtatcatgtaccaggtggggagaagtgtagcnnatctcagtgccaatttgaggggaagcccgtcattccaggagaagagctgggggggaagggctgttggctttcataatgcggtcttaattatcccgtccccctcctgccacatggcggaggccgggtggcggtggtggnggngggggggncccnaccccccgtctctggcnngcccccccgggaaaggggggctccgaaggcgtacgggtccgggtatcctcgagtttcttggncacttcgggtggggttcggtcccgttcttcaggggcgttcttttgtttgttgggttccctggaattgaactgctcccagaggtctccatccatcacattcttcccngggnagtagtaggggcgncagctgnggtggtcccgccccccgtgtgggggttgttcagaccgccgtgcntttccccctgctggnngaggncatgggcctcgtggggngtgggtggnacaaggatgccaattcctccagacaaggtggtatagacaagtgattctgagcctccagggatcagcgtggtcttctgcaaggacagcaccgtctccccgacatggtagttcatgatcacctctgccttctgggaggccccattgagcaagccacggtcccacagggctttgtttcctgtaggancctcatctac

SEQ ID NO: 514802 - DNA, 181 bp, Homo sapiens
actgatgtgttagcttccaggtctcccagtccaggtactttctgatcgtcctgtcgcttctcatagcccccagaagtccgtcagcgcctctctgcttacaaacgctccgggttttgtgatggctggcatacgcactgggtgaccattctccccttgacctcctgccgcagcactcccacca

SEQ ID NO: 514803 - DNA, 420 bp, Homo sapiens
  misc_feature (23)..(23): n is a, c, g, or t
atttggtcgcgtctgcggtcatntacaagttatagtgagcagaagtggtagagtgatgaatcatcatagaggacgtgctgagtgatgatgctccttccagcctcagctatgcttccaccttgcaggccaaccgagaagattccatgaatatcctggaccctgaggatgaggaggagcacactcaggaagaggacagcagtggccgttacgaggatgaggatgatagtcaggatgaagaggagtgaggaggaggaagatgaggaagatcatcaggaggatgatcaacgtgcaagcacgggagatgaagcactatgactactattgctctgagatggaatcggatgaggattatcctgatatgaacgcttctcccttggtccgatttgagcgctttgaccgggaggatgatctcatcattga

SEQ ID NO: 514804 - DNA, 422 bp, Homo sapiens
gccggtaccggcagcttgatctagagtgtactgctgcagagccctctccagaccatggatggacacagtcagaccatttaggatatagcctgcattaagggccttctgcttctgctccaggacatttaggtagaaggtggctcggtcccttacttcattgtcatcatgctcagctgattttttgtatttttagtagaaacggggtttcactatgttggttgggctgtacttagactcctggcctcgggtaaggtacatgcctcggcctcccaaagtgctgggactacaggcgtgagtcaccatgcccaacttatttatttttttctttttaatgagacagggcctcactatgttgcctagtctggtcttgaactcctgggctccaacagtcctcccacctgcctcctgagtagttgagatta

SEQ ID NO: 514805 - DNA, 359 bp, Homo sapiens
agcggacattagctagagcataatttattactaagaccccaaaagcaagtacaacaaaaataaaaataaataaatgtgatctgattaaatgaaaatgcttctgcacaggaaaagaaataatcatcaaagtatacagacaacccacagaaagggagaaaatatttgcgaactatacatctggcaaaggactaatatttagaatctacaaggaactcgaacaaattagcaaggaaaaaatcccatcaaaaagtgggcaaatcatatgaataaatatttctcaaaataagacatacaaatggccgaaaaacatataaaaaaatcaacatcactaattatcagggaaatgcaaatgtccgcgg

SEQ ID NO: 514806 - DNA, 222 bp, Homo sapiens
  misc_feature (1)..(1): n is a, c, g, or t
  misc_feature (78)..(79): n is a, c, g, or t
nggggggcccccgggggggggttaaagcccccccccccccccccttgggggggggccggggccaaaaaggggttaatnngccggggttcccccaaggggaccctttttttccccccccaatttaagggggcttaaaaaaaaaaaggggcctttaattttaaggggggccctttttggggaaaggggtttttttacttttttttaaaaaaattttccccccca

SEQ ID NO: 514807 - DNA, 394 bp, Homo sapiens
tggtgactctagaggacccccagacctaaccccacgagcctcgctttgcagcctacaccacagctcacggcaacgccggatccttaacccactgagcaaggccaggtatcgaacccacaacctcatcgttcctagtcggatttgtttccactgtggcacgacaggaacttctccgtgatctcttttctaaaaattgtattggagtagagttgacttataatgtcgtttaagttttaggtgtacaacaaagtgaatcagctatacatataaatatatccattattttccccgtgtaagtaattacaaactattaagtagattttcctatgctatccagtaggttcttattaatggtctgttttacacaggagtgtgtatgggggggttaggtctg

SEQ ID NO: 514808 - DNA, 595 bp, Homo sapiens
gctgctcctagaccccatttagttctatgagatcagcttctttactggttccacgagtcatgtctacacagcgtgttgctaacacatctacactagacaatgggtccacgtcctgctagctgcaagccgctgcagcttactctcttgctgtccgctcctgttccactagtatattatatgtctgcaggtagttcgcaatctctcatgctacatcttaatgcacagccacaagttacaatgcaacagcctgctgttcatgtacaaggtcaggatcctttgactgcgtccatgttggcatctgcccctcctcatagagcataagcaaatgttgggtgaatcggctgtttcctctgtattcaagccatgcaccctactcttgctggtaaaatcatctggcatgttgttggagattgataattcagaacttcgtcatatgctcgagtctccagagtcactccgttctaaggttgatgaagctgtagtctgtactacaagcccaccaagctaaagaggctgcccagaagcaggttaacagtgccactcggtgttccatactgtttataatattgactcagggaccatggcacgatacccc

SEQ ID NO: 514809 - DNA, 121 bp, Homo sapiens
caaatcgctgggtgactgccaccgtgtggccagtcactgggaagggagccccagagagccggctgtctgacatgatggctcagtgatggtcatccaggttgaaaactgacctgtgtgatgt

SEQ ID NO: 514810 - DNA, 768 bp, Homo sapiens
aacacctggaatttggttactccactgacatgtgatcgaccacattcatgctgtaatggaaaccacttacaccgttctacaacaatgaagacatccaaatctggcgtgaatgaaatataattggctgatcagtggaataatggagaataaacctaatgtattcataacagatgtatgtgaaagtgtacaatgagaatgttacttagggaatgacgtatgaactttgaaaaggaagactgtaagcatacaatgtttgtacgatttgtgggggaaacactattgaattttgtgcaaatggcaaagatcatcagcactgatataatgatacatgactgacactttgttacactaggtaataaaaagtgattcatacagtctaatgattatcaccgctgtaagggttgttataaaactgcatttatgaacaagatctatgacgcagatattctccgtgggtgctcctcgaaaggaactactattaaggttcgattgaaatgtttgtcaatcgattcgtccttgccctattgatcctgtctaatcgatgctgtttgactatctacacctaatattcagagggtaactgggcaaggtatgagggaaggaaaatacatatgaggataattgttatagaatgacacaaatttgagtttagtgaagccctgaacagcatggtcttaaggacgtgtatctggaacttggagaaaagcggagttgagagacagttctatagattaaatcctggttaggacaaagattggcattagaaga

SEQ ID NO: 514811 - DNA, 606 bp, Homo sapiens
gccgccgccggagccgcgcgcagccatggccgataaccccagcttggagaaccaccgctttaagagcttcaacgaacaaggtgccgctgatgtgtgataatcaatgcgatagacatagaaatgaagtgacagtggaactgcggaagaacacacgagatgaacacttattgtaaacaagagaaatgttccccaagaagaacagtctagacagattcagatgttgatgctgattttaaagcacaagatgtaaccctagaaggctatattgcagaatgccacaagtgataacccagttggtccaattgagtgctgtccagtgctagcaacgaacaactagttatccagttgacacgcaaatccagccgagttgatgacttaataaaatctgggatttgaccaattctagtcaaatgtctagaaagggcactgatcctcctacattacagctggcaagctgcttgcggcattaactaaccatagcatcaggaacttctgcacagactcaagctgtcgtgcagtactaatgcagtacctcttaacctgagacttcttcagacaaccagatccagaatgttagagaacaagcagatatgggcttagggaaac

SEQ ID NO: 514812 - DNA, 741 bp, Homo sapiens
gcaggttgtaaatccatgtggtcgggggcttggaccctggcggccaagcggcacgtgggcctcgcagatgtgcacgcgccggagcgagcggcgcaccagcccccggtccggcgccaccatcttcgcgctaagctctgggcaaggccgctgcggcatcgcagtgatccggatccatgcggccccggcagcggtgcacgccctccgaattctcaccgcaccccgagagctgcaccttgctcgcgcatgccagcctgcgcctgggtcaagctgattcccctgcttccggggtagcctctggaccgcgcactggtgctctggtttgcccaggtccccagagtttcagccggtgaggactggcgtggagttccactgtgcatggaggcccggtgagtggtgagcggtcgtcctgcaggccgttgggcagcgtgccggggcttcgaccgtgcggaggcaggcggagtacaccaggacgggccgttcgccactggcgaagctgaaacctgaccgaagctggagcgggctgggcggaccttatccacgctgtgagagcagaggcgcagcggtgcgggccaggccccgtccgggcagtctgggccggagaagcttgggtgcacctctgccgtggcttgggccgagacccgtcaccaagggcttctggcccggttggagggcctatagtcgatttcggcgacggctgactacctggatggatggggttccttggtggcagcggattgtgtg

SEQ ID NO: 514813 - DNA, 200 bp, Homo sapiens
cctggcagcttttctccaggcatcagggtcactaaaaactgattgtctaaaattattggattcgtattctgatattaagggggaaaatgtgatctgcgcctgatctttcatctgggattcttataacagctttggcttcagaaaaactcagaataaaaggccttgacttaaacagctgagacaaagaacaaaacaaaaaa

SEQ ID NO: 514814 - DNA, 1420 bp, Homo sapiens
actagttctagatcgcgagcggcgcccttttttttgttttttcgcaacggttttgccgccaaaacacaggtgtcgtgaaaactacccctaaaacccaaaatgggaaaggaaaagacctcatattcaaccattgtggtcgttcattgtggacacgttaaatttcgggacaagttccaccacatacgtggccagtcgtgactctataaagtgcgggtggcatcgacaaaagaaccattgaaaaatttgtgaaaaggaggcgtgctgagaatgtgggaaagggctccctttcaagttatgtgccgtgggctcctgggattaaacgtgaaaagctgagccgtgtgaccggtggtattcaccattgtgaatatcctccttgtgtgtggcacaatctggaagaaccgagccaaagtcacttatgttgaactaatccatggaatggccccccagggaaccacaagaagacacttttatatcccaaacacctattgtattcacggggggcactatctctcgaggccgtgaaaacgaggtgagcctgagaaccctgaagatatggttaagggcatggctggagtttgtatggggtgagaatttagagacaggctggggtatattcttccccaaaaatatgggggcaaagacccccgaaaaagccatgtgccccttttcttgggctattacaccatctggggtgtgtggacaaaccacaccttaaattggtggtccgggtagtttacaccagaaaatggtggatttctcccaactgtggaggccccaccctcataacacgccccaggcaaaagcaggatatatttgaaggacaaaatttggtatctaaccgcggaacgtctcaacggcaacctttactactcttgccagcaacacactttgggtccatacaaaacccccggaaacaacaaagtaagccacttgtgcggtgcccaaaatttaccggggctggggaaaactgtgaggcaacaacccgagtcccggggagccccaagaggcgctaaacaattcaccccggggtacacacgagcgagacggggcgacacactcaccccccgcgacagggagctaggcacaagcacgcagtgggcaacaaccacggcgatgtataagaggccacacgggaaagggaaacatcaacaacacaacacatcattgcccacgttgcgacaaaacctccagtgaccaaccgacaccacccacgggagatgctatacacacatagtgtggcgctcgagagcacaaaagacagacttgctgcacaccgaagaccaacacaggaggacaacaaacccgcggatgagaggaccacacacgccagcaaaaaagaaaggaaaaaaaccaagagaaacccagacaacaacgacagcaaatcgccgacaaccgagctcacacacaacaacgaacacac

SEQ ID NO: 514815 - DNA, 345 bp, Homo sapiens
gtttcctccttgccacccttccagcctttcagggtttgggggccatttagacagcccatcctgcctgccctgagtgggagggcaaaacatgactggctcaggatggcctgtcccccaagttgcctcaaaaaaaccagggacatcagtgcagttggatgcccagtgcagtaggttttggtaagtgcacacgggtgtgtacctgcccttccaaacctcacaggaaagaccaacccccccccccccccaggttatcactgttttggcccctgtcaccaaaaattaattttgccctttttgaaactttatgtcagtgaaaattaaagtttgtgttttgttgtttactga

SEQ ID NO: 514816 - DNA, 616 bp, Homo sapiens
  misc_feature (183)..(183): n is a, c, g, or t
  misc_feature (215)..(215): n is a, c, g, or t
  misc_feature (266)..(266): n is a, c, g, or t
  misc_feature (304)..(304): n is a, c, g, or t
cctcccaaagtgctgggattacaggcgtgagccaatgttcccaagcctattctttagtatttaacagaatgcggacaagtcacattatcaatgattcgttactttacacacagggaagtcttctgttatacaactggttgtgaacacccagaacaaagctcttacagcctttagatggccaanaaattctcaaagcctgggcatgttctgaaaanacttcaaccacatcttttaaaaaacatagactctcagtcgggtgcggtggnctcacacctgcaatcccagcactttgggaggccgatgngggcggatcacgaggtcaggagtttgagaatagcctgaccaacatggggaaaccctgtctctactgaaaatacaaaaattagccaggcttggtggtgcgcagctgtaatcccagctactcgggaggctgaggcaggacaatcgcttgaacccgggaggcggaggttgccgtgagccgagattgtgccactgcaccccagcctaggtgacagagcaagactccatctgaaacaaaacaaaacaaaaataacatacactctctccccgtttcagaggactgggtggaggctatgtccgcctcccctggaagccc

SEQ ID NO: 514817 - DNA, 1478 bp, Homo sapiens
gcaccgactaagtttgacagtcaaggatcaagccgacccatcgaggtcgctaagttagttatgccattcaagtacgcccaccttacgatagtatttgtatatatagccgacttctcgaagtagacaagcgcatagttatagacatggtctccgcgcaggagcctattcgcctttcgcgtaacccgccacgtaaaactacaccacgcagcgcgtacggtgacaattgaacgtgctaccttatcacatttgcgtacgccttaacctcgcactgtgcaaagcgaaagttccactcgaggcccagatagcccctaccaggctgtcacgtaccatatcaatttcaacatgggtcggaaagcatccacctttgattccgatcaggcaacaacaatcacacaaccgatacacttaacccccttctatcccttcaccttactctctcacacactacaatccaccacccttaaccataacaaattccattcaccaattataacaacatatacacctcacaagccataccttcttccaacaccatagcccaccagcccctaggaaatcaccgctaaacgttttcacaatttaattatgatgtcgagcacgttaactttcctcatcctccacatcactccagccacattacatagccgacacaccccacgcagacttattagtacttcgccagccactcaaaacccccattatcgcggtcccctttagtgtccaagattgcgcaaaacgcctcccaggtaaccattggaacggtaggcagataaattccccaaacggatactccgagtgtgaagactgctggcccgcccattggcaacacgccggcacttcagttgtggctccaatgctcatagttacagccgttacttaccgccgaataacgtattatgcgacttagaactatatagtgccgcagatgaacggtgccttaccgtgggagcaaattcctcaccaagtttgagtcccacacgccacattgaagtgcttccaaacgattccggagtccaaggccgttctacatccatctcttataagcaaacacactttcccaaagactctataacatccaaactccccacccaattataaggtagaccacataaccccacctctacaactacccactccacacctttctcccctaacatcatcctcacagcccctatcgctcacgtcagagtatccacttgtcctgacaaccatcgtatgtgagccaccacgccaacaagtcagtagggacaacacaagctgcccgtcgtcacgctgtctcgcacccgcaacagacgcagatgtacacccccacttaggcataccacgcctaccccacgcagccaccagccgctcaggagcgcggcagccacttattctagtacacatcgtttaacatatcttagcacacccatacgtataagcggcacctgttcgatagaaccccacccacaacaaccgcttacgacgcgccacgtctt

SEQ ID NO: 514818 - DNA, 234 bp, Homo sapiens
cttctgaacgaatatcaacgaaagctgtggtacttatatgcatagggtgttttgttgttttgtttagtggcgtgagattctgtgagctgctaattcaacaatctcgatagaaaacatgactggcagttagaggcctctgaccctagaattttaacagaagaatgtgtcacagaattaaacaaaagaagaatacatttcagaggggaaacttacacatagaaaaaaaagtcgacg

SEQ ID NO: 514819 - DNA, 758 bp, Homo sapiens
gccgcagcatggagggaggcggcggggcgggcggcggcggctcgggtggctgcgctgggagtgccggcggtgagaggctcgcacgcctccagcccggcctggcccccgggagggagagccgagcagcccggctctgggctacggactatgggcgaatagctctgaccaccggcgaaggtccccgtctgcgcaatcacggtgccaagcatagtgcagtgttgggcgaggacagatggcgcggatgacttctatcagctgaggatcctgaccctggaggagaggggggaccaaggccatagagagccaggaagagcggcagggcaagatgctgctggcgaaaccgagtactcactgtgtctctcctgacacacgcaggatggcgtggtgcaccaccacggctcttccaggaccgcacctgtgaaaatcgtggaggacacaagaattccagcccgggtggtccccgaagatgaaagaaggcgcatcttgcctcgtcctggactggcctcttgtgcatcatgacgttcagcgataaagaccgctgaacctcatccaaccttgcagcagctacgttcatcacgggacgacagaggccccgagcgacatgagacgactggggggaaatctctagcgaaacgtgagtccgcgtgggaggaggcccttggaccagaagggagttattcgtggagcgacgaagaccgtgggagttggagcaacatggtgccacacacaggagggcaacgtcggaaacacatcgcgcg

SEQ ID NO: 514820 - DNA, 547 bp, Homo sapiens
cggtaccagagaaccaacgtattctctcactggcctgtaacatttttctcatttcaaccttggtgaatctgacgattatgtcttggggttgtttttctcgaggagtatctttgtggtgttctctgtatttcctgaatttgaatgttggcctgtcttgctaggttgaagaaattctcctgtataatacactgcagtgtgttttccaacttggttccattctccccgtcactttcaagtacaccaatcaaacttaggtttggtcttttcacatagtccaacatttcttggaggctttgtttgttccttttcattcttttctctctaatcttgtcttcatgctttatttcattaagtccatcttctatttctgatatcctttcttccacttgattgaatcagctattgatacttctgtgtgctccatgaagttctcgtgctatgtttttcatctctcttaggtcatttatgttcttctctaaactggttattccagttagcgattcctctcatcttttatcaaggttcttagcctccttgcattggggtt

SEQ ID NO: 514821 - DNA, 271 bp, Homo sapiens
ttcgaagagtggactgtgcagtctgcacatatctttctttggatccattcttcccagcttgtttgctcaggctaggagcacactgtgtgtctccagttccttcaccacgaggacaggagaatcggagatgtgcagtttgcccctgggcctatgatcatctgcagagtcgacgagaaccattagaattctcggttccacatgtagtagaaaaagtctacgataatgtcgtcccgcatctttaatcataggtcatgcgatgctaccctcgcga

SEQ ID NO: 514822 - DNA, 83 bp, Homo sapiens
ctcgggccctgatatatcagctagcacgccgcatacgtggagaacgtgctagaatccactatgatgggacacatttcattctc

SEQ ID NO: 514823 - DNA, 195 bp, Homo sapiens
tgtctagtgactgagtatcgtaatacaatgccagtcaggccacctacggtgacaagaaagagggggcgagggctcagagcactgcacgcagatcctctcctatcgcttccgtggagtgtggcgagtcagctaaatactttgacgccggtggggatagcgctgattatggtagcgcactccaatcggggcatctca

SEQ ID NO: 514824 - DNA, 160 bp, Homo sapiens
tggctgagaaaccctggcccccagcatgacaagcggactctgattggcgacatggtgtgcttcttgttcataactcccgtggccaccatcttgggaacgtgcattccccgatgaagcttatcaccatcatggccatctcggtggtgtgcttcttcttcct

SEQ ID NO: 514825 - DNA, 469 bp, Homo sapiens
atcgtaaagagctatagagataagcctcagcattattaatcatcaggaaaatgcaaatctaaaccacattgaaatataatatcacctcacacctggtaggatggctgttatcaaaaagatcagagatcacgagtggtagtgagcatgtgggaacaagggaacccatgtacactgtaggaggaatgtaaattggtatagttgttaaggaaaacagtatgaaggtttctaaaaaaaataagatagaactcttctatgatctagcaatctcacttctgaatatatattccaaggaaacaaaattactgtctcaaagagatatttgcgctcccttatgctaaatgcagtaagtcagttacagaaagacaaatactgcatgacctcagtttcatataaaatctaaaaaagttgaactcctgtacagaaactgagagtagaagagtggttaccagggattttaggggggaccagg

SEQ ID NO: 514826 - DNA, 292 bp, Homo sapiens
gatcgaggaaacaagtataacaggcgctatcgttgctacatgttgcaaccaggtataacgggggtaccttttctaatgggagtcatatgggatggaatgggtgcccctctctgcatgatctagttgatgtgcatttagctgccatgcacctgtccccctttaatactgggcatgggaaagccatctcaagaggcatcttctacatgtggtgtacgcattaaaataatttcaaagatatctgagaaaagccgatatttgccattcttcctatatcctggaatatatcttgcat

SEQ ID NO: 514827 - DNA, 288 bp, Homo sapiens
  misc_feature (87)..(87): n is a, c, g, or t
  misc_feature (108)..(108): n is a, c, g, or t
  misc_feature (121)..(121): n is a, c, g, or t
  misc_feature (139)..(140): n is a, c, g, or t
  misc_feature (147)..(147): n is a, c, g, or t
  misc_feature (159)..(159): n is a, c, g, or t
  misc_feature (161)..(161): n is a, c, g, or t
  misc_feature (176)..(176): n is a, c, g, or t
  misc_feature (179)..(181): n is a, c, g, or t
  misc_feature (185)..(185): n is a, c, g, or t
  misc_feature (202)..(202): n is a, c, g, or t
  misc_feature (214)..(214): n is a, c, g, or t
  misc_feature (216)..(216): n is a, c, g, or t
  misc_feature (234)..(234): n is a, c, g, or t
atgggggggggggggggggggggggggggtttttttaacccgggtttttttttttccccccccttttcctggggggccccccccccnttttttttcccccctttaaanccccgggggcgtncccccccccggttttttnnttgggcnggggggggggtncnttttttccccggggnccnnntttnccctttggccctttttnggggcccctttnancccgtttttttccaaaancgggggggggccgggccgggttttcccgggttttttttcccccccgggccccca

SEQ ID NO: 514828 - DNA, 153 bp, Homo sapiens
caaactacagctcatgggccaaatccagcctgctgtctgcttttgtaagtaaagttttattggaacacagccacgtgcattggtgacacattgtctatgggggtgttcacactgtgacagcggagaccctgtgtgctgcgcagcctaaaaaat

SEQ ID NO: 514829 - DNA, 249 bp, Homo sapiens
actggcacccgcattgatctgggaggctggcgcccggccagaaccctttgctggcacagtgactatagagacagcaacaaccgagaatgaccacgatgcgcccgccagccaacctgcggtcatcaacaaatcatccccggaaggctgggagccactaccacaagccgccgacagcatagcggtctttgctccgccggccgcggcacgggctgagcctgatgtcatggaggacatgttggacgagagtag

SEQ ID NO: 514830 - DNA, 605 bp, Homo sapiens
ggctggtacgcctgcaggtactggtcggaatcccgggtcgacccacgctgtcgagattgcttgactcgggagcaaagccgaggtcgtaatggcgtcgtgggacaacctcggggagctctccaacatcgcgcagctcacggggctggacgccgtgaagctcatctccctcatcgtcagggcggtgtccagagcgcgggtgcacaagcgcaactgccgccgcttcgcgcagcacctcaagctcatcggcggcctgctggagcagctccgcgtgtcggagctccgcaagtacccggagacgcgggagccgctggagcagctcgaggacgcgctccgccggggataccttgctcgtcaactcctgccaggaccgctcctacctctacctcctcgccatgggctggaacatcgtctaccagttccgcaaggcggcagagcggagatcgacaattacctacgcctcgtcccgctcatcacgctcgtcggacaatgcccgcatacgggatcggcttgagtatattgagaggaccaaggtgaattattctttgacgaggacgacaagaaagtgcaagatgctcggtgaatcctgaccgtgcacgaatcctaca

SEQ ID NO: 514831 - DNA, 1120 bp, Homo sapiens
  misc_feature (300)..(301): n is a, c, g, or t
  misc_feature (304)..(307): n is a, c, g, or t
  misc_feature (464)..(464): n is a, c, g, or t
  misc_feature (567)..(567): n is a, c, g, or t
  misc_feature (782)..(782): n is a, c, g, or t
cgggggtggcggggggggaaggcggggttgcagcggagtggatgggtcggggcttggtgacaggcgggaagtgggggtggtggagtcgtgcgtagcgtaacgcgcagccaggttaggggcgggagctccaggggctgccaggcagttggccgtagtccgtgcgaccctgcagcagttaagagcctgtgcagggccttgtgctccagggcttccatggcaccgttttaatccttctctgaaagcaggcctgcaggctgcaggtggcgcggaccgtgagagggtccagagccttgccgctcnnttnnnnacagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgcngagcagaacatggtgagcatcgcggtgggctgtgccacccgcaacaggacggtgcccttctgcagcacttttgcagccttcttcacgcgggcctttgaccagnttcgatgcgcatctccgaagcaaatactctgcggtccactggggtccatcggggaagacgggccctcccagatggccctagaagatctgctatgttcggtcagtcccacatcaactgtctttacccaagtgatggcgtgctacagagaaggcagtggaactacgcaatacacgggtatctgtctcggaccagcgccaaaaatgcatcatctatanaacaatgaggactccagtcggacaagccaggtggtcctgaagagcaggatgacaggtgaccgttatcgggctggtgacctgacgaggccttgcgtgcactgctgagaagaaagatccatcggtgtgaccttacatagccggacgaaatatctcaaggccggcacaagagaccccgggggcaaataaaggctggagcggccgacaatgcgacggtagccccgaaacggccgtgacaacgaagggaacggcgcgcagagccacagaggaccggaaacggaccagaacagagaaaaagaaaaggaaagacgaagaaaaacaacacagaaaccgcccagggg

SEQ ID NO: 514832 - DNA, 910 bp, Homo sapiens
  misc_feature (648)..(648): n is a, c, g, or t
cattggccttcctcgtaaataatgtcactactaacgtttgtgcgcgcctaacactgtgcggttttgttaaaatacgtggttacaccaccaccccttcttgccgtaagtattaaaagcgctgttgaaaaaaccccgttggttaagagaaaaacaatttttgtctcccgcacagcatctcctttggggagccaaccccttggtttgtccacctggaaaccacaaaagtgtcttttttccgccaaatctatgtccccctcttttcaccgaacagtcacacccctcctgcacatataatggggggacaccaaatatatccaaaggttttgattcctttttgtgaagcacacctcccctctggcgcgaaaatgtgggggcaaaatattggtgtaatgcccccccctttggggggtctggaacagatggtgctacccacaggtcacagggggttaaggcacccccccggtgcccaccatcttgggggaacagcccccgctctgttctctttgtgaaaacaccccgaagttatcctccgccgcggcttgttgtggtgtacgccccaccccgacgactaccgcagtggtattctcagtagtcacacgaagggaggttgcagcacacgaagaaacaggcctcaaacaccctgagggnccgccgtgctggtccccacacgtgtgccgaaggttcaacggccccccgtgccaccacaacaacccctggcggcgacaaagacgacaacaatcccctcttccccaaaacgggaaatcgccccacccctagcactttgccccggcgctgtgggcacacaacctcgggagaacccaggacctctagggcgaacccgcgggggggaccccccggccccgggggcagccccccccggtaaccgggacccgttttcgcccacaaaaca

SEQ ID NO: 514833 - DNA, 1173 bp, Homo sapiens
  misc_feature (300)..(301): n is a, c, g, or t
  misc_feature (304)..(307): n is a, c, g, or t
  misc_feature (464)..(464): n is a, c, g, or t
  misc_feature (567)..(567): n is a, c, g, or t
  misc_feature (871)..(871): n is a, c, g, or t
cgggggtggcggggggggaaggcggggttgcagcggagtggatgggtcggggcttggtgacaggcgggaagtgggggtggtggagtcgtgcgtagcgtaacgcgcagccaggttaggggcgggagctccaggggctgccaggcagttggccgtagtccgtgcgaccctgcagcagttaagagcctgtgcagggccttgtgctccagggcttccatggcaccgttttaatccttctctgaaagcaggcctgcaggctgcaggtggcgcggaccgtgagagggtccagagccttgccgctcnnttnnnnacagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgcngagcagaacatggtgagcatcgcggtgggctgtgccacccgcaacaggacggtgcccttctgcagcacttttgcagccttcttcacgcgggcctttgaccagnttctgctatggcctgcatctcccgaagagcaactatcaagccgtctgctggcgtcccacgtgcgagcgtttcccatctggcggaacgacttgtggcccttcccatgattggcccgtagtaagatcgtcggcgtagtgtttcggagtcagtccccgatcatcaacttgttcttttaccctaaagtgattgtgcgttgcgtactacgagaatggcacgtggaacttagcccgccaaatacaagatggcgtatcgtgctttcattccggtaccagcctgcccatgaagatatgccagtcatctatanaacaatgaggactccagtcggacaagccaggtggtcctgaagagcaggatgacaggtgaccgttatcggggcttgggtgtgaccctgcactgaggccttggccgctgccgaactgctgtagagaaagaaaagatcaacatccgcgtgctggaccccttcacctatcaatgcccctgggacagacacacgtcagttctcgacagcgctcgtgccaccaagggcaggatcctcaccgtggaggaccattattatgcaaggtggcatttggtgagggtgtgtccagtgccagtactgggcagagc

SEQ ID NO: 514834 - DNA, 574 bp, Homo sapiens
aaatccgaatccaaggtttcccaaatcgtcccgcacatcctacttcatcccgacccagacaaaatcccgacccgtctctcctaggtgccgtcgacctaagcgacggttacccggatttaccttctcgtcgagaagtagaaaaatgaacccgaaccctacgaaccccggagaacccatcttcgttctgaaaagacctagccccccgccgacaaccgccccgatagtacccggaccctcagacctttctaccagcgcgactactctcgaccgcacccacctgcaagtacggtgacgtcaacacccagcgctccgcgccggaacctctaagtaccgaccaaaaccaccaccttaaaaacccggagagcccgacccctagaggatccgagacctcctccgacaataacgataataacaacgataaaaaccacatacccggatcgacctctatctctaccctatccctcgtcgtcgcaacgagtagtaacgacaacaaccccctcgtagaccccctttccccacactctctatcctctggcccatcatcccatagctcttcaccagaccagagcccatc

SEQ ID NO: 514835 - DNA, 675 bp, Homo sapiens
  misc_feature (300)..(301): n is a, c, g, or t
  misc_feature (304)..(307): n is a, c, g, or t
  misc_feature (464)..(464): n is a, c, g, or t
cgggggtggcggggggggaaggcggggttgcagcggagtggatgggtcggggcttggtgacaggcgggaagtgggggtggtggagtcgtgcgtagcgtaacgcgcagccaggttaggggcgggagctccaggggctgccaggcagttggccgtagtccgtgcgaccctgcagcagttaagagcctgtgcagggccttgtgctccagggcttccatggcaccgttttaatccttctctgaaagcaggcctgcaggctgcaggtggcgcggaccgtgagagggtccagagccttgccgctcnnttnnnnacagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgcngagcagaacatggtaggtgctggggccggcagggacaggtccacccaaggctgagggctgtggtctgaggggtgcggggcagccatgttggcagagccaggtgcctgctgtaggccagcccagggagactataagaaaagccaggacccagcgttaacccctgaccttgaacagccacagtttgggaggttctgcccaggtgcaaatgtcc

SEQ ID NO: 514836 - DNA, 227 bp, Homo sapiens
acctagtcttccccatcaccaagacctacttcccgcacttcgacctgagccacggctctgccccgcgttcagggccacggcacagccggtggccgacgcgctgaacaacgccgtggcgcaccgtggacgaaatgcccaactgcgctgtccgcccatgaagcgaccatgaacgcgcacaatgctatcggagtggacccaggtcaaccttcaatgctccataatgccac

SEQ ID NO: 514837 - DNA, 893 bp, Homo sapiens
  misc_feature (46)..(46): n is a, c, g, or t
  misc_feature (182)..(182): n is a, c, g, or t
  misc_feature (219)..(219): n is a, c, g, or t
  misc_feature (308)..(308): n is a, c, g, or t
  misc_feature (329)..(329): n is a, c, g, or t
  misc_feature (387)..(387): n is a, c, g, or t
  misc_feature (395)..(395): n is a, c, g, or t
  misc_feature (398)..(398): n is a, c, g, or t
  misc_feature (457)..(457): n is a, c, g, or t
  misc_feature (568)..(568): n is a, c, g, or t
  misc_feature (579)..(579): n is a, c, g, or t
  misc_feature (680)..(680): n is a, c, g, or t
  misc_feature (736)..(736): n is a, c, g, or t
  misc_feature (822)..(822): n is a, c, g, or t
  misc_feature (865)..(865): n is a, c, g, or t
gcgtctggctaactcataaaagtagcctgaagtgattgttaggggngtgtttgttgtcatttccatttgctgccacatcccttacattttcttcttgctaagcactgagaggcccagaatggacacatcaaactgtcaggggggacatttgggccactggcacctgccatggtttttttaanagcagagaatgcagagcagtcacagactccacttccnagccagggtgtgtggaggtctccggggaagagctctgcacaacaggtttcctgggggccagagggcctctcggggaggaacagaaaacnaccagccaggggtgctaccgnccagcctcagccagaatgctgtcagaccaaggccccacacatggcctggcctccgtgntctggggntgnccggtgtcacaagggggccccctggggggtggcgggggcccccgtgggggggccccatnctcttcctctctccgccgccgcagcggggtgtttttttttttcttgggccagctgtgggcctgggtgttctggggccaggtgggcacgtgctccttcttagcatttggggngagcacagggntgaatctgaaattcatgcttccttgttttatgaactcaatctgcatcattcgatgaatgtacttagtatgtaagccatgctcatcctcgtccagctgcgantcagcgccttccacgtcctgtttgtatttggggctgattgctacgattatcatcanggtcttatccctaaggtagcgctccatccatttaatgatatcaatgcctcggattctatcctcaaatatgtcaattgcagtttggnagccatttaccaacaaaaagttcacgaatttcaccacctccanagctgtgtccatcgaataagtgataaag

SEQ ID NO: 514838 - DNA, 355 bp, Homo sapiens
  misc_feature (225)..(225): n is a, c, g, or t
ggtacatgatatgttttggtacagggcatgtaatgtgaaataaggcacacattcatggagaattggacaacgaatctctatgagcatttatcctttgagttacaaacaattcaattatgctttttaagttttgtaaaaatatgcaattattattgactttcatagttaccctgttacgctatcagtttgttttattcattctttctatttgttttgtaaccattnaaacatcccctaccttcccccagccccctgctaccattcccagcctctgttaaccatccttctactctctatgtccatgagttcaactgttttgatttttagaacccacaaataagtgacaacatgtgaa

SEQ ID NO: 514839 - DNA, 4103 bp, Homo sapiens
cacgcgtccctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatgggctgggcatgctagtcctcaggaccccagctggtgtaagtgctggtagtggggggcccaggtgggctggtcctcaagcccccaggcagcatttatggtgctggcagtggcagtagcagcagtgggctagacactggactgtcaggtggcaatcatagctgttggcagtagctgtggcaggatgaatgggacagtttctagccccctaggtgatgcacttgggtgggcactggtggtaggtggggcaggcctgttcaggccttgggattgtgtgcgtgggcaccagtggtgttggatggggtgggccagtcgtcaggcccccctacagagcatataggcaccagtagtggcatgagggaaagatagcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccagggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaaggctgacggcatcccctgtgggtgccagcatctgtgctgcgaatgtggaccactgcagttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaagtgtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggcaaaaaaaaaaaaaaaaaaaaagggcaaatgctgtgtgtagcccctctcataaagggcttaagctcattcaccagggaagagctctcatgacctaatcacctccaaagaccccacctcttaatactattgcattgcagattaagtttcaacatgaattttggagggatacaaatattcacaccatagaatatagtaatatagtatagtatatattttttgtgtctgtctgcttttgctcagtgtaatgtttttgaggttcatctatgttgttgcatgtattagtaggttgtatctattggtgcatagttattccattgtatgtatgtaccacactcttcatttacctgctgatggatattgcattgtttccagttttgggttattatgaataaaactgctgttaaccttaaaatataagtctttgtgtagacatatgttttcatttgtcttgagcaaatacctgattggtcagatggtcatatgtcagtatatgtttaatatcatgtacttccaactgtttaccaaagtagttgtgccattttattttcccactagcgatgtatgagttccatttgatccacttctttgccaacacttgttatttattttagcccattaaattttagctgtttta

SEQ ID NO: 514840 - DNA, 338 bp, Homo sapiens
agaggctgaatggcgtgaacccggtgaggcagagcttgcagtgagccaagattgcgacactgcactccagcctgggcgacagagcgagactctgtctcaaaaaaaaacaaacaaacaaaaacaaaaaaacactgtgcaaatgaaataagccagtcacaaaaggaaaatattgtatgattccatttatatgaaatatccagaataggcaaatccattgagccagaaagtagatcagaggttaccaggtgctgggagacagaggaccctgcggagtgggatgatgcagacagaattccgagcctctttgattctccaccatcagccccatcagcctctgt

SEQ ID NO: 514841 - DNA, 4214 bp, Homo sapiens
cacgcgtccctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatgggctgggcatgctagtcctcaggaccccagctggtgtaagtgctggtagtggggggcccaggtgggctggtcctcaagcccccaggcagcatttatggtgctggcagtggcagtagcagcagtgggctagacactggactgtcaggtggcaatcatagctgttggcagtagctgtggcaggatgaatgggacagtttctagccccctaggtgatgcacttgggtgggcactggtggtaggtggggcaggcctgttcaggccttgggattgtgtgcgtgggcaccagtggtgttggatggggtgggccagtcgtcaggcccccctacagagcatataggcaccagtagtggcatgagggaaagatagcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccagggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaaggctgacggcatcccctgtgggtgccagcatctgtgctgcgaatgtggaccactgcagttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtccaggtatcccagcattatttgttgaaatgcctacacttctttatattcccttgactcctctaaccaaggcagttggacctttgctactaccactgccctgaaactgctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaagtgtatatttcaatgagttttaatacatttatgtacttgtgtcactatcctcatagatagagacaaaacatttctatcacaccggcaatttcctatgtgtcccatcccaatcaatcctttcccctttgctggctccaaacaatgactctttcctatctttttagaaagattagaattgcttttctagagttccagtaatggaatcatacagtgtctaagtctgtttgtggtgctgtaacaaaatacctgagactgggtaatttataaattataggaatttatttctcacagttctggatgctgaaaagtttatgatcaaggcactagcaggtttggtgtctgagggcccagtttctaatttgaagatggtgctttaaacactgtcctcacatggtagaaggggcagatgggcaaaaaaaaaaaaaaaaaaaaagggcaaatgctgtgtgtagcccctctcataaagggcttaagctcattcaccagggaagagctctcatgacctaatcacctccaaagaccccacctcttaatactattgcattgcagattaagtttcaacatgaattttggagggatacaaatattcacaccatagaatatagtaatatagtatagtatatattttttgtgtctgtctgcttttgctcagtgtaatgtttttgaggttcatctatgttgttgcatgtattagtaggttgtatctattggtgcatagttattccattgtatgtatgtaccacactcttcatttacctgctgatggatattgcattgtttccagttttgggttattatgaataaaactgctgttaaccttaaaatataagtctttgtgtagacatatgttttcatttgtcttgagcaaatacctgattggtcagatggtcatatgtcagtatatgtttaatatcatgtacttccaactgtttaccaaagtagttgtgccattttattttcccactagcgatgtatgagttccatttgatccacttctttgccaacacttgttatttattttagcccattaaattttagctgtttta

SEQ ID NO: 514842 - DNA, 1007 bp, Homo sapiens
  misc_feature (1007)..(1007): n is a, c, g, or t
aagaaaggcaaagagtcctgcccgggaccggcgccgcgtgggccaaacctgcgcccgtggaggggcgcgcagagggcaccgggcgcctgggagcatggcggcgcacgcaccagcattgtgttacgtgccgggaggccactgtgtcagacaagctgagagggaaactgaagcaagatgtcgggccggagttgggaagaagacaatgtccaaagctgtcccagttcagtctagcggcaggtgtcactcttatccagctgggcgaggtctgtatgcgttatctgaagaacaagggacgttcaaggtaccggatcagcgtgggcgcccctgtctacattggcggcagctcattgagtacctggcagcggaaattctagaattggccggcaatgccgcgagggacaacaagaaggcccggatagccccgagacacatcttgctggctagttgccgaatgacgaggagctcaaccagctgctacacacaggagtgaccatcgccagtggaggcgtcctgcgccagaattcaccccgaactgctggccaagaagcgagggaccaaaggcaagtcggaaacgatcctctccccaaccccagagaaaagaggcaggaaggccactgtcatggcaacgaagggggggcaagaaatccaaggctgtcaaaccacggacgtccatagaagtccaaaccaaaaggacagcgataaagaaggaacttcaaattccacctctgaagatgggccacggcgatggattcaccattctggtcttctaagagcgcttgttctggggacagaagctgtccttaatcccaagagtgacatcaggccatatttggtccatgagaagtggaggggcattgtcccaccccaacaacaaggcgacaattgaccttcaagaagatataggtaaagccttgggaaaaggtggggggaaaagagtcttggaaacggtaaaggagttcggaaatcccgaggccttggaaagtcgccgaaggcgcgtcagcaatcan

SEQ ID NO: 514843 - DNA, 1353 bp, Homo sapiens
tctgacctgcatgcagcagttacgaggaagtccagacatcggccatcgagtatctgctggatgccgcagcgacatgcgacagggaaaccgaaaactgtcatcagagtgtcgggacgctgcccagtaatccggctcctcgagagcgcagatggataccatgctcacagcgagaagtgtggacgagggaccatgggtgctggggatggacgggccctatgaaattgctcaaggcacagctccatccgcaaagaaaacatggtggcacgcgactgcttgtatgaatactgctgaaaccagatcaacaggacgcgtcgcgctgcagctgctacaaccttggcaaaacaggcctacaagtgactatcgtggcaacactgactttctgacctgcgaaacgagcttccccaggggcaccccgaagcacatggacagggtcgagaaagcttgtagttatgcatgatatcatggccctcgggtagcgaccagtagaaaacacacccgaaatgtcgctcctacagtggttaatccgctatggagacgtgagtccctttgcgaaaagcttccactgtggcaaactcgaggaaatgacggaagggcccaactacgcgtggtccccctgatttaagctttcattgagaactgaccgacattgtaacaaaccatttcccggcacgaacggcaagtggggcgagcacggcgtgagacgcgtaggtagccacagtaacactgacatgcaggtggactaatttagacacagcaagcaattgtagctccaatcggtccaataacaatgctcccccggcacagggcgaaatcccatctctccacggccacggacgcaagattctcagcctaggtgtaccttcaacccgaaaggaatgaaacgctgggcaccggcccgtggcacccgaaatcagcagcacaagaccgcaccaaacaacacacagaccggcacaaccgccccccaccacccaccccacgggaggaggcccaccccacaaacacacccccaccccccaccacggaacacgacaacccacaagcaccacgggcacagcccgctcaacacacccccacacacgccctaacccgctctggggacgccaagaacagccaccccaacggacaagaccagcgcaagcacacacagcggggagacagccgcggctgaggaagaaggacgcggcccccctcaagcacgacacgcaccaaccggaagcagaaccaccacgacgacacacaccgccgttgcgcgacgcccccacctgcgcgaccccgccgccgagccagggggcaccgacagggccgcctgtggcgcaagcgcacgcacaccacggccccacccgcgagacacag

SEQ ID NO: 514844 - DNA, 3528 bp, Homo sapiens
cacgcgtccctcttgcaacttgctgagtttccctaagatcattattttgaattccttttctggcatttttatagatttccttttcttttgaatctgttactggagaattattgtgtctctttggaggtatcaaatttccttgctttttcatgtttcttgtgtccttacattgatatctattcagctagtggaagagttgcttcttccaattttatggattggctttcataaggaaagacttttttgtaggcatatctgtagttttggttgtgattaggatgttttggctttgattctggtgagcacaggagtgtaggctcaatgatttcttcagctgtaaccaatgtaactggtgtcatgtaaccatgtcactgtgagtcctcagtggcttaagttgccattgttagctgaggctgttgtgaggcttttctggggaaagggatgccagaggggccagtccctgggccttttggtggcatgggcaggctttagctgtggtggcgatgggctgggcatgctagtcctcaggaccccagctggtgtaagtgctggtagtggggggcccaggtgggctggtcctcaagcccccaggcagcatttatggtgctggcagtggcagtagcagcagtgggctagacactggactgtcaggtggcaatcatagctgttggcagtagctgtggcaggatgaatgggacagtttctagccccctaggtgatgcacttgggtgggcactggtggtaggtggggcaggcctgttcaggccttgggattgtgtgcgtgggcaccagtggtgttggatggggtgggccagtcgtcaggcccccctacagagcatataggcaccagtagtggcatgagggaaagatagcgctggagaacactggtgacagtgggtggagcaggcctgtctttaggttcttggatggcacatatggacatactggtcctcaggccccctgaaggtgcacacaggcatgctgttgccctgctgagaggggcaaggttctgttggtggcattggtgttgggaagatggctcccaggttctgggagcttcagctccctttttcctggggtagcctccctggtgtgctatactgcctgttccctgggatataagacacttcatgggtcagagtactggggacctggctgcactgctgggtgattgtgatactgcaaccttctggatggatgtgggaggatgttcttgggggtccagggatgtggactgcaggggcttattggaccccaagtgggcaggatataatctggtgggggctagcctcttaaaatggtgctgtgccacagcagcatgtttcttgggatgtgagtaggatccagtggaattccctttctggaagaacgcatttgcatggattccaggcagctccgtatactggactcagggcctgtgaaggctgacggcatcccctgtgggtgccagcatctgtgctgcgaatgtggaccactgcagttctttgacttttcttttcccagaaatgggattcccctcctgcttctgagccagtccaagacatgctggctgctttatttactgctccctttgtgcctcagaagttccctgttgaatagtgttctgtctttggtgctctacctgacatgtggttaactacttgcttttttggtcctttgttgtgcaggagttgagtgccaggctcacggttttttgattaccatagttttgtagtttttgaaattcagaagtgtgagacctccaactttttctttttcaagattattttggctgttgagtcaattatgattccatatgcattttagatggatttttctatttctggaattgtgccattaggagtctgatagatactgcattgaatctgtagagtgctttgggtagtattgacatcttcccactattaagtcttccagtacatgaacacatgcattttcctgatgactaatgatgttgtaccttttcatatgcttattggctatttgtagatcttcctgggagaaatgtctatgcagactttttgccaattttttaatttgtccatttaaaaatcagggttttttttgttgttgagttgtaggagttctttttgtattccttatactagtcccttatcagatatatgctttgcagatattttctcccaggtgggttgtcttcacttccttggtagtgtcttttaatacacaaagttttaaatttttatgaagtcaaatgtatctacatttttctttggttgctcatgcttttggtgttgcatctaagaatccactgccaaatccaaggtcatgaagatttactcctatgttttcttctaagaattttatagtttttgctattacataaggtctttgagccattaagatctttgacttaacttttgtatatgatgtaaagtcactgtcaaacatcattcttttgcatttggctgtccaggtatcccagcattatttgttgaaatgcctacacttctttatattcccttgactcctctaaccaaggcagttggacctttgctactaccactgccctgaaactgctgtcactgggttactgaggactgggtagcttagttgagtagataatcttttgttgtttcctccttgtaatatacaagccttggcttctgtgacatcatactctcctagatttccccctgtcactgtggcttcttctcagtctctgtccatccctggtgctcctgaaggttctgttctcagccttacacacattacctgggtgatctcattctctgccatgacttcacttgccatatatgtgctgattttccccaaattcctatttctcccgacctttacatctattttatttgcaggtcatatatctaataaggaattgatatccagtgtacatgtagaactcctgtaattcaatacagaaaccaaacagtccaattaataaatggagaagagatttgaatgaacatttttctaaagaacatctcaagctcaagatttcccagataacttttctttcttcaaaatctgcttctgtgtttcctcatctgtaggtggcacagcatacatctgatttcccaagccagaaacctcatagttattcttgactccaggaagaaatattattgagtttttaaaaactcagcttattgactcattgttttatataataaaatgcaacagttttaaaaaaaaaaaaaagaaaaaaaaaaaaaagagaagagaaaaagaagaaaaagaaaaaaagaaaaaaaaaaaaaaagaaagagagaaaaaaaagagaggaaaaggagagaggagaaaaaaaaaagaaaagagagaagaaaagaagaaaagagagaggagagagagaacgcaagcagtagggaggagagggaggagcaacagagaaagggaccgaaagagaagagaaaaaaagaaaaagaaagagaaggcaaaaagaacagtgaggagagggagaaaaaggagagagagagagaagagaaaaagaagaaagggagacgcaacaagagaagcaaaaagagaagaggaggaaaggaagagaaagac

SEQ ID NO: 514845 - DNA, 215 bp, Homo sapiens
cacagatgtcaactactgatcacaaggccatagcaacatcatctcgcaaatgtgagtagacacagattctccatgtacgaaaacatgtctccactatagagactgggaaattttcctcttctgggtcacaaattatcaaggggaaagagtaaggatcacttttcaaactgcactgacaatcactcaccagtgtggagagaggggtaccgagctcg

SEQ ID NO: 514846 - DNA, 958 bp, Homo sapiens
tatcgatatagatccaccatgtttacccgaaaaatggtgacacgcccgtggtatccgctgtgttgtattatcttttaacgggtattgtctgttaagcccactgcggagggtccccacccaatagtggcctcgcccccgtgagcaagagggtgcactctgcacgccgcggctttgtttgaccccccccctcggaataatggctcgccaacacggccttgctaatgtggtcaaacatatggagttaaccggcctcccctgtgctgtcttgttacaaggaagctccccccatcattttttttcgcgccctcttgcgtgaacatctgtggcacactgttgactgcccgcggcagtttcaaaggcgtccatctgcgccgccgggaacctgcggtgtccacaacagaagtcctctgccaaggggttcctctggccgccagtgcaccccacaaggtacagagctcaaaaaacggggggtggtcactaaggccgcccgcacccaggaattatggccccgtgtgacgccggaaggcacaccaccaagacggtcctgggcagtatcaccactccacaagggcaaactctcctgggcactactagagcaaggaaaaaatattccacgcaaagagcgggagcacgcgaacaagatctgtccagaaacccgggtgtccgggtcacagacgacaccagcggcccctccccagggaagacccacggagtacgcgtaggaacccctagtcatgaaatgtgttattaagaaaaatggaaatacctgggggacgactgtctcccacgttacttggagacaatatttcgatgtgaagtaatgagcccccaaacagactgggtggaatgattgtgatgtagtagtaaatagatcggacaatccgatttctctgaagagtatggtaccccacattccagcccccctcaagacaaaaaaaaaacacgttctcacaaaaca

SEQ ID NO: 514847 - DNA, 1504 bp, Homo sapiens
atggggaaccgcagcaccgcggacgcggacgggctgctggctgggcgcgggccggccgcgggggcatctgcgggggcatctgcggggctggctgggcagggcgcggcggcgctggtggggggcgtgctgctcatcggcgcggtgctcgcggggaactcgctcgtgtgcgtgagcgtggccaccgagcgcgccctgcagacgcccaccaactccttcatcgtgagcctggcggccgccgacctcctcctcgctctcctggtgctgccgctcttcgtctactccgaggtccagggtggcgcgtggctgctgagcccccgcctgtgcgacgccctcatggccatggacgtcatgctgtgcaccgcctccatcttcaacctgtgcgccatcagcgtggacaggttcgtggccgtggccgtgccgctgcgctacaaccggcagggtgggagccgccggcagctgctgctcatcggcgccacgtggctgctgtccgcggcggtggcggcgcccgtactgtgcggcctcaacgacgtgcgcggccgcgaccccgccgtgtgccgcctggaggaccgcgactacgtggtctactcgtccgtgtgctccttcttcctaccctgcccgctcatgctgctgctctactgggccacgttccgcggcctgcagcgctgggaggtggcacgtcgcgccaagctgcacggccgcgcgccccgccgacccagcggccctggcccgccttcccccacgccacccgcgccccgcctcccccaggacccctgcggccccgactgtgcgccccccgcgcccggccttccccggggtccctgcggccccgactgtgcgcccgccgcgcccggcctccccccggacccctgcggccccgactgtgcgccccccgcgcccggcctcccccaggacccctgcggccccgactgtgcgccccccgcgcccggccttccccggggtccctgcggccccgactgtgcgccccccgcgcccggcctcccccaggacccctgcggccccgactgtgcgccccccgcgcccggcctccccccggacccctgcggctccaactgtgctccccccgacgccgtcagagccgccgcgctcccaccccagactccaccgcagacccgcaggaggcggcgtgccaagatcaccggccgggagcgcaaggccatgagggtcctgccggtggtggtcggggccttcctgctgtgctggacgcccttcttcgtggtgcacatcacgcaggcgctgtgtcctgcctgctccgtgcccccgcggctggtcagcgccgtcacctggctgggctacgtcaacagcgccctcaaccccgtcatctacactgtcttcaacgccgagttccgcaacgtcttccgcaaggccctgcgtgcctgctgctgagccgggcacccccggacgccccccggcctgatggccaggcctcagggaccaaggagatggggagggcgcttttgtacgttaattaaacaaattccttccc

SEQ ID NO: 514848 - DNA, 883 bp, Homo sapiens
  misc_feature (73)..(73): n is a, c, g, or t
  misc_feature (99)..(99): n is a, c, g, or t
  misc_feature (146)..(146): n is a, c, g, or t
  misc_feature (151)..(151): n is a, c, g, or t
  misc_feature (157)..(161): n is a, c, g, or t
  misc_feature (200)..(200): n is a, c, g, or t
  misc_feature (229)..(229): n is a, c, g, or t
  misc_feature (465)..(465): n is a, c, g, or t
  misc_feature (534)..(534): n is a, c, g, or t
  misc_feature (567)..(567): n is a, c, g, or t
  misc_feature (585)..(585): n is a, c, g, or t
  misc_feature (597)..(597): n is a, c, g, or t
  misc_feature (671)..(671): n is a, c, g, or t
  misc_feature (680)..(681): n is a, c, g, or t
  misc_feature (683)..(683): n is a, c, g, or t
  misc_feature (727)..(727): n is a, c, g, or t
  misc_feature (735)..(735): n is a, c, g, or t
  misc_feature (740)..(740): n is a, c, g, or t
  misc_feature (768)..(768): n is a, c, g, or t
  misc_feature (783)..(783): n is a, c, g, or t
  misc_feature (791)..(791): n is a, c, g, or t
  misc_feature (862)..(862): n is a, c, g, or t
agaagggaagttcttgagggtagttgggcagttttacaaatggcagtggccagcatgtcaattgaatgcctantaaataagcgtcatatatcatcatanatagataagtgactctgtgaggtcatattccttatcacccatttttntattntggttnnnnnttttggaggggtgagccatccaaaggcgcaaagccagtnagttatagagttaggtagaatcgtgagtntatccgactttaagttatccatagggattgcctggacaaggcccaggagcttctgtgtgccaactctacaacacttcagaattaccaaaattcgctttgaatgatgagagcccttagcgatacaaatgtttccaaaaaataccaaagaaataacttgtgcacccagtggttgaggactctctaagctacatatggtcctctaacacaggttttaagagaaacaatactcaaaagtnaaactaaccaaactgtatatgactgaataatgtctttgaaaatcccaaagagttagtaccatcatatgncatttaagacagacacatgctgagaaacgcatngttaggtgattttgtccntatgtgaacatngctgagtgccttacagaaaactcagtggtacagctgactacaccctggctatatggcacagcctatgctcctangctacaaanntnggcagcgtgtgactgtattaaatgctgtaggcaactgtaacacnatggtaantattntttttctaacatatctaacatagaaaangtacagtgaaaatanagcattanaattttatgggactactgacatatatgcagtctgtcattgaccaaaacatcatgtggtacatgacagtatnctgaaaaagtaaaagattaaa

SEQ ID NO: 514849 - DNA, 128 bp, Homo sapiens
gatcccccttccccttttgccagggtcataagcttcctggggcctccctggaagttgagcagaggccagccccaggcttccgggacatcctgcagaaccataagcacaattaaccctttttaataata

SEQ ID NO: 514850 - DNA, 183 bp, Homo sapiens
aactgggagctggaatcacggatgtccatgctgtagaagctatatgccccttcccaagatgcttgatcttacatgctgtctgatgtcgtctaggaatcttgatcctcttcagctccttcatgcagagctggccgtcccctgtctggctggcagtagtccaaggcccattctgggagactcctg

SEQ ID NO: 514851 - DNA, 1330 bp, Homo sapiens
tgtgtacatggttgtttgtctcctatggttgtttccagttagggtttggatgcgtatatgtggagcctgcttcttttgataacagttttcaggtggtttgtcttgtctttgtgttatctagtcttgggggtcgttagttgttgggtgaatctaggttcacaggttgttaagatgctagagcgtgttgatatgcggaaggtgtttgttgtgtgcgttgcgcggcgcgtgtgtccgggtgggggcagcccctctgttttgtgcttttgtggggtttccccttttttgtggcccgctgttgcccgtcgtgagttaggggccgccagtgttggggtgtctgtagggaccctgtaggggtcttctggggggtttcgatgtgtgcttgttgaccattcgtggggggccctgggaatgtgtttttgcccgcgattcctctggtttccttttagtataggggggctctctctgggggtgcgagtccgaagcactttttttggggaggaccccccaacatgttgacccaagtgggggcaaaactgtgcagactcttgccctaagctaccataggctcacccccgcgccatcgaggctcgggcccaagaggggggccacccacattcttgtggaggaccccgttgcttggcccagagttcttagctcccaggtaataccagaagtggtacctcccaaggggactccaaaggaaggggtacatttgcgtcgttgagagccccctcccctcgctctacttcctcagtccatctcagtggacccctagaaatggggcgccccagagcgtctcttctccatatggcccacagggcgttatccacccctatttcaaacaccgtgggccctttgttctaagaacccacgttctctcggagtcacggcggaagagggtcttcttgaggagcctcgatggaccctgctctaacccacacactggtgttctcccacctggccctgtctgcgtcttgctgctaacaagagaggggcacagggcctctccccaagcccaccgcttataggaaatgcttggcctttggcacaggcacaggcaagctgtaaccccatgctggtgggcaggggtgctggaaggcacccacggccttcacggaggagccccactagttccgccctgcacgtcctgtaaaccactcggctgggccctgcaaggcccaccaactcaacgccctcttgggtgatggttaccggtgggtgggtgggggctgacccccgacttcccggggactgtccctgtggacggcccaaatggcataactgagataaggtgtaataagtgaccaaattaagcccgttttttaaccag

SEQ ID NO: 514852 - DNA, 478 bp, Homo sapiens
gctagtgatcagtgatcagggattcacgggcggtggtactacatctgggaaaagatataaccatgatacgggtcagtggcgcgtgttgtaatccaggcaactcggtatgctgaagcaagagaatcactagaacgcagaaggtggagtgggaagtgaaatgaactcgcgccactgtatctccagcctccagcctgggcgacaggagcaagactctgtctcaaaaaaagaaatgacaggacgagaccatggatggcttgaatcactggtttatagcaaacatagttaagatatggcaaggcaaggatctgaaacctggtgtgcttagttgccaaagtctcactcttgtctgttgtacctcccgataaatttaggtttgacttccttcttcagcatcttgggcaatgtagtaatagaattgatgacaaatagtagtaacaattatagcccagctcagtctttgaccccttccgagcaccat

SEQ ID NO: 514853 - DNA, 797 bp, Homo sapiens
tccatcccagtacctgctttgagcacctggtgacacaaatgaagtgtgcggctccagtgagggacgtggtgaggccgtctaccagattgggtgtagaggacaatgggctgctggtgtggtgctggctgagtgagtgaccatgctgagcttctgctcaagaccctgcacctgtgatggcagatgaatgttgtttggtgggcagacataacctgttcttctgaggagctgagaagtggattattgatacgctgacattgcccctgtgaagatcacctgatgggtgctagtaactgaaagtgtcccgtgacaatccaaacagtttacctatggaaccatccctgtgttgtagcctgtcccattgggtttgacattgttggacttcttgtgggacaggtcaagctacttgctatggaggttccccttgaacactcatgaggaagaaggcttggacaagtgagagctggggagcccgggggctcggcttcagagccctttatcctggcacctttgcagttgaatcgattcatgtcttggacctgaagcctccaggcaatcagactttcgagaatcctggtcttttaacatgccaatgtgagatggttggttgaagattaccatggctggatctccaccgggaagtagcaggaaagcagatcctcgtcggaaggcatgctcgcaaaggatgaatcaggctatcaatcgagcatgggatgggcccacccatacagtagcttaacaacgcacacaactatgggctccaagtatactggcccgactgggccctgtctatgtggttc

SEQ ID NO: 514854 - DNA, 271 bp, Homo sapiens
  misc_feature (13)..(13): n is a, c, g, or t
  misc_feature (21)..(21): n is a, c, g, or t
  misc_feature (166)..(166): n is a, c, g, or t
  misc_feature (259)..(259): n is a, c, g, or t
ctggaaactgganagcgggancctggccaaaacttaccctcgcctggacatagagaaagagatggggtttcaccctgttgcccaggctagtctcaaattcctggactgaagctatcttacccgccttagtctcccaaagtgctaggattacagcgtgatctaccanacctggccaatcccaactactctggaagctgaggcggcaagatcacttgagcccaggagtttaagaccagcctgggcaacatagcaagacccntgtctctaaaga

SEQ ID NO: 514855 - DNA, 301 bp, Homo sapiens
tagcgacgcttatcatggaagctttcaaccaaaacaaaaaaacaaaaacaaaaatgaaagaaaggattaaaagggagatgatggctcattctccatctgcctgccaaatctaggaggttaacctattgttttcttcccttctctctttttctcttccccccctcttccctgtactccttcttctctcttttctctttctatcccctctctcttttcttcttgtgcttttttttttcatgttcagctttagtaacaaatgagcatctgtcagttttataaactgcaaccgtcgtttaatttt

SEQ ID NO: 514856 - DNA, 892 bp, Homo sapiens
  misc_feature (28)..(28): n is a, c, g, or t
  misc_feature (66)..(66): n is a, c, g, or t
  misc_feature (76)..(76): n is a, c, g, or t
  misc_feature (79)..(79): n is a, c, g, or t
  misc_feature (86)..(86): n is a, c, g, or t
  misc_feature (90)..(90): n is a, c, g, or t
  misc_feature (96)..(96): n is a, c, g, or t
  misc_feature (112)..(112): n is a, c, g, or t
  misc_feature (121)..(121): n is a, c, g, or t
  misc_feature (125)..(126): n is a, c, g, or t
  misc_feature (139)..(139): n is a, c, g, or t
  misc_feature (148)..(148): n is a, c, g, or t
  misc_feature (155)..(156): n is a, c, g, or t
  misc_feature (159)..(160): n is a, c, g, or t
  misc_feature (166)..(166): n is a, c, g, or t
  misc_feature (168)..(170): n is a, c, g, or t
  misc_feature (177)..(177): n is a, c, g, or t
  misc_feature (186)..(186): n is a, c, g, or t
  misc_feature (191)..(191): n is a, c, g, or t
  misc_feature (196)..(197): n is a, c, g, or t
  misc_feature (210)..(210): n is a, c, g, or t
  misc_feature (233)..(233): n is a, c, g, or t
  misc_feature (235)..(235): n is a, c, g, or t
  misc_feature (239)..(239): n is a, c, g, or t
  misc_feature (250)..(251): n is a, c, g, or t
  misc_feature (255)..(256): n is a, c, g, or t
  misc_feature (258)..(258): n is a, c, g, or t
  misc_feature (263)..(264): n is a, c, g, or t
  misc_feature (275)..(276): n is a, c, g, or t
  misc_feature (280)..(280): n is a, c, g, or t
  misc_feature (282)..(282): n is a, c, g, or t
  misc_feature (286)..(286): n is a, c, g, or t
  misc_feature (291)..(292): n is a, c, g, or t
  misc_feature (298)..(299): n is a, c, g, or t
  misc_feature (318)..(319): n is a, c, g, or t
  misc_feature (334)..(335): n is a, c, g, or t
  misc_feature (339)..(339): n is a, c, g, or t
  misc_feature (347)..(347): n is a, c, g, or t
  misc_feature (349)..(349): n is a, c, g, or t
  misc_feature (353)..(353): n is a, c, g, or t
  misc_feature (355)..(356): n is a, c, g, or t
  misc_feature (373)..(373): n is a, c, g, or t
  misc_feature (379)..(379): n is a, c, g, or t
  misc_feature (381)..(381): n is a, c, g, or t
  misc_feature (393)..(393): n is a, c, g, or t
  misc_feature (398)..(398): n is a, c, g, or t
  misc_feature (403)..(405): n is a, c, g, or t
  misc_feature (408)..(409): n is a, c, g, or t
  misc_feature (417)..(417): n is a, c, g, or t
  misc_feature (425)..(425): n is a, c, g, or t
  misc_feature (441)..(441): n is a, c, g, or t
  misc_feature (448)..(448): n is a, c, g, or t
  misc_feature (451)..(451): n is a, c, g, or t
  misc_feature (455)..(455): n is a, c, g, or t
  misc_feature (478)..(478): n is a, c, g, or t
  misc_feature (487)..(487): n is a, c, g, or t
  misc_feature (513)..(513): n is a, c, g, or t
  misc_feature (524)..(524): n is a, c, g, or t
  misc_feature (532)..(532): n is a, c, g, or t
  misc_feature (539)..(539): n is a, c, g, or t
  misc_feature (545)..(545): n is a, c, g, or t
  misc_feature (558)..(558): n is a, c, g, or t
  misc_feature (561)..(561): n is a, c, g, or t
  misc_feature (578)..(578): n is a, c, g, or t
  misc_feature (796)..(796): n is a, c, g, or t
  misc_feature (813)..(813): n is a, c, g, or t
  misc_feature (879)..(879): n is a, c, g, or t
agcctataagggtaatggacttttgggncaaaatgaaaaaaaaagcaaataaaaaaaagtattggnagggagaggnganaagtgtntccnggagantgaagcggaggagagnatgggaggnaagnnaggggtcccagcngcagagggnagaagcnnggnnaaagangnnnagggagnagatttgtntgagnagggnnagcaccaggaagnaagaagtaaaaaaaaaaggattnangggngtgggagaatnnaagnnantggtnncatagaaaganntgtntnatgnttggnnagaatnnactttggagaaaatggggnngtatgaaaggatggnntggngagggaananaggnannaagggtaaaagggggangaaaantnaccactgggatnagggnggagnnnagnngaatgganaataactncattacaaggacctgntcctggngcnaggntgtgccactaaactgctcatggncataagganattaaacttctatcctctcctccatnaggcccctatntgtgtggnctcagcnccggtnctcactatttggnggntatgatgcaggactctncaccctcttttggaacagtgttgcataaagaaagggagaatgttcttctagagggacaggaaaagaagagatgtccacatacttctctcactctaagaagccaggttaggtccctggtgcactccactctccacagatggttgggtcatagcatccgagaagctgttatggtgacgaagtcttcgaagctgagccgaatgttgccttgtacagctgtntccttctcccggaaggnctctgtaagcacctgcagctgggtgcacacctggatgaagcggtcaagctgcatggcaggattggnagagcgtgggcag

SEQ ID NO: 514857 - DNA, 264 bp, Homo sapiens
tgctgggtatgtaaacacaggtacattattgaggtacagcctaatgcaaaacagacaagtaaatatggagtatattacagaagatacattttgtagtaattatgtttcagtaatggctagaatattatctatacctatttgtattgtgtttgctgggtaccctagggattagcataggaatcttttacttaccttggtctacttacagttaagatagtgccaatttatgtatatgaagcttcacaataggatacagtagggaga

SEQ ID NO: 514858 - DNA, 1071 bp, Homo sapiens
ctttgacccactgagcagcacggggcagccagaagtacctggtgcgctgacctgtgccctgagactcacccagcagatgttttgatgccaagaacatgatggctgcctgcgaccccgcgaacatggctgctacctgactggtttgcctgacgtgttcagggtgcctgcatgtacatgaaggcaggtggatgagcaaatgcttaatgtccaaaacaaaaacagcagctatttatgttgagtggatccccaacaatgtgaacactggctgtctgtgacatcccacctcgtggggctaaaaatgtccgccaccttcatttgtgcaacatgcacaggacatccatggagactgtacaagcagcatctccgagcagttcacggccatgttcctggtgcaaggccttccgtgcactggtacacagggctgagggcatggaacgagatgagagttcaccagaggccgagagcaacctgacatgacctggtgtcctgagtaccagacagtaccaggatgccacagacgacggaggagggcgacgttcgcaggcaggcggcttgcggcacggcaggtaggctagaagcctaccagccacactgagggacaagccagcgcaatcagtgtgaaacttctttattacaactccacagaactgatcctgttggccttgtccccatagtgttgcacttgctgggaattccatggacccgatccaatgcttgttaccggaccgcacacaatcacacgcaatttccaacgctgaaaacaaaaacaggcgaaaaacaagacaaagaggcggagcagcacataaaggaacaccacaagagcgcccaactgcgcgggaccccagatctttgcaacaggaggggccacaaataaaggagccgcacaatcaaagcaacagcactaagcgcatgtattaaagaaggtatgtgagtgagaaaaagactcacgaagccaaagggagagagcataaattctgtggtcaataatgagcaaaccatacggggagcaagagtaggagaatagcctcgggattggcatcgcgtggcctaggaggaaagagacaatagtgt

SEQ ID NO: 514859 - DNA, 330 bp, Homo sapiens
gtcccgggtaaatcctcatattgaattgagaacctgttttcccattggggggggtttcctccgattgatcccaacccttcccctattttagggaaaccggccctttcctaattggtttttacactgctgggccccccttttgaggggggcctttgcatacttacaaatcagtcaacgtgttttccccctattttgagcccataaaagacccagattcaggtgcagtgaggagagaaatccccctgctgggggggttgggggcccctccctgcatcccctttcccctgagaggggtttttttggtcaataaaatttttttttccccctcca

SEQ ID NO: 514860 - DNA, 198 bp, Homo sapiens
attaagagaacgaaggaaggaaacgaaaagaatgaagaaacgacgaaagaaaggaaggaagagaacagagagagaagaaaagagagagagagaaagaaagaaagaaactgcagatttatgagaatgattgtgatttatcctacttaggctgagtttctaaagtagtaatacttctttgctgctgtgtcatctccagag

SEQ ID NO: 514861 - DNA, 241 bp, Homo sapiens
  misc_feature (86)..(86): n is a, c, g, or t
tgcgctcagtatcacatgtcagagctgtggagagaggacctcatgcaggtgacggtcagtgggcgtcgtcagagctgtggagaganacgctcatgcaggttgtatgtccagtggtcacattcagagcatggaaagaggacctcatgcagtgtggtggtccagtgtccagttgtcagagctgtggaaagaggacctcatgcagggtgatggtccagtggggcattcgtcagagctgtggaaa

SEQ ID NO: 514862 - DNA, 1377 bp, Homo sapiens
  misc_feature (316)..(316): n is a, c, g, or t
  misc_feature (353)..(353): n is a, c, g, or t
  misc_feature (363)..(363): n is a, c, g, or t
  misc_feature (443)..(443): n is a, c, g, or t
  misc_feature (465)..(465): n is a, c, g, or t
  misc_feature (473)..(473): n is a, c, g, or t
  misc_feature (709)..(709): n is a, c, g, or t
  misc_feature (786)..(786): n is a, c, g, or t
  misc_feature (812)..(812): n is a, c, g, or t
  misc_feature (843)..(843): n is a, c, g, or t
  misc_feature (886)..(886): n is a, c, g, or t
  misc_feature (948)..(948): n is a, c, g, or t
  misc_feature (961)..(961): n is a, c, g, or t
  misc_feature (981)..(981): n is a, c, g, or t
  misc_feature (1030)..(1030): n is a, c, g, or t
  misc_feature (1088)..(1088): n is a, c, g, or t
  misc_feature (1090)..(1090): n is a, c, g, or t
  misc_feature (1171)..(1171): n is a, c, g, or t
  misc_feature (1285)..(1285): n is a, c, g, or t
gatagaggaacgtgtcacgccaacttgcacagagcatcctgtgttctggcactactaatcatcggtccgcgaagagttgcgaacccacgagtacaccgtcatatttcatgctctacagccatacgggatgctgcaccaaggcgcccccgcaagaccctaacgagtaaacgcgcgtgtaagaaggagtgcaggaagcgtctctgcgaggtctcttgctgatcccgaaccagagtctgctcatggcgccatcaacgccatcccctcctgttactcaccctcattcggtcattcgtgccttccggcgacatgtggctcntgtctattctcgcacttagcggtctttccactaatcntttatgcttntgttcttggcgtatggctggcatggcgtcggtgtgacctaccaccattcctttctctggactctccctcttcggcgatgngcacttccttcaactcttgcanagcgttanagagaggggacgcccaaagggggtgcgaagatgtgaatcccccaccaagaccagaagattagatggacaccacgacccaccaaaatttgtaatgacacccaccattccaaaattacaaaaccacaaccgtatggaatacgaagcgccgcagccgcgaatctaaatatccggttccgttacgccggtgcccgtaggggaacaagcaacccacacgcagaaggagtgatgatgagacnattaggagaataagctgccgaagacggaggggatatgtaacgcaactgttggaccagcgaaaaattggcctactaancgctgccagcagacgaagctttattntggcttatactgttttggtatggtcaagacnagcacaggaacaacggcgttggtgttcagggagagaaacgtcnaaccgggtttgtcggagagcagcttttacgccatcagcgctaaaagaaatgtttaaagaggngaggggggaagantttcaaccggcaaagtgggnaaaatgacagaaggggttccatgaacaaaccaagattgaaatggcaaancgggaaacccgggaacacaaaggatctggttggtaaaatggagcaaaaccggcaagangngcaagcgtcaaataattaacgatagttttaaagttatagcttttttggagagtgtacacacaatataagtattttttgaantttttaaattcatacgcgagacggcgaaaaggcgacaaggtgaggcggaaagaagggggggacagcgcagagggcagagtagcaagagagaatttggcagacgagacagagagngtttagtgaagagggtggacaacaaccgccctggggcgaggagactatttggtggtgacctattttgggcgggccagggcggtggtttccaa

SEQ ID NO: 514863 - DNA, 388 bp, Homo sapiens
gttgatctcttagaggatacccaggcgttgcttgtgttattaaccaagaacaataaactaaagggatagcattgcttgaagagatgtttatgctgctctccttgttttgatacttgtatcgcgaaaatgggctgttgtaaacaggctgaagggtgtgtatggtcggccatttctgtctcacctctaggccctctgctggtgctgtggaggccaagaccccattaagcctaaaggtgatgggtcctcgcctaggcttagtgctaccatgtgggtttcgtttctttccttccttccttccttccttccttccttccttccttccttccttccttccttccttccttctttccttccttccttccttccttccttcctccctctctctttc

SEQ ID NO: 514864 - DNA, 1768 bp, Homo sapiens
gtgaatagacgtcagacgcacgagcatactttcatcgcatccgtctactcgatcatcatcgctatgctccatgcgtgtggtcaatggtatcatatgcttgacatcgtcgcagacatcgctacggtaagccgatctattagaagatgatctgtctgacaaggcgtgtctcgtagcccatagtgattctagtcttctctctttgcaccgctaccgttggaggccattgaattgtggccactccgataatttatgacaaaaaccgtacagtcgagctaataaccacttcgggatcctatcgatcggaccacggttgaacttagcgttctgttaaaccacgcacatatcgcaacgtattcgatcctcatccacatgagggaacctggtatttgtgcctagtctactaggcaggactcaccatctcatctagaatttgcgccctatattgtctacgggtacgccccgtagaggcaggagacatacagccgttgaggtgccgatgatcactagtccataattcatctgggcggtagaaatcgtaacttgttcattgggcatcaacgagctttcgtcgacccttatccggaaattgcccctgaccgttactcgcgactaacctcagagtgcatgctcccagattgtactcatagctatgcctcgtgtatgctcattccctttctcatatcagcagttacttatttatagtttcacagaatttgagtagcccggtgattttggggcaaggagcccaatattcaaagaagcctccaaaaatgccgagtggcacaatggtgcccccaccggcactcattccaaacccgtttaagccacccaaggcaagggagcgaaccccaccaggtcgcccccctggcccccttgccgaaacacaaaaaatgggcgccgccacaacactggcggcagacacccccgcaacggtcaccagccaggaggcaacgagccccccccgacgcacgcccccgcacacccctacccaccaccgcccgaccccccacccaccagcacgccgcacacagcgtacaggcaacagccggcacagaccaacgcagacatagcacaacacacgtgaaagagagcagcggcaggcagacgcggaggcagcagaagaccaagacgaggagaggacgcagacagaaataggcaaacagcaccggagagacagataggacacccggaggcaccgtccgaacaaacagccagatcgcacaccgacaagggacaacactcacgtcaccgaaacatactcgcaacacccagcaacaaccgccaacaccactcccccatcaaccacacatcacacactcccacatctatcaaaccctatacaccacagtgcacaagaccacacccctcaccccgcatagttaaaatatccagcgcctacccaacgcctaaccctcgcatacataatcatgacactcctactgctatgggcagctatatgatgggggtgacaccacgagtacccacacgcagataagcttggaagcagaggactgatagcgcagacggacacacaacgaagcgatgcacccaaggcacgcagaccagcgacgtctacacgagcgagagcagcaacgagccgcgcacgaccatgagacaacgacgcagcacctacagatacgactcgagacagagcgacacaaggagccacactgaagcagataaaccggtacatcacacgatgatccacaaacagcatggcacacaacattctgatggacgagcgggttgggtggcaggcctaccacga

SEQ ID NO: 514865 - DNA, 959 bp, Homo sapiens
gagcgggtctagtggtcgcgcaaccggtggctccgggccgccgttgtgaagtgagcgggcctctccctgctgcctgcggcctgcctgggcacctgccgcttggacccctgctgcccgaccctgtgcaggctgccccggaacttgcctgctcgggcaggtccgcggacggtttcggatttctggttcctaaagtccgatttttggacgctgaacaagggcaggcttgtgcgaggggccgagcggagtcctgggaaggcaaggcctgctctgtgcggagcacaaaacgcctttgtgcgaacagacaactaaattcccgcggaaacggccttgaacggtgggactttcaccatattctccacttgaaagcaaatgctgcaaacaaattgtgcattgccgttcaccaaagtgtcggtctttgatgctcataatatcattgctacctaactgctacaacgggacgactggggtcaccagtgtcaacaccgacaggtctacacttggtgttagtcccagtgctgagtcttcaaaggcttcctgggaccttcaaagcaattactttccacccttcagactttcccaaaaattgcttggagattaaccagcattggcagtcttggctctggtacgcccatgggcttgggaaggttgcaagatggacattgcgcaatcactcggcaaatcaactttggcgaaccttacgaggcgtcccccgctgggatttcaacaggttgcatacatacctgtggccgttcaggaccatccacaagagtaacgcctggtgcgcgacttaacataaaggccccccggttggcacaacccaattgccccaaggaccacctatgtttcaattcattgggaaacccctgatgagaatacccccgagttggaacccaggaatgcctttgcgaacacccttggcacaggtaacatcctttcagcgaattccctaaggcatgaac

SEQ ID NO: 514866 - DNA, 1173 bp, Homo sapiens
  misc_feature (366)..(366): n is a, c, g, or t
gacaaggaccctctagtaaatatccattgtgggagatccctcgtgaatatgcctgtcgcaacaggttgatggggtgttgtcgcccctcgcctggtgcaacaaccgtatcagtgcggtggtggaacaccccctctccttcgttgtttctggggtcgtctctctccttcgtctgctaatggaaagaaaggggtgttctcctccccacacgacgcataattggtgcagtaggagtgtgtgtgggctgcttctcatgcgagtccactgtgggcgcaccactggctcctctctagaccctcccggcgcactgtcggcccacacagattacgactctcacttcgtggcacgactgggtgctcgcccacagtntggtgtcgcacacacgacgagtcgctcccacgatctttttcctctagtggcactcccactattctcacacaccactcgcccacagtctgctgagagagtgtctcacattgagactcctcgagagaggaggccctcttctcactcacactgtgtgtcactgtctctctcttgtgggactctcacacagaaacctgctatgcgtggggctgggcgctctctctgcagagagagagatataacagcctcgcacacactgtgtgtgtgagacacacagctgtgtacacacactggtgcgcacacacttgtctccacacacactctctttatttctccgtgttctctctccacacacactctctcacagctgttatagcctctcatctctctccacacaaaccacacacacctctctcgcacaacaagactcttggagcaatcactcccacacacctccacgcatgattatctctccacagcgcacactctcacaatattatctcttttcactccgcctctttgcaccctcgccacactcgtgttcccaccgtaactctttctctcctctcttatattgtaagaccacactctcacgcctctctctcccacacccacacatctgtacacacacactcctccacagaaggcacccgacattctagaaggccatgaaagttgagtgtttgtgaaattcccacgaaaaggagtttcgcccccaggagttcgccccactcactcccacgcgtaagagatggcaggaatggattttgcatgagaattttaaaatataagaatggacacacccaatta

SEQ ID NO: 514867 - DNA, 335 bp, Homo sapiens
ttaaaagatgaaaacaccactatatttctaactcttgagagcttctgttacatttctgggcacttagcatttacttctcagcattttaagttataatttcactgtatatttttcttaatctcccaaagagagattgtacagctcctagcagagcaggtgcttgtactccagtgaatacgatttctctcattagcccagtgaatccaaatgatgaccatcagtgatacattgtcctcaccgagatctacggagctattggctcttctaaccaagcctttaggccacacgtagaacattctagtctagaacttattgcatactaatccccaagctct

SEQ ID NO: 514868 - DNA, 326 bp, Homo sapiens
ggggggaatttaatttttttcccaccacactttttcgcgcatcggggaggccccgaggttttgggggatacccccgagggataccccaccatggaacatcctatcattgggagggtcattcttttttttaacggggggaatattaataatttttttgttttgggaggccttgggtttgaagggaaaagtcttaatagtagaagacccctccataaacttgggggggttatatgggggcccccccccctcccccacatttgaagaaccgggataaataaatttttggcaaaaaagggaaccaaaaaagatacggcctttgattgtta

SEQ ID NO: 514869 - DNA, 244 bp, Homo sapiens
ctactgggataggtagactaaaggaaagatacctgattctagcaaagcagttagcacagggtgcaccctatgcattatataccagacatgccctactaaagaaagtggcactgagctagagagtgggaaaaatagagaaacagttaatttaggaagcgaagagtcttctaggacaacaggcagtgggcaggtcatgtaagatagccccaagtggtgaggcagcaagtacagtgctatctaggac

SEQ ID NO: 514870 - DNA, 370 bp, Homo sapiens
actactactaaaataggcggcggttcgaacgcattggtggctcatgccttgtcatcccaaaaactttgggaggccaaggggggaggattgcttgaggccaggagttcgagaccagcctgttcagcatggcaggacccccatctctacaaaaactaaacagattagctaggtgtggtggtgtgtgcctgtggtcctagctgcttgggaggctgaggcaggcggatagctcgagcacacggagttggaggctgcagtgagccatgattacaccactgcacttgagcctgggcagcagagtgagacctgtctttaaaaaaatagaaaacaaagagcgaaactccatctcaaaaaaaaagtcgacgcggccgcg

SEQ ID NO: 514871 - DNA, 389 bp, Homo sapiens
tactttcacagggattaaaagatttttctcaaaattatatagccaataacaagaagagtagaagtgatcttcaatgttgtccattattttattccccttcttttccacctctttaattaaaacacagccttcaagaccctgcttgaatcccacttcctctgcaaagctctccctccctcccccacagcacatgacatagagcctttcatataccagtatgcaataacagcttgatgactggtgatgatgatcaggtagcaactgtcagcctgtgtggatgccttgtgaccactggataaaggggcaactgcagtggtctggactcaggaaagaagtcccctaggaaggactaggctttgagccaggtcttgaagaaactggtagctgtg

SEQ ID NO: 514872 - DNA, 705 bp, Homo sapiens
gcaaagaaaaagagaagccctcctatgacactgaaacgagatcctagtgagggattgatgaatgttctagaagaaaatttagtgaagatggagacgatgatatgtaagcagaagccatgtagataaagcctgggtggaatcaagagagaagcattgtcgaaaggagactacggaattttgagacttataaaggtcgttgtggggaacgtgtgatgtgatgtggaaatactgatgtttccagttaagggaatatgggtgagctgctatatataaatttgaccaggatagcgtatttacatagccttctaaggtaaaggcaaagaattctccatatcctagctggagggatttatttagattacaagatatgcttatgtaatagcactcctgcaaggatggttgtattagtaccctggtcattctgttcgagggagggttatatgcattctcacgtgaaatatacaaaagcatagtctctgccctatatgaaagcgctagactgtgtgtattgttgtgtccagctaagaattggaaaaggcatcttgcttgccttggaagtagctgacatcagcttgaccagtgtagaacttgagtaaaaactgaagtttgcatggatgcaaatcggtgccggtgctgaaggtgctgtacagatctgaccctttataccaccttgagcagtgtatatgccaggtaccagcactaatc

SEQ ID NO: 514873 - DNA, 210 bp, Homo sapiens
acttacaacgataaaaatagaagttagtttcaataattatttttataattttttcagtgaaaatccacagacaagaacaaaactcatggttctcaaattatactcttatactgattatcagtagttttaggtgtttgggttctgaaattcaatgctaggactgggagtagaggattttattgctaatatatcaggattaggttttgctgc

SEQ ID NO: 514874 - DNA, 200 bp, Homo sapiens
tccccatacccttaagggctgtcaccttagttccaaaaactcatccacaaaggcatttttgcgtagatcaggagaaaaaccactcaaacaattcacacgaaacccagggaccctattattcggcttaggaactttgacgaacggaccaaaactcagcgccggggaccggcaccccaaaaggcggataggaaaaaggggtc

SEQ ID NO: 514875 - DNA, 421 bp, Homo sapiens
gggctgcaggaattgtcacgaggtgccacccacctcctgagctgtgtttgtgaaatgactgcggacaccaagttcttgctgttctccaatctcatcagacagtagaatgtgaggaaaaacttttgcccgactgagttttaaaaaggaaaaaaaaaaaggtttactatgtggccttccaaaataagtagtggttgcctatgtggaaacaacagcgaacttacacccagtgccagagtcctggatgtgccattgggttaagtggtcatgtgtctaatgaacacacgcttgttcaagaacaaacacttaaacgatttgagtataggctggtgtgcaccttttgtgacctgaggaatcccaagcctgtgagaaaagcgttcacattgcagcacatgatgcgcctagcactggtcgtctgtgctgg

SEQ ID NO: 514876 - DNA, 751 bp, Homo sapiens
tctgaggcttattgttcttttttcttaaaagagaaaacttcctcacacctgtaatcccagcactttgggaggccgaggcgggcggatcacgaggtcaggagatccagaccatcctggctaacatggtgaaacaccgtctctactaaaaataccaaaaaaaaaaaaaaaaaaaaaaaaaaactggggggcggcctctcgggccctccggaaaagcgcttttcaaagacccttccggtggggcgcgcgcggggcgcccatgaggggaaagggagacacggggccaaaacgcgggtccccaaagggaaacccggggccatagagacaaagggcgcgggggattctctcaccccaatataaaaaaacgccccggggcgcgcacccccgagaggggtcttcgagacaaaactctccacaagggcgggccccagagagggccaatccacgggcgcctcatatccaccacgggggagcgcccacaagcgcgagagcctctcggatatactacacaattacgcgccccccggctcctcgggggcgcccaccacatacaccccacccacccacacccacacacgccacacccacgaccacactccgcacgcaaagaaaaccaagaaacagtgaggccacaccaaagcactcacaaacaccacacaccaacccccccacacacaccccccacacacacaccccgcccacaaaccacaccacccacgcacaccacaacaccgcgcgaacccccccccgaccc

SEQ ID NO: 514877 - DNA, 827 bp, Homo sapiens
gatcccattacgacgcctctctccctactgttgctacagctagggaacctgagattgacctgcaagacgaacaccatgacagagacctgtatccttcttgcgcactccgtggccgccttgaatcggcttctaactttgtgttctcgaagtacacgagtgaagacgcctgggatcttatgaacttgattcccttcattagcatgggaagagttgctacctcagccttccatattccccttcacgaccaagaggaatgcgatgatgctagagtccagtgagtaggatccgtagaatcgcctctatatgcctgtccacgagctcaatagggactgcctgtgatgactacagactttgcgagaacgcatacgccatggtgtgtatgccaatactagattgctgcctataaatcgctacttcagtgaagcgcctgaaggggccataattgagactgagggaagaaaccaaatctctttttctctggaggctggcacctgattttgtatccccctgtagcagcattactgaaatacataggcttatatacaatgcttctttcctgtatattctcttgtctggctgcacccctttttcccgccccaagattgataggtacctcaaagtgcactgcaggtgtacggtcaccggagagtcaccatatgtgattgtcccataattaactctggtgtgatctttcatcttgtaactctgcttctttgggagccttcgccattttaaatcatggccacctaccaaatggagttctgtcccccattctagtttattgaaatactctaaagaggaacgaaagggcccaactaatttaaccc

SEQ ID NO: 514878 - DNA, 349 bp, Homo sapiens
  misc_feature (83)..(83): n is a, c, g, or t
  misc_feature (109)..(109): n is a, c, g, or t
  misc_feature (115)..(115): n is a, c, g, or t
  misc_feature (125)..(125): n is a, c, g, or t
  misc_feature (173)..(173): n is a, c, g, or t
  misc_feature (183)..(183): n is a, c, g, or t
  misc_feature (312)..(312): n is a, c, g, or t
tcagattgagatgtccacccatatctcactcagggagaagttaatccagtactgccagtccaaaggtcatcgtgggtgaccgncctacagccccctcggctcttcctgnacaggnccctgggcanagtcccgaggtacccttctcttcctgggagggatcccaggatcaaggncgatcgcagnccaagcacaataaaactacagcccaggtcctgatccggttccccatggcagaggaacttggtggtgatccccaagtctgtgacaccagaacgcattgctgagaactttaaggtctttgactttgaactnaggcagccaggatatgaccaccttactcagctacaac

SEQ ID NO: 514879 - DNA, 108 bp, Homo sapiens
tcagcctaaaggcatggacactgtaatatatcttaatgaaaggaccataatcccaatgcagcgtcatctatattctctgataacagccattatgtattcacaggatat

SEQ ID NO: 514880 - DNA, 257 bp, Homo sapiens
gatgggagccaagaaggattgttagcactgctagagtttgctgagagaagatgaaagtgaactatgtcttcatctcttcaggaagggcgagagacagagctcactcctgaggacctccagcttcttgggctttgagattgtacgtcaggccatccttgagtaagcaggtcgaccctcttctttacagctagtgttattctggcatttggtaagctggcttaatctgttaatgtatcagacatttaataggggcattg

SEQ ID NO: 514881 - DNA, 228 bp, Homo sapiens
cagatctcgagaatgagatagaacagatagtaaatgaaatatgtcagagttcagatagaaaagaaaacaggtagacatatggagtatagagataaaaatataaggcaatgttaaatagcactgaaaaaatgggaatattgtaccattttattttaaaagccccatcaatttaaatttctggtggtgcagaagttagaaggtaaagcttgagaagatgagggtgttacg

SEQ ID NO: 514882 - DNA, 500 bp, Homo sapiens
cggtgctgctctccccccccgtgtattcttccttgcccgggcgtcctctccgtttataggctgaggccctcccacatatgcggggggttttttctttaccccgccgcccaaccaaagcgccatctctggggactctctctctcccagcgtccacgcggcaaagggcgcctcccgtcagatgcgtgggggaccccaagagcaacttctggagttatcgcgaacaccgttggcctgtcgccaggtacacagggacgcagttccacaccgcgtggacgttctctccgctatgggttctcacggttcctccctgcctagtggacgtgcccttgtcgcgcgattttcccacaggagtctcccttgtgtgctcttggcttccccccggcagcaggttttgtcccccctggcccaccccccggcgggttaagcgggtctcctcccctcccccttttttttttcctgggggctcaccccaaaattttaaaaaactctgggaaaaaaaa

SEQ ID NO: 514883 - DNA, 148 bp, Homo sapiens
aagtggtgaccgtgagatctgccaggtccccaggctcacctccccgccccgatagtgtcatgatgaatgactgtcttcatgtggcctggggctgtgggtgtgccagtgaggctgggccatgtcacattttgtgtggcagcccaatcca

SEQ ID NO: 514884 - DNA, 152 bp, Homo sapiens
cggccactgtaacggtggggatagagaactccagaatttaatcatcagactccaatcagtccctaaatccacaaaggcagaaataggagctttttatttattcaagtacattttgtttctttcaacttaagcccaaaacgatagtttaatca

SEQ ID NO: 514885 - DNA, 357 bp, Homo sapiens
ttgtgccctcccttcgtcagtaaggctgggcataggatcggtatgaaaatctcatgagaatttgtcaaaaagatgataatgtcagagatgatctccagttttaagttaagcaattaggcaaatttttcttctcttcattatagaatattcatctcaagtttaacatctccagagataaattggatggtacgtacagccatacaacattaaagttatcaatgtgatgtacaaaatctcatcttgctattaacctaacctttactttctttttcttttatatttcactgcatataaaacaagcaggtgtcgagcaggacaggatgcaggaagtagtacctcggagtgctaccactatgt

SEQ ID NO: 514886 - DNA, 924 bp, Homo sapiens
  misc_feature (17)..(17): n is a, c, g, or t
  misc_feature (96)..(96): n is a, c, g, or t
  misc_feature (158)..(158): n is a, c, g, or t
  misc_feature (447)..(447): n is a, c, g, or t
  misc_feature (464)..(464): n is a, c, g, or t
  misc_feature (478)..(478): n is a, c, g, or t
  misc_feature (548)..(548): n is a, c, g, or t
  misc_feature (672)..(672): n is a, c, g, or t
  misc_feature (677)..(678): n is a, c, g, or t
  misc_feature (681)..(682): n is a, c, g, or t
  misc_feature (685)..(693): n is a, c, g, or t
  misc_feature (695)..(696): n is a, c, g, or t
  misc_feature (730)..(730): n is a, c, g, or t
  misc_feature (892)..(892): n is a, c, g, or t
tatggggggttttaaanttttatttcaaaagcttggatagcttcaatatccaggttgtggcaaaatcaggacacgtgtaaaataccttacaatacnttagattcccaaaaggtaccaaaaagtacagtaaaattaacatttccgttacaggaaatgtntgacgcaaataatataaaattaaaaggtgaaaaaaaggtgacactggtttctcctaagatacaatttactctttacaaccagggctccacaggctccaggctgcagagcggcagcaggaagcagagcctccttcacctgctttctgggggacctggtaataaaaatcagcccatgatggcgctagtggcctctcagacaccacacgctgcctaaacaccttagagctctggaaatagttcaacaggagagtgattcccatgggggaaattttaaattaagatgcacatnggacaggcaatagaaantttgccaagttaanatttggtacataattgtgttcactccatatccaaacaaagcatgttgtgcgatcagttggtcgctcctgntgccgcctcagtaatggcttgtagttattctgatggccaccacgtcgctggctcttgccgtagtttgtactaccctgatctccacctccaccaccacctccgctgcctcggttccctcggaaanaaaanncannaannnnnnnnncnnactgctgctgctgatagacttctttgggctgggncaccttgatctcacacttgcttccactgacagtatggaactttttctccagaaccttcttcacgggttcttcttctttaaaggtgataaacacaaaacctcgtctattgttcaactttggatccattgccattccatggcctcaatctccccaactcgccanagtactccctgatcttttcctcagtgcttcag

SEQ ID NO: 514887 - DNA, 1061 bp, Homo sapiens
gctgatctcttcttcttcttctgagagtgtgttctcgcacctgttgtataacacgtgcgtcggttctgcaccctgtttggggattccctgtgggttcccaccaccggggattccggatattccgcggggtgctccccccgttgtttggttctcccccgcccccttgttcccggtttttgttcccctccggagagttttccccgctttttcctagggaccttcccgtttccccctgtaggaaaattccccgatagccagtcttagctttccaatttgaaactgaactccttggaaaggacctggttcacggcttccttaatgcctgagtgaccgttccctatccggaaaattgactaaacgcctgtcctaagctatctctcaagggttcctaaggttttcatatcaaaatttaaagcctaaccactctggatcccctaccagtcacgaggtccgtatctcagcgtgtgaattatagaggcaataccacgagagcacctcttccccctttacctttcggtcccaatcaaatgcactggtgtgacccgaaagttgaagaatcgcggtttaggattggggctagctcgatgaccctaaggcccccacatcgcgggacctcgctttgggcccggatttcttaggacccctcgtttctagccggcccccttctgcccggggtccccgtggccggcattattttcctacgtttctttcttgtagacccctgaggtgcccgcccggggatctgtaggaaggggtccacgggggctaaggatgcacacctctgacgttttgcgccttcctaggagaatcttaacacatgtgttgagaatttcacaccagcacaatgcgagttgtaaaatacccagctctaccagaagctaggctctgtgcacggccatagtttctccagtagctttatccaccaataattccaccaatggagaattatatgaccatggtacgccagaaataggcccttttatgtgttgcttttattttacctccaattgtaaaaatcagggtaatccaataaaatccatccctgcctttctacaccctta

SEQ ID NO: 514888 - DNA, 465 bp, Homo sapiens
  misc_feature (92)..(92): n is a, c, g, or t
  misc_feature (102)..(104): n is a, c, g, or t
  misc_feature (106)..(108): n is a, c, g, or t
aactgctgatttctttggagaatcatccccataaacttctcataaagcatcaatgattttaccattcttccacccagcttcacactaatttnatgttggttnnncnnnaattttagtagaatttatgttgctctgacaggtgctcttttcaaacttacgtcttacctttttagtgcctcaaactacatcctgttcaggcatgttataacaagttagtatgagcttattttggtataaaaaatttggactccataattttttcataatatgcatttttcattaccttttggaagacaactcatatcaccttgagcttcttttcatatgcctattttccatatgtatatcttctttggtgaggtgtccttttcagatgtttgtacatttaaaaatcagttattacccactcccaccacttctattcaacatagtactggaagtactatcaagagagagcaattagac

SEQ ID NO: 514889 - DNA, 214 bp, Homo sapiens
ctaggtggaagtctgttctttctaaaagcaagtctctcaggttctcgctcaatctgttcttcaccagtaggacctcggtctccgtgccatggtttgagggcctgcgctgtgaagttgctgcagctcttaaatgctctcctggcccttggagcagagtatcagctgcgaatggaggacctgcggaaaaccggaggctgtggactcgtcccaaggg

SEQ ID NO: 514890 - DNA, 88 bp, Homo sapiens
ttttaaggaatgtacctgaccacagtgttaatatatatttcttcaaactaattaaatgtacatttctataataaatattttttaaact

SEQ ID NO: 514891 - DNA, 407 bp, Homo sapiens
  misc_feature (227)..(227): n is a, c, g, or t
  misc_feature (361)..(361): n is a, c, g, or t
  misc_feature (381)..(381): n is a, c, g, or t
  misc_feature (397)..(397): n is a, c, g, or t
agtctgggcaacatctccacagaaaataaaaaaattagacaggcatggtggcacacgcctgtggtcctgagtagctgggactacatgcaggcaccaccatgctcggctaattttgtatttttagtagagacagggtttctccatgttggtcaggctggtcttgatctcctgacttcaggtgatccacctgcctcggcctcccaaagtgctgggattacaggcgtacnctttcacctgggccaaaattctgcatttctaataagctcttagggtgatcatattttgaatagccagtccccaaacttcttcatacattaggatatggggttggggcctattatggaacattaccccagcttanttcattttgcctggatggantcagttttggatcccngttcccctaa

SEQ ID NO: 514892 - DNA, 225 bp, Homo sapiens
agtcaacatctgaaacacacatatcttatacagaacactccctaaacagagtgtgggggcgagtggacctggagcttactactgcctccaggacttcccagagacagtatgcttattggggagtggtcctcagtggccctgcaccctactctcattccagaaggcaaggcttagaagtggactcaactcctcaacgcgttctcacacgcgattagggttagtggt

SEQ ID NO: 514893 - DNA, 169 bp, Homo sapiens
atatgagctggctccgcttggcgtagcgcattgtggttaacagcgtgaagtgctgtatgaaaaatcgacaccgcgacgaacaccgacagcggcacgcccgccagcgccagcagcaaaaagaacgggatcgacgtcagcgacgaataccaggagttgcgcacccccagcg

SEQ ID NO: 514894 - DNA, 134 bp, Homo sapiens
  misc_feature (26)..(26): n is a, c, g, or t
  misc_feature (35)..(35): n is a, c, g, or t
  misc_feature (112)..(112): n is a, c, g, or t
ccttcatcggaaatgtgtcatccaantgacgtcancactcgcagcacattcagaaacaagtcaaatttatattctaccgcttgtgcaaaacatattcaacgcaaagaacatntacttacgtcgagtagtttttt

SEQ ID NO: 514895 - DNA, 419 bp, Homo sapiens
tattaagaatatggcgactgggcctgcggcggactccacgttgaaaccggcgactggggctgactccccttctgctagggcgaagagggatcatatggtctccgctggtgatgatagcaagaatattatggccaagggtcgtgatggcatgagggatcagaggtgtactgggcctctgataagggaggagaagataaaagagccacttatgaggaatgtttataatataatgagggctacggcgacttcatctcagatcgggggggctactgatcgcaatgctccccccaaggcgaagattgagtttgctgctcaccctgatcagaggatagaaaaaacgggtccgctcagacgttcagagacccagctaccaagctcaaatatggaaatatgggcataccgggtgacagtgtgaaacg

SEQ ID NO: 514896 - DNA, 133 bp, Homo sapiens
aattaatggactcggtacacaatctggtctacgcccagctgcacgttcaccgtacgacacagttgcgcggatacatcaaccgggcgttgacacccacaactcgtcatgaagcctggtgtgtggatcacgggca

SEQ ID NO: 514897 - DNA, 1127 bp, Homo sapiens
taacggcacgcctgcctcgactcgtccacgccctctgcccagaacgcaaacgcttagcacgccacgcgcctcagctagagacctacacggcgccgctgaactgagctgcggaacaggcgaaatgccgaccaattgcgctgccggcgggctgtgccacctacctacaacaacgcacacttaacactcacgcttccacaggttctcctctcggcactccctaaccccgccacagcacccagcacactgggcttcgccctggctctacgcgcgcccccccacctttcgctgccagcgaacacccccaccttcttcctttgcttcaacacgcaccttctgaagcctcacctgctcctccgaccctacaccacgcgcacaacacctccgcacgcacgttaacaactggccatgcctggtaccccgaaacccacttctccccgcatcttattggtagccccactactcaacagctcctactgcaccaccctccaaagactccaacggcaccatcctcttctcgcaacgcaaacgcccactacaacagctggaccccgtccccaagccctggggcaccccatatctataaactttctcacgaactttcttcatacccactttaggcctacgcttccacgcggaacgcttacttaaaccttctggaaaaccacccaagcccccttcaatggccccttcatcaacggcaccaattccccttcaactggcgcacgcgccccagaccccccaccgtcacgccgcctccccaatctcgagcccctgggggcacacctacgcaccacttaccccaaacagccctttcaaacgaaccgaacactactgcacccaccttcgccccctaacccaccaccggaaacccgccacaagtccaaacctcgccaccgcactggcgccttccaaccggacccacgcccggactcccggacacacagcaaacttcgcacaaagcacacaattaccgctgcacatctgacccccctaacagcgcgctacacctcacagaaatccatcactgtgttcacccaaccgcggccccctcaacagcacaggcctcctcccccacctggtccaccgccccctcccaacgaacatcctctggcaccccacgcacctca

SEQ ID NO: 514898 - DNA, 406 bp, Homo sapiens
ccacagtgtgtgcccatagcatctgtggtcactcaacacactgtgcaggacgtatgggccgattcacccatgcctctccgtggactgcgagcttcctgaggacagggagcttgccctgttcacctaggtggcccttgtcacctagtacaggacccagaacacaggaggtgctctgtgaaagctattggaatgacaagacaaatgtgcctcattcggacagctgggcccctagcacccccatttacttagtcaggagtgtgtgatgaaactggagaaaggctctccgggggcataggggcaaccgaagaaaacgggaataccctagatgggtgttatttgtcagatctaagagtatcctatctgtggatgcgattatggaactcaacttcctttgtgttgagggtgg

SEQ ID NO: 514899 - DNA, 433 bp, Homo sapiens
  misc_feature (395)..(395): n is a, c, g, or t
cacccgcatccgaaaaacccacgcagcgtttaccctgattgttgaccccgacaattcctcatcatcgcctacaacatgacctcgctatttacaatcgcgaatacctcttttggcggcgtgtcatatgcttttttaaaaacagagtagaaatattgcagcgatggataaccgcacatttgcgatatctcattgatcgacaaggtggttgaaatcagcagactgcgcgctttctccagcttctcggcatgaatcatggcatggatggtttcacccacctcttctttaaaacgcttctcaagattggagcgcgagatcccgaccgcatccagtacctgatccactttaatccctttacaggcgtgattacgaatgtaatgcatggcctgaataacggngggatcggtcagcgagcgataatctgttgagcgccggt

SEQ ID NO: 514900 - DNA, 1658 bp, Homo sapiens
  misc_feature (148)..(148): n is a, c, g, or t
  misc_feature (211)..(211): n is a, c, g, or t
atttgttcttcatcagcgagggggtgctcctcatactagtgttgttccacagctcgtccataccagccgcgcgggttggtgtcctacacctactcttcgtttgggaggtgagtccaccacccacgacagtttggtgtggccgcaccanacgttgtgggggcgcgggttgatgacgtatagaagtgtggtgcgtgctcaccacaccccctcnccgcgtgttattgcgccagccctctggtttgtgggcgacgcaccccgctctgttgttcgctctcgcccctactgtgtgtctcccccgcgatagttggtgggaagacccccccaccggtggggcgaccccaccggtacccctcttctggggaggataatattgccggccgtgtcgtggccgccccgtatcacttgttgggctgtggcaaaagaccaacgattaccagcagtggttgggtgtggtcccttcggcgcctcccctgggagaatgttcccccccaccattgtgtgccggaagaggggaagtcgctgtgtacaccaccccttgtgcgccaccgggaaccacgactgttgtggctgtgtgagcaacaacgggggtgtttctccccacccatcgtataggggaaacgacagttgtcgggaggaaaacgaccacatgtttctgtcgagacctctctcttctcattggggggtgtcgcccctcctgttgtgtgcgagtgggcccctcgggccagctgtgctttgccccaccaggggggtttaatatattttggggaacacccccccggtgttttgctaacacaccagcgtgcccactgcccccccacgtggagaccttcatattgtagaagccggtgcgcgttggcctcctaatatggtcttgtgcttctctctcttcatagttttgcgcgccctcgggggccacacacacagggtgacaccctcgcacaccggcgcgcacttgagcgcgagacacccttccctcggccacagatatccctgctctgttgtcccgacacactacacggcgcagcacttcgagcctcttcttttctcggtgtctctcccgacaatgtctccacgcataaattctctaacacacgcggcccacgcccctctcacacgcgagagagtaccaccgcttcttcgagctctcgtgtgggacacatatctgcagaggatatgacccacctcgcttgagatagagaagtgagaattatttctcgtgagctcttctctcttctctatgtaggggatgatacaccatcaagctggtgttcttcatgtgtgcctgcgttcttcaacaccttaccacacgctccacgcgtggtgtccacacccgcgtttctactagccccagcagcgtggagtacctgagaaacacacccgcgagaatctgtggagaatgttatataccacgcgttgccacgctggaacgtcacagaggtatgcttgataaacccacgccctctggttatctgctgccccacgccacttagctgccacgcgattctccacgcccacgctttacgccaccgctttaacctaggacacacacctcggaattctgggggctcactccacaaacacaactttattgcgaaaacagaaaacaaatattttggtcttttaaattgaatgaaaccctaaaccccctgattccatcc

SEQ ID NO: 514901 - DNA, 1193 bp, Homo sapiens
acaggcctaaggagaagcgagtaaccctgttaacccccgccggggccacaggcagcggtggtgtggacctcggtgggacagctaccaagggggaagataagcaggatcgccaacaaggcagaagaacagcaagcgctgagcaaggtggtaattcagaagattacctcccacttatgttctcacaggagcagcttcagtgaacatcttcaacctatgccgtgagcatgcattattttgcagtttattttctcaatgcatcacgcagtttgtaatacctcatatgtatgccaagagccatcacatccaacgtttaaacaaccgaagcaggcaccattcattatagttccagggcatcagcattatgcataggttactgtatatccttgcacagatcacaggtacaggacatatcccggctatagctagcaatttgcacgctttacaacaagagctgcgaaacacagcaagcacaaagcaaaagcagataccaacagtcgggacctatcgaatgatgatccagcaatctagcaacagtaacaaggacaagttatgccacagaataatgcgcaaaatgaccatctactccagagacactgctagaggcaaactcacaagccaccaaatagcagcaatacacacagctacaaaagacaagccccacctaaggagcttcctgcaaaaccaaggcagagaacgacacgaacgacaacagagaagaaaggaggaggcgagaactacgacacgcaacaggacaaggagcacgacagagcacgacgacaactgcgaccgcacagcacaagacacgccaccaggcaacgctataaaacagcctcccgcagaataaccagcactcacgcaacgggacacaactaaccgatgaccccacggatcaccagcgccacaacgccgcaaacgccagcccacaatgtgcacaccacgaccaagccgacatggacaccgagacgtcaagcgtaaaagagcacatacggcaacagaccaactgtcaagagatgagagaactaaccaagacagaccagacctcatactcatcggcaacacaagagacggaaggaaaacaacacaagcaactacaagagtgaacgaacatcgcaaaacagcaccacagcaacaccaagcggcacgaagaacatcaacgaaaccaagccagcaaagaactctacccacacacacac

SEQ ID NO: 514902 - DNA, 168 bp, Homo sapiens
tttttttaaatgagatgaagtgtcattatgttgaccaggctggtctcgaactcctgtcctcaggcaatccttccatcttggcctcccaaaatgctaaaattacaggcgtgacagccacgtccgggcatgatgacagtcttattttaaattattccttttttgtaacaa

SEQ ID NO: 514903 - DNA, 85 bp, Homo sapiens
ctggggaaggggaaagagggaggaaggggaggggcctccatctctaatttcataataaacaaacactttattttgtaaaaaaaaa

SEQ ID NO: 514904 - DNA, 103 bp, Homo sapiens
agtacaaaagcatacgtcttataaggtgaaaaaaaatagaaccatgatatccaactaacagtagcatgtaaatcatgtagagagtgattaaagccaaagtact

SEQ ID NO: 514905 - DNA, 2885 bp, Homo sapiens
ttttcactttaaagagttctgtgagtcagaagtcattttgactgccctcaataaaattagtaatgcaattggtcattttctctttacagattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaaggtaagaaaactttttttctatcatttccatttttaccttctttacacagaattcctcatcaaatgagtgtttctatttaaacttttttcttccatagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgattcactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgaggagtctctttcagtttcattttttctcatcccatgacttccctccgatggt

SEQ ID NO: 514906 - DNA, 124 bp, Homo sapiens
tgtggagactggggtctcacaccctccagaggactgttgggctgcgagctggggccggacgggcgcctccttcgcgggtataaccagttcgcctacgacggtgcaacggattacactcgccctg

SEQ ID NO: 514907 - DNA, 841 bp, Homo sapiens
aaatattcagctcatggttctccccaaaaaaactaaaaagcagctaagcgctgggaacaaatctgacttattgcattttctcagtgggccaaagaaaggagggccgattgactgctttgactttttaaaggtcttctctttgttcacttataaagtgaggaaaacaaattctcggcactggcgtgagagttgagcgtcacaaaagaaagcaaaagaaaatattagtgccattattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggaggtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgacgtcacgtgatccgggatgaggtggagttcggctttaaggaggcgtctcttcctagcttcatcaaatctttaggatctgagcaggagaaataccagcggatcttccccactctgctcccttccattcccacccttccttctttaataagcaggagcgaaaaagacaaattccaaagagggtaagttgcgagtttatgcctttccagagacttctgcgaaatctctcattgacaaggtgaaggatgagagggga

SEQ ID NO: 514908 - DNA, 3466 bp, Homo sapiens
aaatattcagctcatggttctccccaaaaaaactaaaaagcagctaagcgctgggaacaaatctgacttattgcattttctcagtgggccaaagaaaggagggccgattgactgctttgactttttaaaggtcttctctttgttcacttataaagtgaggaaaacaaattctcggcactggcgtgagagttgagcgtcacaaaagaaagcaaaagaaaatattagtgccattattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggaggtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgacgtcacgtgatccgggatgaggtggagttcggctttaaggaggcgtctcttcctagcttcatcaaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgattcactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgaggagtctctttcagtttcattttttctcatcccatgacttccctccgatggt

SEQ ID NO: 514909 - DNA, 603 bp, Homo sapiens
gggagaattagaagtgaagtgtgggcgatagaagtaattctaatgaccaagcttctttatgtgatagagattttatttttgctgtttgcaaattacatacacacacagtatttaatatttgcaaatatatttagtctatagatcacaaaaatgtaaaaacccatattgcttaaaaggctattactactcagtgatatttgaaatctagtgaaaggcttggcaggtgatttggcttattaagtaacttcagagaaatcctattataacacgggtattaggatatgagattaatacctgattatgggctaaatcatttcatgcccagtttttagcagtttctctgctttgtggtctgtgacttgactagtaatatacccatgttttaattttataggaggactctactgtatttaaagttactactgtacctaacagtggtttatgtacttgtactccggggaaattgcaatgtcttcgacttgcaaaccagtctgtgttggtctggttaacctggaatgaattccttgacctcttcactgagtagtctgatagaccctgctatgttgtagttaatgcttgctcatcgtagctcacattttgaac

SEQ ID NO: 514910 - DNA, 3411 bp, Homo sapiens
aaatattcagctcatggttctccccaaaaaaactaaaaagcagctaagcgctgggaacaaatctgacttattgcattttctcagtgggccaaagaaaggagggccgattgactgctttgactttttaaaggtcttctctttgttcacttataaagtgaggaaaacaaattctcggcactggcgtgagagttgagcgtcacaaaagaaagcaaaagaaaatattagtgccattattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggaggtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgacgtcacgtgatccgggatgaggtggagttcggctttaaggaggcgtctcttcctagcttcatcaaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgattcactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttc

SEQ ID NO: 514911 - DNA, 3096 bp, Homo sapiens
aaatattcagctcatggttctccccaaaaaaactaaaaagcagctaagcgctgggaacaaatctgacttattgcattttctcagtgggccaaagaaaggagggccgattgactgctttgactttttaaaggtcttctctttgttcacttataaagtgaggaaaacaaattctcggcactggcgtgagagttgagcgtcacaaaagaaagcaaaagaaaatattagtgccattattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggagattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgattcactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagctttctggcataaatatgtactcaaaaggcatttccgcttacaatttgtagaaacacaaaatgcgttttccatacagcagtgcctatatagtgactgatttttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttc

SEQ ID NO: 514912 - DNA, 1249 bp, Homo sapiens
cgacgctgctgtgtgtggtctcagaggctctgcttccttaggttacaaaacaaaacagggcagaggaaaaagcaaaaaaaaaaaaaaaaaaaaaaaaaaaacaccttggctgggcgcgcgcgccccggcgcctataagaatatccgggaaagcgcttctttaagacaccattccggtgtgggcgcgcgcgcggggccccaggtggtgtaggtggcaccggtgggccataaaggcgtggttccccaaaggagagaacccgggcgccatgagagctaaggtgcgcttgggggtttcctcaccaaattaaaaaaagccgccgggggggacacccacggagctctgttctgagaacaaatctcccagagtggggatgtcccggggaggggccataacaccggggtctcctcatcacacccgggggagcgctgcaacagcgggaaaagcgcctcgagaattatttagataatatttacccccccccccgtcccggtggagagtgccactcagccagacctgactaagacatgacaacctcacgacaaacatcgactaaccatacaacagtacaaacatcagtacaagacacaatcagcaagcaacgatacacacgagtagaagaaacactgatgaaatcagaaccacgactacgaacaatcgatcgacggcaagactaactcaaacgcaatcgcactcacgacacaacgaggagcaggagagcacaagcgagaagaaccagcgaagcgaaagaagaatagaccccggaacaagccaaagagacaggaagagaagacacagaaggaaaagaggcagacagaacgagacaccagaaaagagacgacagaggaaaaggacacacaaaagacagaaagacgaaacagcgaacgaagcggagacaaagaaggagacgagagaaaaaaacaggaaagacgagcaacgagagaacagaacaaaggcaggcaggaggagggacaggagccgaagaacaagacgagcagcaacacagcgcgaccagacagacacagcaaacgcaagaaagcaacgagacgaggaacacggggcgaggagcaacagaccacagagctagacacagggcgaaggcgaccgcagccaagaggcaaggcgccaacgtgccagaccaagacacagacgaagcagcgcggggcgagcccgagcacgagacgacagagagcaacaagacgacggaagcacacgaagcgcgcaggggagcgacagcgcagagacacgacag

SEQ ID NO: 514913 - DNA, 1770 bp, Homo sapiens
aaatattcagctcatggttctccccaaaaaaactaaaaagcagctaagcgctgggaacaaatctgacttattgcattttctcagtgggccaaagaaaggagggccgattgactgctttgactttttaaaggtcttctctttgttcacttataaagtgaggaaaacaaattctcggcactggcgtgagagttgagcgtcacaaaagaaagcaaaagaaaatattagtgccattattgtggcgaatttcatgtttcccagcgagccctttgattcctggtttgggctggcgctcgagctctccagccgggtatgacttcggccacaagatggcactgacctgcaaacaaagaaaagcacagtggcaccgactttttcaagcctcgggaaactgccctgccttccccggagtcgaggactgtggggattagggcttcctttcccctgcgcgggaggtctgtgtcgaataatgtgtggcttctgttggattgcttttctttccaaaattcctaggcaatgcttccccgaggtgtgcacctttgtgaggtgtttgtggggttgggggagcttcaggcgctactcgcgggacgacgtcacgtgatccgggatgaggtggagttcggctttaaggaggcgtctcttcctagcttcatcaaatctttaggatctgagcaggagaaataccagcggatcttccccactctgctcccttccattcccacccttccttctttaataagcaggagcgaaaaagacaaattccaaagaggattgttcagttcaagggaatgaagaattcagaataattttggtaaatggattccaatatggggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaaggtaagaaaactttttttctatcatttccatttttaccttctttacacagaattcctcatcaaatgagtgtttctatttaaacttttttcttccatagaataatacgctcgattatatggtacacactgtcagcccgcggtttcgcctggctat

SEQ ID NO: 514914 - DNA, 212 bp, Homo sapiens
  misc_feature (14)..(14): n is a, c, g, or t
  misc_feature (178)..(178): n is a, c, g, or t
gttaattttttccncagaatttatggactgaatctaatgcttccaaaaaatgttgtttgtttgcaaatatcaaacattgttatgcaagaaattattaattaccccccccccccataataacattgtggtttaagctgtactgaactaaatctgtggaatgcattgtgaactgtaaaancaaagtatcaataaagcttatagacttaaaaaaa

SEQ ID NO: 514915 - DNA, 788 bp, Homo sapiens
gacttccgcttccgatggtgaggtcctccatgcgctattcatgagtcgcctgcaagtttatcgatattggtatcaagttgattgagccgtatgttcagaggaagtttatatggggtggttcagaaggcatcaagatgacttacaggatgtaactacgggatgagcctgtcagagattggtgttaaaaagtttaggatgtacaggtggaaaatcgtacaatgatcagtaacaagatgcacgtgcaatgtggggtccacgaacagcagaagtaggtattgcgtcatatttctttttacccgaaaaagacaccacacagtgatcttaaggtaaatttcggaaggaagcttctttcgtggaacaacctggcttgtcaggatcatgctgttccaggctacccagatagggcgactggtcagtcctaacaaaggactgttgggtcgacacttctgacagcctgatataaacccttgaatatcttgcgactttcgacagccgagtttggctcaaatcgctggggctcgaaagagcacattagcacgggcacaacgtttggtgcgcacattcacggaagaaattcggctgagtccctttgacatttgtgcaccccggaaggtggccaggtctatcgggctccccccacagtagaattacctccaaagttccaacatactgttcggacaaacacccagattggacaccgggattccggaaactaaatcaaagatgtgtacccaaatgtgttcccatcccactgggtgcgagaaccttcaagcagtgcgtgaaagtac

SEQ ID NO: 514916 - DNA, 2250 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514917 - DNA, 110 bp, Homo sapiens
ggccccctgattttaaatttttcattcttccctcgggccgaattcccacgggaaacagcagtgattaacctttagcaataaacgaaagtttaactaagctatactaacca

SEQ ID NO: 514918 - DNA, 495 bp, Homo sapiens
tgccctctactccaagggcaagagctactggagtctttttgaaaataaaagtgttgttacatgtgtgatatgtaagtggcatgtgctaatacacattttctttcttattaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514919 - DNA, 4341 bp, Homo sapiens
ctgctgccccgggctccggaggccagcttcacagagttccagagggctgcagaataatgaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaacaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggactggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggtacgtgttgtcggttctgactatattggaggaaagaggcgatgttcaaatattagctgttaaaaactcaagataaattagaagcttcaagagtgacatttgttttccttgtttttatgctgtttaaagtcccaaagataaaactgatttaatataagtttttttaatgaaatgtcaagaatcctcagccatagtttccatagtctctgatggtctgctatagctgttaggctgacagatactttattgcctataaaaatattctaagcacttactgtcataatcattatagttactattcctttcacttaagcggacacgtaaatgtatgaaatggctataagctcaattctgtttataacctcccttcatcaggatgaattaactgggagaagaaaattggagaagctagacacagtttaatgatgatgtagcccattcttaatgtaaccccctattttaagatctctttgactcttatcccaaattcatgtaacccaaatgattttttttaaagatatagcctgtaacttgatgtggcatttgttgtttatctgcaggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctgtaagcctccttttgttgttatttaaaagtactgtgatttggggagaaaggggaacaagctagagaacagtcttgaaatataaatggtttcggaacccagctgtgatttcaggatgctgttttatcctaatacgtaaagaatggagcgttcaaaagtaagacgctttcacacatgagagaaaattgttaaagcacgtatggcagtagcaagcttttctgttgcaaaatctagtataccttgcttacccaggaggatggttgttaggtggaaatttaaattcataggaaccaacttttggtgcaaaatatgtttgataagacattgaggaattaggtaacagaggagtatattttatataattttggtaagtaagtagttcagaggctacaaactgttgactttttgggcaaatcaagcttttcaaaaaatgttttcttgcaggataccttttaaaaatcagacattttacatgcaagttcagatcacctctttctcttaagacaatagaaaatctgggccgggagtgagccactgcctgtaatcccagcactttgggaggccgaggcgggcagatcacctgaggtcaggaattcgagaccagcctggccaatatggtgaaactccgtctctactaaaaatacaaaaagtagcctagtggtagtgggcacctgtaatccaagttactcagaaggctgaggcaggagatttgcttgagcccgagaggcagaggttgcagtgagcagagattgtgccactgcactctagcgtgggcgacagagcaaggctctgtctcaaaaaaaaaaa

SEQ ID NO: 514920 - DNA, 450 bp, Homo sapiens
gggctgcctgctcccctgcagcgcaaatggctctttgctaaagtggtgggaacagcaagccgccaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514921 - DNA, 941 bp, Homo sapiens
agcggggctctctgagcagcaccatggcggttggcaggaactagcgccttacgaaggggcggcagaacagggatgcctaacgaagataagtggtcgatccattttctaagaaacatggtgtatgtatgtgacataggcacgcgtgccttatggttctacactagtaaagaaagattatagggatataggacgtccgtcggtcgaccaggtagcccgaaggaagccatgaagtgtgcatctggagtggtctgcatgggtcgtgtgttgtgacagtgaggtcattggcgtgcattgtgcgagagatgtatgaagcttgcactattaggaaacatgtctgagctggatgtacgtgaaggatggttcagggttgagaaagaatgcctgcactaacctttccatggccgtatgggagtcctctagcgccagtgacgatggacagtgtgcttccattgggtcaactgagaattgcgcaagagcgaaatgcacttatgatagactcccatcggtgtgacttggtccaagcaaccttagcccggaggtggtggacgttggccgtatcggatcgtgggtgaccttgtgggtgccgggtctgtttgaactcagaaatagagaccgtcgaaactaatttcgaggagtaagcgcgcaagtacacgtcctttatggcgtgctaggcaagcgcaaatcgggcgtcgcagcccagagaatcgccgggggcaatggcaaacggaattgcagtcggggaaacatttgccagttggaaccccccgtacggaggagttggcgaatgttcggaacagtggaccgttggacaaactgcaaaggctggcgctccaagtgaaatctatgattttcgccctgatcaggcacttaggaaaaaacgaaccattaagtcacaacgggcctttggccggaaattcctaattttattcccttcgttccta

SEQ ID NO: 514922 - DNA, 217 bp, Homo sapiens
aaacagcacacttctaaataactctgggtcaaagaagaaatctcaagataaattttttaatattttgaactaaataaaagtgcaaacccaacttatcagaatttgtgggatacagttaaagcagtgattagagagaatttttatagcattggatgcatgtattagaaaacgagaaggttttaaaatcaatcatttaagcctcccccttacaaaacta

SEQ ID NO: 514923 - DNA, 4257 bp, Homo sapiens
ctgctgccccgggctccggaggccagcttcacagagttccagagggctgcagaataatgaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaacaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggactggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagataaagtcgcaaatggagacatttattttcataatgctaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattataaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtcttttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaataaaaaaaaaaaa

SEQ ID NO: 514924 - DNA, 736 bp, Homo sapiens
ggaacaatggtgttgtccaggcattctctgctgtgagcaaggacttgacatgcagcaagatgtgtgtcgttatcagaccgtctcttacaaagtgcactttccttttcacagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccaggtgagagcgtaggcccgtggccacaggccagactttctacggccgattggtcacctgccaagctcttctttttctaaattgagaccatttttcatattaagaatgggatagtatttgagatctgaagaattgggaaaatacactaaaaccagtgttttactggatactag

SEQ ID NO: 514925 - DNA, 108 bp, Homo sapiens
aatgcagcggactcggcacaattttctatatccgtttctcagattatcaggaacatcatccaagctttacattgcgagtaccatatatgaccctcagaacacaagttc

SEQ ID NO: 514926 - DNA, 4093 bp, Homo sapiens
ctgctgccccgggctccggaggccagcttcacagagttccagagggctgcagaataatgaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaacaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggactggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagataaagtcgcaaatggagacatttattttcataatgctaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattataaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtcttttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaataaaaaaaaaaaa

SEQ ID NO: 514927 - DNA, 2318 bp, Homo sapiens
gagacggatcgtttggctcatgttagttgtagaaggtctaattcaagagtgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514928 - DNA, 4215 bp, Homo sapiens
ctgctgccccgggctccggaggccagcttcacagagttccagagggctgcagaataatgaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaacaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggactggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaaaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattataaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtcttttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaataaaaaaaaaaaa

SEQ ID NO: 514929 - DNA, 5322 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514930 - DNA, 155 bp, Homo sapiens
gctctgtgcgtagttgtgttagtgggtttgtccgttgcgttcgtgctccgggttgttcttagtagtgcttgctctcttttggggcgtgcttctttttcgcttccttctcgggtgtgggtttcgggtttttgtccccctttgttcctgtttttctg

SEQ ID NO: 514931 - DNA, 178 bp, Homo sapiens
cgcatctcttgatagggggtggagttgccccatccacacctgatggggtgtactcggaaggtggaatgagagacttaggagagaaaacgacacagagacaaagtatagagaaagaaataaggggacccaggggaaccagacgctcaccaatagtggatggatcccggccagcgctctg

SEQ ID NO: 514932 - DNA, 4154 bp, Homo sapiens
ctgctgccccgggctccggaggccagcttcacagagttccagagggctgcagaataatgaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaacaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggactggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaaaaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattataaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtcttttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaataaaaaaaaaaaa

SEQ ID NO: 514933 - DNA, 5366 bp, Homo sapiens
gagacggatcgtttggctcatgttagttgtagaaggtctaattcaagagtgagtaccatcttacactttctagaagtctgttacttaaaatgttttctttcttctaggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514934 - DNA, 415 bp, Homo sapiens
cgtcgacggagaagctgaggaaggggagtgaccatgagtgcagctggggaggaggagtagctgaggcaggggagtgaccctgagtgcagctggggaggaggagaggagaagctgaggcaggggagtgactctgagtgcagctggggtggaggagaggagaagctgaggcaggggagtgaccctgagtgcagctggggtggaggagaagctgaggcaggggagtgaccctgagtgaacctggggaggaggagaggagaagctgaggcaggggagtgcagcgttcacatgagatgacggattctgggacttgccctgcaggtgaccatggccccaagccataacccattactatattttgagaaagttccagaagagggaggaaggagagggagaaggtcgacgcggccgcgaattt

SEQ ID NO: 514935 - DNA, 4587 bp, Homo sapiens
  misc_feature (391)..(391): n is a, c, g, or t
aatagaagcagcacaatgagagcatctgcggcgagagtaacagcaagggttgcggtcccgtcactgcagagaactcctgtaagaaatggcagcagaaggaaaagggaaatgcctagtcctagtaatgagggcacttccagttaaatgacagggtgtgacttcatacctgctgaggcagagaagcagaattgaatgacgagactcagtcttggtgagcacgtgaggattcctggggccacgttagtggcacagttcttttggaagatacttgtaagtttacatcagaagctgcgaaattacagattcttctgattaagtaattcttgtgggaggctaagcattaactaaattacgaaaacctcggttagccaagtcatcgcagatgggtccntctatctgcctgctgtgtgcctgcacgtttcctttccagagaagccccggagagggactttggttggtccccactccagagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514936 - DNA, 102 bp, Homo sapiens
tgtgcaaaggggtcttacgaagctgggaacctctatgtgagagattagcactgtagacattctggaagaatccaggcacacagattttcatacgaacctcgt

SEQ ID NO: 514937 - DNA, 792 bp, Homo sapiens
  misc_feature (9)..(9): n is a, c, g, or t
gatccccgngctgcaggattcggcacgagctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatata

SEQ ID NO: 514938 - DNA, 5991 bp, Homo sapiens
ctctgattttaatcagttctgcgtttgaaaggaaacccggtgatatccgacatccaaagcacgtccaacagacggatgtggctgcgacactggcgatagcacttggcttaccgattccaaaagacagtgtagggagcctcctattcccagttgtggaaggaagaccaatgagagagcagttgagatttttacatttgaatacagtgcagcttagtaaactgttgcaagagaatgtgccgtcatatgaaaaagatcctgggtttgagcagtttaaaatgtcagaaagattgcatgggaactggatcagactgtacttggaggaaaagcattcagaagtcctattcaacctgggctccaaggttctcaggcagtacctggatgctctgaagacgctgagcttgtccctgagtgcacaagtggcccagtacgacatctattcgatgatggtggggactgtcgtggttttggaggttctcaccctgctcctgctcagcgtcccacaggcactgcgcagaaaggctgagctggaagtcccactgtcatctcctgggttttctctgctcttttatttggtgatcctggttctttcggccgttcacgtcattgtgtgcacctcagctgaaagttcgtgctacttctgtggcctctcgtggctggcggcaggtggggtgatggtgctggcctcggcgctgctgtgtgtgattgtgtctgttctgaccaacgtgctcgtgggtggaaacaccccaaggaagaaccccatgcatcccagctcaaggtggtcagagctagaccttcttattctgttggggacggcgggccacgtcttgagcctgggcgccagcagcttcgtggaggaggagcaccagacctggtacttccttgtgaacaccctgtgtctagctctgagccaagaaacctacagaaactactttctgggagatgacggtgagcctccgtgtggcctctgtgtggaacaagggcatgacggggccacagcagcgtggcaggacgggcctggctgtgatgtcctggagcgagacaaaggccacggaagcccctctacctccgaagtgctcagaggccgcgagaagtggatggtgctggccagtccgtggctaatactggcctgctgccggctgctgcgctccctaaaccagacaggtgtgcagtgggctcaccggcctgacctcggccactggctcaccagctctgaccacaaagccgagctctctgtcctggctgccctctccctcctcgtagtttttgtgctggtgcagagggggtgctcccctgtgtccaaggctgccctggcgctggggctgctgggcgtctactgctaccgggcggccatcgggagtgtccggttcccgtggcggccggacagcaaggacatttccaagggtattattgaagctcgttttgtttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagcatttagcctcttgattcagactctaatgactaaattcatctggaagcccctgagacacgatgcagctgagattactgtgatgcattattggtttggtcaagcattcttctattttcaggtaggttttcattattatcatgggtagtagacttcatgttttacatatttattttaaatttttctttgagaaaatgttcccataagttggaaagtgactgtcagtgtggcatggtgaattacgctgaactctcgtgtattttataagacaaagtacagccggttgtttaagacacgcgtcccaggtgtggatgtgtgggtgcttaagacagcagactgctgctttgctgggccaggcctgggtttatttattacaagcagttcaggaagcacagacatcacgttgttcacttgcttcactgatgaatgtaataattgttctcgttcatgccctttgcccctggtgtcggggctgtccacactggggaccattggtgcccccatgattattagctccctgaagcctggtgggtcgtcagggcttctgtccggtgtttaaagacccatcccagacaagcccaaaccacctcagtttgaagagacatagagggacaggcagacggggcctcagagggatccagcctcatccagcctcccggcaacctcaggagagcaggccagatggggcctcagagggatccagcctcatccagcctcccggcaacctcaggagagcaggcacagccctgctggttcccttccagtgccgactcccaggctgagtcgctttgcagcagctgaacgtcgtggttgcattttggtctctaccgtgaggtctgtattttcttggtgtgcaccggtgtctgcctgtccgctgtctcgtacccaggaggcatgtgcagttctttgtgtccctacagggcctctcttccatcctcttctcctttcctggtgctcccagcctttcccatggaacagcccacagttgcaggattttctgtctttatgtctgtccccctgatcctgaagcccaaaggtggtaggcgtgaagttacagaagtctgtgtcttcaggtacaatgagtaggtggccaatggccagcttcttagccccgtcctggtgcttccccgacccttctgatccgctcaggcccctgtcctcctcgtacacagctgcagctctccctgccatgtccacgcaaggcacaagggtgtccccagcagaactgcaggcctggatgctggtatccagcacgttcaagccaggtggcctccggcaggctcttgccacaccttcgtttccttatctgtaaaccagggatagtggtctcccggcctccccaggacccagccctccctggtctccccacctccccgtggcccctgttttgaggctgagtccgctgcccctcagtgttagatctcctctgagaggaacctgtggctttgctgcccatccctacttcctgccctcgactgggcagttccttaacagatcagggatcaggaacatgactgcccttgctcatctgctggccctccacatttgcccagtccctgggtctctctgcctccgtttcctccctgtttgatgaggataatcacgaagcacatcaggactgttgggttagatgaagtcatgcaggtaaagctgctgtgcagctgcagacatgtcagcatggctggcagtctctgtgcttggctgagcctgctcagagccacagtgacctcctaggtgtcctcctcccctgctcccatcgtggcatctgggactctgtccccctgccaccctccagggtctcctactgcttctgcctgtttgctctctcctcagtctccctgcagaagagcttccaagtggaggagacacatgactggggtggcaccgtccaagagaggcagtagctgcgagtccagtgggtctcagggcaagccaagtcaaagggctggggcctaagacaacagggataggagtcaatgcacatctgtgagataatggggaagcagcatcaacatgacttggggaccccctgggcccacagctctctgcatggaaagggaggaaggagccaagctggtgagcacccagccagtgttttgtggacatgaacagttctggttctggagagggatcttcgttgagcttgatagagacatgtgctgtcggactgtagatgtcatgagtttctgaggaaaggtcagcatgacaggcaagtgacagacatcagagtcagtaaagatggagcgtggggaggcggggcctgggagcagagaggaggggcctaggaatggagaggtggggcctaggagtggaagggtgtggtcttggagtggagaggcggggcctgggagcagagaggaggggcctaggaatggagaggtagggcctaggagtggaaaggtgtggtcttggagtggagaggcggggcctgcgcggagaggcagggtctctcagaagacccctttttgggatccagaatcactaggagcagggtaagctgtgtggcatcagcgcttgcatcctgcagggagttacctaccagggctgggccgggactggccagaaccttgacagatgaagtttgaccagaccaagtgagtcctcatggtctgatacgtaagccagatgtgagttaccaatttgcaccaggggctgtgctcccccagtggctggcctgccctccaccatataacccactggcagcacctcaccgtagatgggacctggctgggtgcccgttctagtcttcagcccagctccccgcttggctgggcccagcagctggcctctcagggccctatgcgcccctcggatgggggtccttgaggggagcttcatgtgcttgtcttaagtcgatgggtctggacaagggtcttagatgtggcacagtcagccagccggtctgtgtgtgcgtccctcttcagagggggccccagcttctgcacggtccgctcacgtgcccttccgcagcctgggcactgcaggcagggggagggggtgccacccaggcaaggccagctcggcagtctgaaggaacggctgggcagccacctctgaccacacgtgtgtccgtgccggcgtggttatctgggctgcctacacagttcacgctaacatcgtagctcacgctaacatcgtggctgttgatgccacgtgttgtgaggcctttgtcagctcttctcctgtattccagggcaactccaacaacattgccaccgtggacatctccgcaggcttcgtgggcttagacacctacgtggaaatcccagccgtgctcctgacagcgtttgggacgtacgcagggcctgtgctgtgggccagccacttagtgcacttcctgagctcagaaacacgcagtggttcagcactgagtcatgcttgcttctgctacgcactgatttgttctattccagttttcacgtacatcgttttggtgacatctctgcgttatcatttatttatatggagtgtattttctccaaaacttctctacgagggaatgcacctgctcattacagctgctgtctgtgtattcttcacggcaatggatcaaaccagactcacacagtcttagactaagctgaacactggaaaaataatacatgcttaaagtctgctgttattctaaaatgaaagatatgaattcaacaaagttgatggataactttctttgactgctctacctgaatttagactaagcagtaaatagtttaataaaagatcactttaatatacagtttgtatcatattttcccccattgacaatcactctagaagcttctgaacttttaatttcctctgaataagctatggtgtgacccaaatatgtgtgtttaaatcaatgaatgaaaaggttctggactttgttagagtccaggagctctgtgggaggaggcacccagattaccttagggagcacagagctcttagaatcctacaaaccactgagggccccaaggcgctttggtttatgagggttacatgtatcagtgtttatggcatttgagatgaaaactaagataaaaaagtattcatttataaggaatctattgcatattaatgaaacacttgaaggaaaagtaactatattttccaaaacaaaaaaattcagtgagacccagcactttgggaggccagagtgggggtatcacttgagcccaggtgtttgagatcagcctgggaaacatagtgagaccctcatctctccaaaaacttcaaaaaattagctgggcgtgatggcacacacctgtggtcccagctactcaggtggctgaggaaagagtattgtttcagccgagttcaaggctgcagtgagccatgattgtaccactgtactccagccaggacaacagagtgagactcttgtctttaaaatgaaaaaataaatgtttaatgagaaaaaa

SEQ ID NO: 514939 - DNA, 919 bp, Homo sapiens
  misc_feature (331)..(331): n is a, c, g, or t
  misc_feature (376)..(376): n is a, c, g, or t
  misc_feature (491)..(491): n is a, c, g, or t
tggatgggtccagtggtttatttagaaacacctgggatttggttcaagaacagtgtggggggtgtgctttcacacctttttccagcggggaagtgggtgcgtgggagggtgaataggcgagcatttctcaccatttccttcgagcaacgagagagggtgagaggcttccttcaacctcgagcagagccacaaatatgtgtggagggcgacgaggtgtgggcgcgagggacacagagggcagaagaggacatatctcccaagagcgcaatatctcaatatacagaagagagaggtgtaaaacacagtgaacttcccacacacatattcactntacagagtggacagggtgtgcgggagctgcctgtgacgtgtgtgnctctcacgtgtggccctgtgcgtatacagtgtgctcactgttggctctctctctgtgtggggctcctctctctatacccacagctctctcacacctctctaaaagacatatctcnctatacaggtgaagatctctctcacacaggagtagacgcccaagccacgagggggacatatatatcccctatatacccatctagagcgggggcaacacatattacacacagagggacacacagcgcgccacagagagaggagagagagtggcacagaaagggcattaggcgagcgggcaagagagtcccagagagacaagagaccccaaactgttacccacagagaagagtgcccgcgcgagtgagaagaggctaccaaccagcagggtgtgagtgcgggtacacacacaagagggggagacacagaagcagacgatctacaccaccccacgaaggggggccccccaaaaaaaaccacaagaagaagtgtgtgccgcgtaagagaaggctcccaaaaagctactacagcatttcaacacttctgacgg

SEQ ID NO: 514940 - DNA, 713 bp, Homo sapiens
  misc_feature (182)..(182): n is a, c, g, or t
  misc_feature (196)..(196): n is a, c, g, or t
  misc_feature (202)..(202): n is a, c, g, or t
  misc_feature (205)..(205): n is a, c, g, or t
  misc_feature (207)..(207): n is a, c, g, or t
  misc_feature (211)..(211): n is a, c, g, or t
  misc_feature (217)..(217): n is a, c, g, or t
  misc_feature (228)..(228): n is a, c, g, or t
  misc_feature (275)..(275): n is a, c, g, or t
  misc_feature (618)..(618): n is a, c, g, or t
  misc_feature (707)..(707): n is a, c, g, or t
  misc_feature (711)..(711): n is a, c, g, or t
ttttttttgtatttttagtagaggtggggtttcaccatattggtcaggctggtctcgaactcctgacctcaggtgatccgcccacctcggcctcccaaagtgctgggattacaggcgtgaggcaccgtgcccggcctctattttcatattctattaaactattattggtcaggtacatgtgngttagatttattgnataatngantngtancacctntaaacatggtngaaaatgcttccaaatccaacatccttacatttcagagtactcttcncaatttaatattcttgatttgaccaagaatattaaatgggtttaggggttgccatctctacattatttttcagtctttaagtgtaatactctttatattcttaagattttagatttttaaagattatcttaatctttttaagatttaagattattggtaaaacttgaaatgtaagaaacacaatcaaaactgtgcactgtgtatttatacttaatataaatgtatcctacaacagaaacacaacacatttctccatgaagcatattgagatggaataaaaatggatagatctataactcgttagaacatcaacattcagactaatctcagaagcctttcttcntcaatatctccacataatttggatgtatactgacaaagaatgctgatagctttgagactgtggaggtacctcctctccgtggccgaatnctgnca

SEQ ID NO: 514941 - DNA, 338 bp, Homo sapiens
tgagggctcatagccgcatcagcgcaggccccgaccagggtagaccaaccggcccggcgtcattccagcggggggtgctgatgccctggggcgcagacttccccgatccgtgactgaattggcgtggaacgaggaatttggtgccctgaaaggcccacccggactcccgggcagatggagaccgtttgttaaggggcaatcatgttgcgggggccatgcgggtgttcaccacccccatgcacacgccatttgtgtaacttcagaatttgttatgtggctccatgtaacacacaatacatgcatgcactgtgaaaaaaaaaatgaatgtttaaaaagta

SEQ ID NO: 514942 - DNA, 428 bp, Homo sapiens
ctctatcatcggctgaaacgatggaaggtgtggaagagaagaacaaggaggctcctgctgggccagaaacgctttagaaaaagccaacgaattatccagagctgacaatcaagcgcctgagaaagaggttaggccaaatgatgctgtagaaggtacggaggaagcttatgtatcaagaagcaaagcactatcacaaggaataaaggcagacgtgcagaactgaaattagaatggcaaggatggcaaggctgaccacatatatggacctcgcaaacccatattggcgcttgtcatcagaatcagaagtatcaatggagtgagcccaaaggttcgaaaggtgttgcatatacttcgccttggtcaaatcttcaatggaacctttgggaaactcaacggcttccatcatgctgaggattgtagagccattc

SEQ ID NO: 514943 - DNA, 854 bp, Homo sapiens
  misc_feature (273)..(273): n is a, c, g, or t
gtccgtgatgtgaaaatcgactggaatgaagaatgcaagagccccaacgaagggtcggtgctctggccacatctctaagtgcccgaagttacgctcaggtagcgctcgcgcgatgagctcgacccagtccttccaccgactctcggtctgtgtgtatggcaacaatctccatgggcaacagtgaggtgaaccttcatggctggctagggaacctgggggtggagactctgggctccctgttccgtcactgaccatccatggacctaatcaggnactcgtggatgactacgtgggaggcgatcatacccgttttcgccaggaagcatagctgagaagacatcagtcaggctatccctggtgaaaggtcagtaacttcccgttacgtaacgacgcatgtggactggcacggaacggccacagcaccaagccaatcaagaccatcttcacgtacgagctcatcgtgagtccgagcaagcacacacgactgctgcactcaggtctccacgacgcgtttcatgtcccgcatgccacaatcgtgccgcaacttcgtcacgtcatatcaccgatcaccatgaggaacatcatgaggcagccacgcacgatcgacatgtcctttccagaatgacttgagcacataaccgtccgagcgtcccagtgtgccttccccgaacatcttgcaaagcccggtcgagcagcaagcaactgccgtggctccatggaaccggctcgccaaaacatggcttcaatgccctgatagtcggccgaaagaccatctgtgtcgcaaccatgtcccatcacagtcccttccttcgtcacagttcaaacgcacagcgcaggtacacaagagtcaggat

SEQ ID NO: 514944 - DNA, 993 bp, Homo sapiens
atgatcccaatatgtaaaagtaagcccggtaataaaattaacttgaagccgagctgcaattcattgcggagcctcgcacgcgatcccactccaacgatctgtccgcagtgagtgaatgcgtgttcgaggctcagatccattggcgcgcatgcggtgaatgcgcatccagagtcagccagcagagagtaatacgcatagtccatgtcactactcaccaggaggcgtcaaacgaggttctgcatcaaatcgcccacagtcactccgagacgtaaactatatgggctgaactcgatccgcgtaccttcgagcgccgaattggcagcgcgtcatatattctttatcgtgctctcttcgcttacacgatcgggcgaggtcctatagttacggatcagtttctcttactcatgaacactctgaaacgatctggcaattatcgctcctgctttgcaagctaatatgcaatcgagcctttgcatcaggctatgtcgctactccgatgcagggccagaatactcattcttgagggggaccacgagtagagttacaatacttactagtccgccgatcccgagtacacttgtggaccagaccataggttcaagtgaaatctgaaggaaggcgtactcagttatgacatggtccctaagcctgtcacacgtaattctaataccgttatcagcttgcagtcatggcgcacttcagtatagttggcaagccgcttagtcaggcatcgtaccaaggctccttatgtcgttgtgcacggaaaacgggggagtcaatgagagaacccacctaatgaaatacatccgttccccaatttcgcgaatttagaacgtcagcattttccagacaccttttaagttaacagcaaagtcatacaagtaacgtccccctcggggcgattaacttgtcgtctttccagtgtcattcatccgttaagtgaacactttgaagcactaaatgcctcaaccagaacactcctaagggacccaa

SEQ ID NO: 514945 - DNA, 675 bp, Homo sapiens
cctctgtacactgttgatggggatgtaaattagtacaaccactatggagaacagtctggaggtttctttaaaatcttgaaaatagagctaccatatgatccagcaatcctactgctgggtatatacccaaaggaaagaaaatcaggatattgaagagatatctgcactcctatgtttgttgcagcagtgttcacaatagccaagatttggaagcagcctaagtgtccgtcaacagatgaatggataaagaaaatgtggtacttatagacaaagcagtactattcagccacgaaaagaatgagatcctatcataatgacgtccagttccatccaacaacatggatgtcattacgttaagtgaaataagccaggcacagaaagacaaacattgcatgttctcagtcatttgtgggatataaaaatcaaaacaatagaactcgtggaactagaggatagaaggatggttacttacaggctggaaagtgtgggtggggagccatggggaggtgggaatggttaatgggggaaaaagtcggaaagaatgagtaagacctagtattgatagtacaacagtgggactatagtcagtaataattcattattcgtttaaagtactaaaagggtataatggggtgtagtaacataaagaataatgtctaagggatagatacccag

SEQ ID NO: 514946 - DNA, 251 bp, Homo sapiens
agtatgcttcgggattacaggcattagccattatagcctggctaaattttttctgtattttcagtacagactgtgttttaccatgttgcctaggcaggtctagaacttctgatctcaagtgatctgcctgcctcgagcctcccaaagtgttgggattataggcgtaagccaccatgcctcagccccaagtttggtaatattcatgtatcataccgagaagctgggagaagctgtggaggccgtggtaccga

SEQ ID NO: 514947 - DNA, 249 bp, Homo sapiens
agtcttgaaactaccatccgtatagagccggatctggacttgtgctgatttcccttcaaatgttaatatgcaactatgttggggtatgaaatacatcgctatggacagtattcttgaagaggatgttcgtgcgcaattactagtcgatgaaatgagcactatccagagcaatatgattacctacgcaactgcattcggtcagattaaagtcatgggtaaaatctcccataaacttaaaaagatgggact

SEQ ID NO: 514948 - DNA, 179 bp, Homo sapiens
  misc_feature (166)..(166): n is a, c, g, or t
gacagacaaggggactgagctgagccctgagtccctgaacctcccagctcagcccccacagcaggactgaactcaaagtcagagggtggagactccagaaccacccacacacggttggggacagacaggaaacagaaataccgtctgactgtcgtgcaggggatgncggccgcaagctc

SEQ ID NO: 514949 - DNA, 216 bp, Homo sapiens
tgtccatgtatctggatcgcagaatgaacgggagtgtgtatcagcaggaaggctttagattagatacaatgaagattatccattacaaaaattttatattcgactagccggtacagtgattcggaaaaaggagacttctgggctcagttttcactatatgtccaaggtcagtgggggataaatgcgattgtgattcactggtagggttttagaact

SEQ ID NO: 514950 - DNA, 139 bp, Homo sapiens
cgtggagtattagctcggaaaatccaaaaggtgacaacttggttggaccttttaaagctgaagagagttgtcactagctttttcctgtcgttgaaaatacagagctggctgtcttccatcgatgaaacagacaatacaa

SEQ ID NO: 514951 - DNA, 646 bp, Homo sapiens
ggttcctcaagtgattaactggataaacttgatacatgacgcaaattgttccctaacccaccctgaggcacagttaaagggaacactggtaggaggcacacgaggggctgaaagccttcctgggccctttcttcatagtcccggttcctgggaagccactggtttttttgggtgacaccagatggacccatattcccatgcaccttgatcatgaccgggacatggactgggtttccaaccccgctcccaggccacaagccaatgtccaccagtctgccttcaatgactggttcaagtggacacctccaacttcccagattgagcaccatctttttcccacgatgcctcgacaccattacccccaagtggctcccctggtgcagtccttgtgtgcccagcatggcatagagtacccagtcccagcccctgctgtcagccttcgccgacatcatccactccactaaaggagtcagggcagctctggctagatgcctatcttcacccataccacagccaaccctgccccgtttggaagaagaggaggaagacttttggagcccaagcagaggggagcttgagggaccatgcccctatagtttaatactcagagggggttgggtttggggacataaagcctctgactcca

SEQ ID NO: 514952 - DNA, 222 bp, Homo sapiens
aaaatatgaaacgagagagctgaacagtgagacgtggacgatagacaacacctgaggcgtgacagactacgatgataaccatctgcgagccagcaagagttggcgatgcagacgctgttaacagagagagtatataccatgcaaagtgtgtgagtagatagcatcgtgtaactgctgtgacctaacactgcaatagcgtacgagcgaagcatgcgactgtcg

SEQ ID NO: 514953 - DNA, 938 bp, Homo sapiens
cttgggcagatttgctgcccaccacacggggccgccagattccggccgacacaagctggggggggtgcacccaccaacaaaaggcaccaatggggtggcatatacccagggaccgcactgtgggaaaaacgttcgacgaaatcaccgagctaccagatcggggggagccaccaacaatcctgatctatctgggaggggggggaatgtaacacgtcgctccctaagttgcagcgcacaagggatctccgcccgccccggaatcctcccctcgccggtatgtcgggcgacaccaagaaaactcgcctgctgtggttcgccaaccgtgctctgcacaccagacgggctgatccaaaatctcacgccgggttccgcaggccaacatgttgggccaacagcgaggacgcacgcacaccgctggggcgaccacaaaggacccgccaattacttgaccggcggggggggaaaccaaaccacggagtggtctgggtcccgagatatccccacacggagggtatccacgggggcctcggcgagagagtgccctccttgcgcgagccacccggcgcggagggtggtgcgacgcaccccctcccccggcggagaggattatccgccacccaacaacattcgtcgtcggggcgatcccccgagggggggcacaaggagtttcccccccacggcgagatctcgtgtggccccccatggtgccaccacagcgaagcaggtcacccacaaaacagttattcccggggcaaagttgttgatgccccccaggaagaacaaggccccgcgaggtggtaacaccccacgggcgaatcaaaatacatcggcatgcgaataaaggacacaccccacttgaagctgccccccacggaagaaccccccggggccctcgcccctttttaacccaaaaaagcgccccggtcttccaaaaataa

SEQ ID NO: 514954 - DNA, 354 bp, Homo sapiens
tgggcggatggcttgagtccaggagtttgagaccaacctgggcagcatggcaagaccctgtctccacaaaaaatacacacacaaggccgggcacagtggctcacacctgtaatcccagtagtttgggaggctgaggcagttggatcacctgagcccaggagacagaggttgcagtgagccaagattgcaccactgcactccagcctgggcgacagagtgagaccctgcctcaaaaactaaaaataaaaaatgaacagtgtccaacaccttgaaagcgttccgcatgactgaacgatcactgttacgtgattaccaacatgacgaccccacttctcttggccttgccatatgcaa

SEQ ID NO: 514955 - DNA, 336 bp, Homo sapiens
tggagaggatccccccaatcgtgctcacaaatgacagtgaatttaatcaataaatgttgtgtgtgttctaactgttcccctgactggctattcccctgtctatctctctctcctctttggattttcctattacctgagacacaacaatactgaaattaggccaattaataaccctacaatggcccataagcattcaagtaaaaggaaatatcacatgtctctcattttaaatcaaaagctaaaaatgactaagctctgtgcggaggcatgttgaaaaccaagataggacaaaagctagacctcttgcattagttagccaagttgtgagagcgttgg

SEQ ID NO: 514956 - DNA, 885 bp, Homo sapiens
  misc_feature (62)..(62): n is a, c, g, or t
  misc_feature (154)..(154): n is a, c, g, or t
  misc_feature (160)..(160): n is a, c, g, or t
  misc_feature (165)..(165): n is a, c, g, or t
  misc_feature (177)..(177): n is a, c, g, or t
  misc_feature (192)..(192): n is a, c, g, or t
  misc_feature (207)..(207): n is a, c, g, or t
  misc_feature (219)..(219): n is a, c, g, or t
  misc_feature (228)..(228): n is a, c, g, or t
  misc_feature (235)..(235): n is a, c, g, or t
  misc_feature (239)..(239): n is a, c, g, or t
  misc_feature (310)..(310): n is a, c, g, or t
  misc_feature (314)..(314): n is a, c, g, or t
  misc_feature (319)..(319): n is a, c, g, or t
  misc_feature (347)..(347): n is a, c, g, or t
  misc_feature (354)..(354): n is a, c, g, or t
  misc_feature (372)..(372): n is a, c, g, or t
  misc_feature (378)..(378): n is a, c, g, or t
  misc_feature (450)..(450): n is a, c, g, or t
  misc_feature (469)..(469): n is a, c, g, or t
  misc_feature (471)..(471): n is a, c, g, or t
  misc_feature (474)..(474): n is a, c, g, or t
  misc_feature (480)..(480): n is a, c, g, or t
  misc_feature (523)..(523): n is a, c, g, or t
  misc_feature (525)..(525): n is a, c, g, or t
  misc_feature (527)..(527): n is a, c, g, or t
  misc_feature (543)..(543): n is a, c, g, or t
  misc_feature (549)..(549): n is a, c, g, or t
  misc_feature (660)..(660): n is a, c, g, or t
  misc_feature (707)..(707): n is a, c, g, or t
agcttccaaaaaattaaaaaaatgaaaaatatattattgctaatattgtgtgtttttctagntaagtcccaaggtgtcaagaaaatgaggagggtttcttcagtgcacgtggtcatcgaacccttgaggaagaagagagaagaggctcccaggntgaggnctgcnccaacgcccatnagtggaggtggctancgggctcgtccagcnaaagaagctgcnaatcaaaanaaagtanaaanaaaagcccctgatgctggaggctgtcttcacgctgaaccagacctgggggtgttgtgtcctaaaggatgtnagtngcaanaggctttgctaaaaaaggaaaggcaaanaagaaanagtgttgatgagttaaanaaaaangtggaagatgtttcccagaaatcctcttcttcctttcagtaaatgtatttgctgaaagaactgtggaaaaanaggaagaagaaagtaaaananaangaaaangtagtaaatgagtaatcctcagaaatggaaaagaacaaattanananagatgagaatgtgaanagaaanatcccaaataaacttcgtgtgcttcgttcaatcctggaaaacctgagaagcaaaatacaaaagttagaatctgatgtctcagctcaaatggaatattgtcgcaccccatgnactgtcagttgcaatattcctgtggtgtctggcaaagaatgtgaggnaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacaggga

SEQ ID NO: 514957 - DNA, 210 bp, Homo sapiens
aacgggggcaggacccagcctgcctagttccctgttgtttgttcccctgctggggccattggtgccatttcctcccctggttgaaggcctccccccatgccctttgcccctcccatagggctctgtaaatattatcaggaggaaaaggcctctcagaggggggggtgctggggccaagggatttccccccataaaagctggttttttcca

SEQ ID NO: 514958 - DNA, 150 bp, Homo sapiens
atatcacggctgtgtgactgcgttttgattcctcactacggcctgcagtattgtggcatctatcactgtatctgtgtatgtctgcagcttgagcgccaccgctgctgtcgtacacttgttgtgtgcgatcgcactccccgtggatgctct

SEQ ID NO: 514959 - DNA, 432 bp, Homo sapiens
  misc_feature (363)..(363): n is a, c, g, or t
atatggttgttgtgagggatatacttctcccccacatatgaagcttagttgggctggatatgagattctgggttgaaaattcttttctttagagagtgttgaatattggcccccactctcttctggcttgtgtggtttctgccaagagatccactgttagtctgatgggcttccctttgtgggtaaccggacctttctctctgactgcccttaacattttttctttcatttcaaccttggtgaagtctgacaattatgtgtcttggagttgctcttctcgaggagtgtctttgtggtgttctctgtatttcctgaatttgaatgttggcctgccttgctaggttagggaacttctcctagatnatatcctgaagagtgttttctaacttagttccattctccccgtcactttccagtacaacctgccggtgg

SEQ ID NO: 514960 - DNA, 146 bp, Homo sapiens
agactcctccgcaggatcccaagaagagcagcagtgcaaggggcaggtgtcaacgagagcctgatcgccacactccagcactcgttgcagttgagcctcccaggcaaaagtggcagctcgccctcccaggttgccctgcccttcac

SEQ ID NO: 514961 - DNA, 387 bp, Homo sapiens
atctagttatagcatggagagtagagtatagagggtgggaccatgtagagtcaggttggtctcgaactccggagctcaggtgatctggcgcgcctcggcctcccaaagtgctgggattataggtgttaaccactgcgcccggccagtgctcacttctgaatacaatgcttatcaacctgtttaaattcatgcccctctggttaaatgctgaaaattctgccccatatattaaacactacatctttcacaggctttccagaccatccacgtagatcttaagtttaattcttctttatacatattatccatttttaacgtttcccaaatctgacagcatatcgcctatgcttccgaaaagtgcagtaggctttccacgagatttgggtc

SEQ ID NO: 514962 - DNA, 991 bp, Homo sapiens
cggcgtgctctgggcgctgttgtttggtctttatgcctgcgtgaggggcgttatctggagggcctgcgggtgcaggccgcagtgacacgggccgcttcgcccctgtctagtgctgcctgtctcccgcgtgccgtctgtgttcgcggccttgcatagcccaatcattggcggcagcgatggatgtcggacgttatccttgagtcctatgaaaccctgcggagtggtctaacgcactggcgatggatggcggctagacgcctggcgacgtgtgacgatgtgactaaaccagcttggacgactgaccggcctgtgattattttgcgtatcgccaccgccggaggaccctggacgcgcccgtactggacggcgactgtctccgtacttaggcaactgagtgaagcctgccgagcgtcgcgagtagcgtggatccgcgaaagccaggcacggctgcatcgctagtctcagtcatacccttttccaattgtgcccttggtgcagaatccaccgatctttccttcgagagtgcccgagatgacagtgaaggacatcgcaggtaccactaacccaatacacctgccgtccgatatatacgcttgtggtcccaactcgtgggcaagataccccgcgtgcgcccccggagtcagtcgcaccttcaccagtcaggggtggatcggctggggcgcctttccgtgcggctgtgagaaagggggggaataggtttcggtgcgacagccggcggacagagctgaaaacttccactggctcaggggcctccgaggacctgtgggtccccctttaccttaataacgtggagggggacattggaccactgggttgcccgtgttgccccctttgacagcaaccggtggtgtccccggagagcaactttgacctttgtcccccccggagggatccgcgattcatttggttggatttttgtcccccccggagatgttgggcgcttaggttaggcgggtgggctaggccaatg

SEQ ID NO: 514963 - DNA, 230 bp, Homo sapiens
tacccctcaaattggcctcgacctaccggaccacaaccaaaacccatcacccaagtgacgttttaccagaacggcatcggcactggctacggtggttggtaccaacagtacatcggcaagtacgtttctggtgctacgggcgaaggccttgcatttaatattcgtgaggcgtacaacttcatctgcagcaactatcacagggacgacgaggtcattctgctagggtttaa

SEQ ID NO: 514964 - DNA, 227 bp, Homo sapiens
agatagttatctgatatccagtagagacgggattcacgatgttgcccaagctggtctcgagtcctgagctcaagcaatccacctgcctcggcctcccaaaatgctgggattccaggcgtgagccaccatgcccggccattgtggtgcacgtctgtcatcccagcaaggcaggcgaatcgcttgaacccgggaagcggaggttgcggtgagccaggatcgtgccattg

SEQ ID NO: 514965 - DNA, 165 bp, Homo sapiens
atgggggttaggtaagtcaaagcagtcgggttaccggggggtcggtccaccttctgggatgctcagattctccagggggatgatccctcggggctctttgtcggtggtgtactcaaagtagtagaggcagtggtcggccattcaacttagggggtacggagctcg

SEQ ID NO: 514966 - DNA, 178 bp, Homo sapiens
  misc_feature (60)..(60): n is a, c, g, or t
  misc_feature (62)..(62): n is a, c, g, or t
  misc_feature (153)..(153): n is a, c, g, or t
ccctttctccccctctctctctcccttaggtctgtctccaccgcaggcccaaggtgaaantnctccccttgccggagcagtctggcagggcctttcgtggctggaagtggccagtttggttccggtgctgacccctaggccccagcgcaggcncttcccgtgctgtctgtcttcccct

SEQ ID NO: 514967 - DNA, 244 bp, Homo sapiens
tgtcatggctctagcggattcctgtcgttcctggaggcgctcgatggtctctggtggatcctggtcctcatgctctatacagtgtctaggtgttgcctatcgtgtcctcagaggcgtgctgatccccttcctcagtgacatcgaagcctggcctaattgtacctataggggatagagggtaggcatagaggaggtacccactatgcaaatactttctagagagagaacctcaggtacggagaaa

SEQ ID NO: 514968 - DNA, 105 bp, Homo sapiens
gacaagagacacatttgttgttggcttctgaagtggtcagtgccatggctgacacctccaggtcctgcctggcctgggacaccactgtggacatgcccaatgcag

SEQ ID NO: 514969 - DNA, 445 bp, Homo sapiens
gatccgcgccgccgccgccgccgcctgcctgccgccgccgcctccgccgcggaggaagacagctgccgcccagcgcaccgccagctgacacccctgcctgcagagtcccacctgccacacggcctcgggccagcggccaggatgctgccatcccgcatgccacacacaacaaacacaaaacaatcacagaaccacaacacccccaaacgaaacacaaacacaaccaccaacacaaaaacgagacacacacaacatgtcagctcaacctacacccacaaacacaaaccaccacaccagcgcccactctaccgcacctactcgatctatattgtcttcactctcacctcactccacttattctctctctcaaggtaaacattactacattctcaacaaccacatattccttcctcactctccccctccacattccctcctaccttat

SEQ ID NO: 514970 - DNA, 349 bp, Homo sapiens
tttataagcgtcttgtaaatgcaagtgatcacagcatgacaatgacatgtgctgcatattatacaatgtctgagactgcataatgtacaagtcacacttatgctgtttataacaggaggagaaagggacctcctttactattctcatcatcctaaaatctcacttctaatcagcttatcatctgttgcctgtacagctcagtgaaatgtactttcatcttataaaagttcagatatatgccagtgcctatttttgctgtaaaggagaaagtaaaaactccacagcgggaatctttaactttgcttttgaaaccaccattgaatcactatcgtatagcagacttagcaca

SEQ ID NO: 514971 - DNA, 227 bp, Homo sapiens
cgagatagcgttctagaggatacccgtctggatgcaatgtgtcacttcgagagcgaaatattaaacaagggagccgtaccccgctctatccccaatctagcggaggtaagaagaaaggcaaaatgaagaacgctcggccaagcaatggacagaagacctaatcgtggagactgcaaggagatggatctagaaccttagaggctagaagcacgtggctggcacatggc

SEQ ID NO: 514972 - DNA, 811 bp, Homo sapiens
acttggtgttgggactgctgatatagaagatgtcttcacgaacatgctaagatattggcgtaccctgcccccaacttcaaaagccacagctgttagtgccagatggtcgaagtattaacaggatatcacgcctgtcatgactactgaaggaaaatatgtgggtgtgcttcttttaccctcttgacttcacctataggtagtaggccccatcgtgagatcattagcatttcagtgactagggcgagataggaatttgaagaatagctcaacgtgcctaagatgattggtgcattctggtggattctcacttctgtcatctagcatggtgtcaatagacctgatagaaatcaaggagagactggggacaccatgaggcatgccattagttcatctcgacacctgaatcgcgccatttgctccaggattatagcgggtcttacaaggcttggattgataggtccatctcgttccagaggggcctacttatatctattagatcatgaagggtcatatcgtgtcgagcagatcaacatgtatgatgacctcccatgaaggtcgttctgtggatgcagacttagagtactagatatcagcgccttcgccatggtatcatctggacgaatacaatggtggaacgtggtgccctagactggttggaaagcctggcagtgataccatccacgcctgtatgtgcaaaagagccaagaatatttctccaagccgaaatgagcgctgtgctgttttaggtgccagggctgtggtgggcagccatgagaacaaaacctctactggattcctggccgttcaagta

SEQ ID NO: 514973 - DNA, 458 bp, Homo sapiens
gtacgattacgctctagaacgggatgaatgtgggtgaagcattgccagtcctccccgtgggagtgttcctctgaggggatgtgtagggatggagggagagtggagggccccttgggaggaagtaacagagcatataggacagtttgaggttagtgtctcttagtgaggtgaatagatggggggaggagaaatagggtgaaggagtaggtatgggggcgcacactgatatggaaggatgggtgaagagatgtcagaatttcttgggtctgctcttaggggaggacgagcttttgattttggactatccagtccccttgaaaggaggctccttgctgtatagcaaagcttactcggtgggagagtcctggggtaggatcgctgggataacaggacggagaggggcagaggcagaagaaagggaggcttcttttgctgcctcatcggcctttctgttgcct

SEQ ID NO: 514974 - DNA, 850 bp, Homo sapiens
tatagtaaatagctcttgttaccggaaataactgttcatttgttcactcctccctcctaggtcacacttttcagaaaaagaatctgcatcctggaaaccagaagaaaaatatgagacggggaatcatcgtgtgatgtgtgtgctgactttggtgactgtgtggagtcctgctcaggtgttaggtacacgtgtgtttagatcgtggtgtgcttgatggggaacccgcatgttcagtagttctgtgactgcggctggactctagagaagctgaccttggctgctcgtagcgccgggccttctctccatcgtactatcgatctcagtagcagctcagttaggtccgggagcgcagaagatgccccactcccagcctgtgatccatcacatcccgtgtcccaggcgtctacggggcccaggataggcagtcttggttctgcgtgatgtggactgcctggtgacccttgggggctaggagagccatccagagcacactctccggtacctggtgctccacctagcctccctgtagctgggactgctgtttaacggggtctgacgctggctgaggagctgcgccacatccactaccaggtaaccggggcagttacttgcgaaggacttgtgcagggactgcctggagtgccccctccggacgaggggccctgttgctgatgtcacatctatatgctactactccctcacaaaatgcaggcggaccgccttacttggatgctagcatacggacctagaggaatgaaatcctctggattaagggctgcacagtgagatctatgatgttaagcagggacaaactggcagaagaaggaaaaacgaaagaaggacgaaacca

SEQ ID NO: 514975 - DNA, 740 bp, Homo sapiens
  misc_feature (176)..(176): n is a, c, g, or t
ccatctttggggctaaacaaagtttgtctacacattcatttcccaaaaagggatcgcaaaaaatttctccccccccgggtaaatcaaacaaaaacaccgtgcacccacccaggtccccccacctgaaaaaaatcccctcacctaaaaatccccggaatgctctttcttgttatggnacaaaatagttccaaaccacagcccctattcttgtgacattttacttgccagaaatatttgtttcctttataacccccataccttaatggttgtttaaaggcacctatacccctgtactatcttgtggggcattcaaccccaaatccgaggggttcgtaaaatgagtttttagtaccaaggttcttaaacttctggcggcgttgtatttctccgcatgattaaaatcaaaatactcggaaaactaacgcccctgcttgaacccctcgtaaacatggaacaaaaatgctccaggggctcaccccaggcccccaccttcgagacagttaaaggtataacctctccggggaaagtacatctgttttcccccctcaagatatgtggacttaggtaaatagttttttccagtacgtccatcccgccaggtcagcctattaaaaatacattctccaagaaaaaagatgctgttaatctttatggggcagtcagattttcttccaaaatcttccttcctctcagaatcggtggttatgaagaggcaatcaatacggaattccttagccgga

SEQ ID NO: 514976 - DNA, 86 bp, Homo sapiens
ttaaacgagtctgacctgcactgtagatcgctccaacctgactgctgtcaccttcacgttccagtttttaaatcctgagtcaagcc

SEQ ID NO: 514977 - DNA, 718 bp, Homo sapiens
  misc_feature (12)..(12): n is a, c, g, or t
gcggcgtcaggncgaccagccgcgggccgcaagggcatggaccttcaggccgccggggccaggcgcagggggccgcggagccgtcatcggggcccgccgctgcctagcgcgcggggggcgccctcccagcccggaggctggctttgctacatgctgaccactccggtcaggagagagagactgagaaggctatggatcgatatagcccgtggaacacagagcattcctaagtgacagtcccgtgcccggggtgagggaacccattctgaagaggaaggctttgtcatggatgcacggagcgcatctctgaatggtaggaactgaatatcctgggtagtctgtcagcaagggatcaatactgtccacctccaacggtaatcagcctgtgcgactcttttcacactgaggaactgtggacctcggagtttgaaagcataatcaagggaactaccataatgatgcttgacgacatccaggagaagccatttgctcaggagcttaaagccttggggtgtgctgtgcccgcgagcgaaggcatgacatgatctatgaaccccagactggcgaaccatccgactgccactgtataccctattattccaggatggtcgttctgcacaagcaggacagttatgacgatgctggaagattgagtgtggagctttactggcttgtaggtgggtgggcctccacgtcgggatctctttccctgtcttgg

SEQ ID NO: 514978 - DNA, 111 bp, Homo sapiens
aatcgggcaaataaacgctaattccgaattagcggggaatttctggaagttaaaaatggggttggggatactgaagaattggcttaaattctaattaaaaattaatatttt

SEQ ID NO: 514979 - DNA, 723 bp, Homo sapiens
  misc_feature (174)..(174): n is a, c, g, or t
taaattgtttaacactgacatcttttaatgttactcttttcagattatttcaacaagcaaagtaagtgtcagcagtttttactataattgccaaatggtattaggaatattacctttcctcccttgcttacaacaaaaacaaatacaaaaattaaagttataggtaaagatatnttatcaaaggggatttttttttagacaagagtctcgctcttgtcaccaaggctggagtgcagtggcgcaatctcagctcactgcaacctccacctccggagttcaagcgattctcctgcctcagcctcctgagtagctgggattacaggctcccaccaccatgcctgtaatcccagctaattttttgtatttttactagagacagggtttcgcctgggtgacagagcgagacaccatctcaaagagtagtggctatcaacctacactgtacaggagcccttgggaattacttttttaaaaaagacactgtggtggaccctcatgcccctcatcaagaacagaactgggtactttcccagatgaggcccatgtgcagcgtgattaccttggacccattcggcttgaagttgggaggaaagaatccatttgtggtcccgcgagtttttgattaatttccggattagccattcctggcaagagacttaggggacctgctggcgtccaaatgtttcttctctgcaatgggcgattccgtccctcagactttgg

SEQ ID NO: 514980 - DNA, 394 bp, Homo sapiens
gaaatccccctgaatcctggaggccggaggttgcagtgagccgagattatgccattgcactccagcctgggcaacaggagcgaaactccgttgcaaaaaaaaaaaaaaaaaaaaaaattataatcacaactttttgcaatggagtgacttatatctgcagcttatatctgcagtgtttgtgttaggaacctagcttttataatgtgttaactttttaactcagtattctggctttgggattttttgttttgtttttggaaacatttcagaagtggaatgtagcctgttaaaggtgtgcacaaaaatattttgcatgtgttttttttttttgcctgtgtgaattctactttttagcaaaaataaagccccccaaaggatgtgcaaaaaaaaaaaa

SEQ ID NO: 514981 - DNA, 451 bp, Homo sapiens
  misc_feature (185)..(185): n is a, c, g, or t
  misc_feature (369)..(369): n is a, c, g, or t
atatcatgatcaagtagaattattccaggaaatttaaaggtgagttaacatcaggaaatcagctgggtgcagtggcttatgcccgtaaatcccagccactcaagaggctgaagtgcgaggatcacttgaggccaggagtttgataccagcctggataacatagtaagaccccaccactaaaagtntattattacctcagttcatacagaaaaagcagttgatagagatcactacttagttatgataaaagtttttgtcaaactaagaatataagaaaagtttctgagcttgataaaggttaaatctagaataaccatataattaatcttccaaattttcacacttcagttcaggattaataatgcatanggtaatgtcagctagaacaagaataagatagggttgttttgagcaaattagcatgagaaaggagggagggagggagagatgg

SEQ ID NO: 514982 - DNA, 333 bp, Homo sapiens
cgggctcccttgcccatttaagaattcctactgcacagccctgcacttcagctgtgtgtaatgaaaagggttgggatgagtcagggagagctagagagggggcagtttctaaagttgtcttcaaggaacagaaaggggagtggggaaaggatttaggatctatggggtcaactaggtttccttttgtgagtttatataatggttttgttaggatggcaaaaccaggtgtctaaaggtgaaagtatccaaccatgcccaggaaggaaggggttgttttgtagaagggttggggtttgagagattagtttggaccttggccgggagccccggggt

SEQ ID NO: 514983 - DNA, 150 bp, Homo sapiens
ctagccaacattgtgactactgtactcatcactgtcagtactgttgtggcatgctggagttccatagttcagctgatctcctgtttgagtgtgcttgctctaatacctcttacctgcctgctatgtgggggcgagagcctgtgtcagggg

SEQ ID NO: 514984 - DNA, 302 bp, Homo sapiens
caggactctccatagaatgaataggataacattgaagtcctagaaatcagccaaagtttgcatttgatgcggattgtgtcggcggatgtgccctacagcttccgctattggtgtctttagcagacctccatcctgagtggtgagatgttccgacgaactggtccgagattctgctcctagaggttatacccatattttgaacatcactcattggggtgtttgtaactcttcagatggaaataagggtaaacatttcagtaaacatgccaatcatagtcatctggtcccttctgtcgtcttct

SEQ ID NO: 514985 - DNA, 443 bp, Homo sapiens
gacgattagatgtagtgagcattaaggatatatggaaagtggtttgaagtaaaatgtatacagtataagagtcagaatcagccaggcgcggtggctcatgtaatcccagcacttcgggaggccgaggtgggcggatcacctgaagtcaggagttcgagatggcctggcaaaatggtgaaaccccatctctggtgaaaatacaaaaaaaaagccaggtgcggtggctcacgtctgtaatctcagcactttgggatgctggggcaggataatcgcttaaacctggaaggcagaggttgcagtgagctgagatcacgccactgcacaccaatctggggtacagtgaggctctgtctcaaaaaaaaatacaaaaaaagtagccagacatagtggcatctacttgtagtccagggtactcaggaggctgaggcaggagaatcacttga

SEQ ID NO: 514986 - DNA, 301 bp, Homo sapiens
cgcgtcatttcagtacagtgtattaatctagccgcagagcttatgcggagacgaatgtattcatgtaacttatactaaacattagtccttctatagggtgatagatgggcccaatggggtgtgaggagttcagtaatatgtaggggatatataaggtagtgggtgtagagcttgaacgctttctataatggggggctgcttataggcctactatgggtgtaaaattttttcactctctctacaaggttattacctagtgtccaaagagctgtccctcttgggactaacagttaacatttac

SEQ ID NO: 514987 - DNA, 156 bp, Homo sapiens
aagacgaggccagaaacaatgagacctgggctgagaataagagatagaaaaatggaatctaatgacacagaggggatggtgggcagaggcctcgaagagccagaaacgggtccctgcagttcgacatgcctaggcaggggcggtactggccgcact

SEQ ID NO: 514988 - DNA, 359 bp, Homo sapiens
  misc_feature (323)..(323): n is a, c, g, or t
  misc_feature (341)..(341): n is a, c, g, or t
aatagttccgggctcggtgtaaagtgagaattattgggcatgcagtcatggttctttcccaggtagtggggttttttttggtcggggctttatggagttttcggctttattcattcacatactggatattcagccaaaaagcttatgtgacccctattagtatttcgggagcttttctccagcgggattcttggtctcgggtactcggctttccaaattcggattaccacagcctagcaaacaccgattccatggtcctctactcagcaagatggccacacctggcgggggatgccctttctatactacactcggggaacggnctccaggtaggaaatggngggatcactggagccggg

SEQ ID NO: 514989 - DNA, 231 bp, Homo sapiens
cttatgaattaaaaaaaataaggagccatcaaaaaaaaagtccctggcagtggaggaggacatgatgttaggagccctgtttgcggaaggaatgttatcccaggtcatggatgccatttttgtcaatgattcgaacactgaaagttggcagattcaggatgaagcgtttctggggcccctcccaagaaatttcccttaaggggttccccttggccctcctccggtgaagaa

SEQ ID NO: 514990 - DNA, 328 bp, Homo sapiens
tcttctcctgacaggaatacaaaatgaaataccacgtgatctcacctatagtgggagctaaacactgggtactcatggacataaagatggaaagaataaacaccgggactactagaggggagaaggaggaaggcaaggtttgacaaactattgggtactatgctcatgtattaatctgttctcacactgctatatagaactacctgaggctgggtaatttataaagaaaagaggtttaactgactcacagttccacaggctgtacaggaaacatggctgggaggcttcaggaaacttataatcatggcagaaggtgtcaggagagaag

SEQ ID NO: 514991 - DNA, 102 bp, Homo sapiens
ttcgctgctcttcttgtaatggtgcgtcaggttctcctcagcctcgctgtcgcctgcctcttcatgtggaatggtggcatccgggaaccccccccgatgagg

SEQ ID NO: 514992 - DNA, 1137 bp, Homo sapiens
taaaacaaacgggtgctttatttcatcatcagaaaccgggggcatagtttaaaaaacaaacagaagccctggacagcctgggatgtggctggcagctcggagtcactggaaggatgtaagtaatgtctgggaggagctggcctgagcttcctggcttaggggccggcccccaccacaacagggatctatcccgtggactgtggcgggagggggtggggcgttcaggcgcagtgtgggacagggcgccctaaccataaggacctcccaacctctgtgcccgtgggtgccacaccaagcctgtgaggcaccaaggtgggcctacaagcttactctcagcgccctttgaacgcgtgctcttgggcgccggggggtaacttccacagcctctactggcacgagagggaacagaagggggacgcaaaaacaaacgccccgagacccaacggtgtggagagaaacgcagggccctgtgtggcccccggggcacacagccccaccgtaccacccgtgacacgcgggcccaacccaggggggggcccccccgacgaggccctcgtgggccagcgacgcaacacaaaagtgggctgtcgccgcccagcgcgatcacacccaaaatgtacccgggtgacccccctctctgtggcccccgtggacgagcacccccacaataaccccaaagggggaaccccaccggcgaagcgccacacgcggcacgcgcgcacacccaaccaaccgcgctgcgcggcgccaacaaacccgcagcctcgcgcacgccaacaccagcccccccccaagagccccacaacacaatcacggagcccacacaacaacaccgtatccccccacgcccccgcactccacgcgcaccgagacagtgccgcgggaccaccacaccacacccaagcacagggggccccacgatttcaacgcgcgcaacgaccaacctcttcaccccccgaccaacccggcggtcgcaactccccgaaccgggacgacacttaagagcacccccgtgcgacactggcacgcgcccccccctgccgcgtaaaggccccgtaacctgcaccgcgaaaaacaccttcctctacccacccgtgccgtgacaacgcacctcaacctcacccctcgacaaccccg

SEQ ID NO: 514993 - DNA, 141 bp, Homo sapiens
  misc_feature (1)..(1): n is a, c, g, or t
ntctagagttgtttagagttgtacgctagagttgttttaaggggtattttgttaatgttgaaaagtgcagaggcgttttgtctaaatcactgacgctcatgcacaagatttgccccctacttaatcttgatccagaattat

SEQ ID NO: 514994 - DNA, 307 bp, Homo sapiens
agcctctgcaggggccggcctcgatacaggcgcttccaccgtgccctttccctgcgaccattgcctaactacactaggaaaaactcagccactgctctttccagtctcaaaaaggcaaacggaaaacaacttggtattgtgtttcaaaaaggattaagttgatgaacagataaaaaatggggaaacaattcgttccggtgactctttgttttgccatagtttgggtttgagagatttgtcccgtatcagctggggaaaccagataccacttcagcgaagggtttctgcgtttaataattctcttttt

SEQ ID NO: 514995 - DNA, 639 bp, Homo sapiens
gcccgccccgtgtaccccgttatcgtttgtcgccccttccatgtcgcgatggaagtccctttttcttatcccgggcgggtgtttcggggcccctccccgtggcagcgacacgtcaatgggccccgcgcaggtgcgcgctgggcctcctaggtaatcactccggctgtacgtcgggacccgattttgtacagtcgtcacaccgttcccccctgttttcgtaaggctccagggccacttggagctcctcgtggacgtgttgacccccttagcgggggaagggtttcccctggcgtcgcgccccccctattgttaaaaatgcgtaagtgccaccgagaagggctgtgtgagttaactaggactggctcccccccacaaggggggttttcaacacggaagctcatatttctcccggagcttcttacaccaagacctacttattagcccagacacacgacgccggggggttagtccacgagcgccaagacttctgaaaactgttgcgagcacaaacaccaccaatgtttcaatgccccgtctgttgtcttcaagaaatagttgtcccccgctaatttttgataaaaggggccgctttttcccgattggctcccccttcaccccctattggggcccaaaaaaaaa

SEQ ID NO: 514996 - DNA, 1034 bp, Homo sapiens
tggcacgaggatggaaccaggggttagggactgcctgtaatagcactgggatttcgcctcccagccaaaatgctccaggtaggcagcaaagaagaaagagtgcgatatgagggtacagtgagttggcagtccaaattctgttctctgcagcctgtttttgagtagttgtgaataaagtcacccgcctacttgtctaagcacatgtgggtgtgtaactcagttcctggttctcggttctaaaaacagacttccaactgggaaacttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctggtggtctcattgggtccacatggcactatggtaatgtgggggtgcgcagagagagctcacagtgctccaatgatggatgcatccgaggacagactgggacggactccgggaaagaggctttctggggaagaagggacccaaggaggtacttcctcctcaattgatgccctcagggctgcatgtgtgggtgtgtacaagctgataaggtcagtttgggcggaaactaactgctagtcttgtgtcagggctgcagcctctttgtttcacttttgccccttcttgggagcatttgaccaaaataatcctcagttcatctgtgtacagtcccttggtaccccgcccaggtgggagggtgaatagggaattcaccgaagcactgggggagcaaggcaggacatgtgttaatgacgaatagggggccggggctggcaaaggaccagacacaccaggaattagggggacccctggaggacacagcacactcgaggaacaaagaaggcaaacgcagagaagagaacacaagcgacagggagaggagaaggaaacaaccaacgggcgacagagaaagacaaacaaaggagggagagcagaaaagagaggagaaaaaacacaggagg

SEQ ID NO: 514997 - DNA, 849 bp, Homo sapiens
tgaagttctaatgaactgtttctcccaaggttttaaatattgtcaagagttattctgtttgtttaaggaaaataagaaacctctttaatgcaatagcattttgcttgggttgttcttgtctatttagagaaagacgatacattacgtgtgacatggcaaggtccactgcttacacacagttcttcaaattcctctccgagatagacaccgagtgtgaaggaattctacaatcttggctgctcacggatcaataactagctgtaatttaggtagaagatcaagtgcatgtcgtaaagcttgaccaacgaaagagaaccctcagcagtagatatcaaaaactttgctcaggacatttgtaggtcaagattgaagacggaaaccggaaaccgttgtcttgtaagcccctagaggcagaatcatggtacatgcatacagtagttagagggataatggagagaactggtaacatgaacaacctcaatattatgcagatttatgccttattgttttatgcattgtattccaagagttgggtgctttctaggctgagttttaggtataagtattgaagatctgtatatgtttaacttaactgagtgatttaagttgtactatttacagctacaatgtaatcttattgcttgcgggtgatattctatttctttgcctatcatgttagtattgtaacagaccgttgtcatatcttcagaaatgttccgtgcgaaatcctattacaaagctttcacgcagggcaatatgtttttgcccttaataaaacactggtaagaaaatatacctagggatttgtgcccattaagatcctttggggaagctaaatgggggaacaag

SEQ ID NO: 514998 - DNA, 452 bp, Homo sapiens
tatggattatgtacgtacaacggtcaagaatattaacaaacattcatatccaaagttctgactagaaagacaacccaagatagtggcttacaaatgaatcagaggtccgtgatgctcatgtcatcacgcttgattcattccatcactttgggaggccgcattctacgtggcattggatcacgtgctaccgatcattgaaatatgctagaatgtgacttgtggccttaaagataacccacaaatcattacagttcattgtgataagcataatgtggcacataggatcttgtcaggctcatgtgtccttctccccaaggaggtataaaactgttttttacttgatactgaagattctaagatagttgtatgactttcaattaattatttcacttaatgtggtaacatgcattcttttcttgaaaagccaccattgaattgatgtatatacaaga

SEQ ID NO: 514999 - DNA, 453 bp, Homo sapiens
  misc_feature (158)..(158): n is a, c, g, or t
aattgatttgccaattcctgatgtttcatctgaataaaatcaggtaatatttgtctttttgtgcacttaatgctttcaaatttcacccacattataccatgtataagtacttctttctttgttatagctaaaaattgggtgtccatttatgagtcacnaagcatatggattgtttccacttttggactgtatgattattactgctgtaaatattcatgcacatgtttgttatttgagcacctatgttttgtaagattaacagctgacttaacagaaacaatggaaggcaagaggcagtagaataatatattcaaaagatgcaaaggaaaaaaaactgtcagccaccaattacttatccagcaattatttttcaaaaatgaagataacacaaagactttgccagataaacagaaatattaactgaagttgttgctgccagacctatcatcccaa

SEQ ID NO: 515000 - DNA, 177 bp, Homo sapiens
gagacgggggtctcacctcagcctgcatcagtgtccaccagtgagcttgtcaaaacacaggctgccggccccacgcccagagattctgatttactgggtctggggctgggggcatgagattttgtatttcttttatttctttttctctctctctctctcttttttttctttgagagg

SEQ ID NO: 515001 - DNA, 270 bp, Homo sapiens
  misc_feature (236)..(236): n is a, c, g, or t
gcgaaaaagctaaggcctgcgtgcggacaagggcagaactacttaggctacacacccgcatggcccgaaaaaaagggaaaagcaagggccccccccccgggataaagggcaaactaggtggaagcaaaaaaaagggcgtgcctgccggagaaagcgcccagggggccccctgaaaaggggggccgccccacgaaaaagttcgcaataaggcgaaggggcggcggggcaaaacgagncggcaaacacaagggcccgtttaaactgtgtctc

SEQ ID NO: 515002 - DNA, 170 bp, Homo sapiens
ctcaaaatctatatcagaggaattgtagagtactgcaacaggtacatcatccctcagccagagtattagttctacttacttccatgcgctgatgtgtctctcatctccttacaaggggtggcattctcttcacgttatacagccagcactggatatccactcagcacgta

SEQ ID NO: 515003 - DNA, 227 bp, Homo sapiens
gaggaggggcgaaactgagaatattgaatgctgagacccccggagcagtggtctagagccacagccgtgctcgcccagaaatgattctcacgggtgtcaccccaccaggcgcaagcctcactaataacttgacctttccaaaacctacagaggaaaagtgcaatgcgtgttgtacatacaagaggtaacctactcaataatttaagttggtggctgtcacgatttgt

SEQ ID NO: 515004 - DNA, 226 bp, Homo sapiens
gggcgcctagaggatccgacagcatcctaaccagacatatgcagagctggagacaacagatggtgaaactaggtccagcggtaaaatatctcaggtacccagttagatccagttattctggcatctgtggatttaaaagggtcatcatccacacgtagaatagactgggcccctgcatggctcagacaaatccacacgctggtctggattggacggcatacagaca

SEQ ID NO: 515005 - DNA, 175 bp, Homo sapiens
cacgcacatagccagcaccaatagacacttcacagagcagtcacaccaaagcgaatgatactcccagctggaggagccagtgaccttgaggagcttgagcagtttgctatgaccttcaaacaaagacgaatcaaacttggattcacttcaggggtgttgggcgataacatggtac

SEQ ID NO: 515006 - DNA, 419 bp, Homo sapiens
taacctgggcccatctttccctctctcacgccagtatgaaatgaggtggacatgtccaaagtagtaacagagggaatgtaaaagagagtgtaatttttaaattttattttattttattttatttttttgagacggagtcttgctctgttgccaggctggactacagtggcgcgatctcggcttactgcagcctccatcacctgggttcaggcgactctcctgcctcagcctcctgagtagctgggactacaggtgcgcaccaccatgcccagctaatttttgtatttttagtagagacagggtttcgccatgttggccaggatggtctcgatctcttggccttgtgatccacccgactcgggctcccaaagtgctgggattacaggcataagccactgcgcctggccaagagagtgtat

SEQ ID NO: 515007 - DNA, 572 bp, Homo sapiens
  misc_feature (183)..(183): n is a, c, g, or t
  misc_feature (250)..(250): n is a, c, g, or t
agccctccctgcctgtggctccaggcgcagcaggagagggttttgtccccgtagccaaagctctgcaggtcgaaccttatctgctatgggaaggccccgcatttttcagtgtgtgtgtgcgggggtgtggggtgtgtaaaccgcgcatgtgatgtgtgatgtttggcctccactgaatcctcntctgggagcccctagccccatgtcaagtgcggagaccggtagatcgtgggcgctcgtggcctgcagnaacccaatgtcggcttgcagactgtcgcccacgtgccctgctcaggtggacgcgggtcctccggtgacaagggctcttccctcgctgcctgagggattgccatggggcttgcgggagtcaaggcccacacacctcggccctgaaaaacccgtggggcccggcatccttcggaagccctgccgttgcgaccccgggccagtccccgggcaggagcggggaaaggctatgtctctcgtgctgccggggcctcctgggaagtggagaggaaagggctccccgtgagtgggcgaggacggattagcttccagtttcacccctcccc

SEQ ID NO: 515008 - DNA, 738 bp, Homo sapiens
agcggagggtgagttccaggtgggaaggcagttatgacagtcgagaagtagtagaagacacggaaggcacagaaggcagacttcgctcagcacacaagaattcttctgagtaaccatacgtggcaaaatgaactgggctgccttcggagggtctgaattcttcatcccagacaggcattcagatagattcgagatgcccactaagcagagaatatcacggaatggtaccatgactatggccttgcagtgcacagaaagctcccaatatgatgatgtgatgtattccaagaaaggagctgcctgggtgacgctgcagcacgggcaagacagaagtgatgcaatacagacttgtggaccatattcaccccggtccaaactcggagacacatgctgcctacgaatttcccaatgtcaagagatctagcatctgccagacatgcctgcctgaggagaaggttgctaccttgtcatgcatgatgtcacagaacacgactgtcagagaatactggacaacgtgtaataagagccaacatttgactgaggtttcaaacgatttcctctcatgctacattttgtgacacaggcaatgtcggtcccacatgactgccctagtgctgggctcctccacggcaggtgaacatcgtcggcgtgtgtgactaccatcctctacaaagctattctccggggtgctgatgccagctgtgctgcaggcatacctggacagcttaacatcagtga

SEQ ID NO: 515009 - DNA, 467 bp, Homo sapiens
aaaataaccccgggaccaagtttttgaacgtttaaacagcctgccaagcaggtaaatatgtttaaaatccaataaacaaaaccccggtccctaaataatagaaatttaaattattctggcaggtttttcgacatcccaacagatccctaaatccctaaatccctaaaaattagatacaaattttttcacccagtaccccgtggcaaaatttatttttaaatatgattttttaaacctgccagtaagaaatttttaattaaacccctttgttaaaggatatagggcccaagttatatggtggcccccctttgtcaaaacttagccttatgtttttcaaattatccaaaaaacaggtcaaaaatatttttatagggcccaaatataaaaaatatggatgatctatgtgaatcctaagtaaaaattttgttcccgaaaaggccaaaataataaaggtaaaaattttctat

SEQ ID NO: 515010 - DNA, 438 bp, Homo sapiens
tacaattcaggatgagattcgggtggggaaagagagtcacaccatatcgtgatcgtgctataataaagagatgcccacagtgtgtagcatcgaggcacagtgctcattaaccagttgtcctgccgtaattattaatagtatcccctttgcttacaaaagctgtcctagtttacaaaaagtatagacactggcaggacagcaatagtggttgcccaagataggaaacagggtcagggtaacgggtgcagaggtggatgtggttataaaaggcaacatgggacatctcgtagtgaaggaactgtttagtatctccactgtggtggtagatacccgaacctaaacatgtgaaaaatcgcatgaaactaaacacacacacaaacaagtacaagttaagttaggaaaatccaaataagatttctacattgtatcaataggtat

SEQ ID NO: 515011 - DNA, 259 bp, Homo sapiens
  misc_feature (201)..(201): n is a, c, g, or t
  misc_feature (225)..(225): n is a, c, g, or t
cagaggatacggggatcggcagacgccactcctcccttagatgcttccccgtccttccctccgcaggcctacgtctccgcaaaccccacgcttcggggtggcgcctcagacaggaccctgagtccgagactggggtaggggacctgccccgaatccttgtaaacaaaccctcgttgcttctgcacaattcgcctcccactnagcggtgactgtttgggtgtctanccttcccggttgtcccacttgagaagccgggctc

SEQ ID NO: 515012 - DNA, 130 bp, Homo sapiens
  misc_feature (69)..(69): n is a, c, g, or t
  misc_feature (119)..(119): n is a, c, g, or t
ccgcaacagcgcaccacatactaaatccaaggctggatacggtgtgagccaccgcgcccggcctatttncaattcttgaggaattacaatactcttctctatagtggctatactaactntgcatcccacc

SEQ ID NO: 515013 - DNA, 309 bp, Homo sapiens
  misc_feature (62)..(62): n is a, c, g, or t
  misc_feature (66)..(66): n is a, c, g, or t
caatgagaacacatggacacaggaagggaaacatcacacaccggggcctgttgtggggtggngggnggggggagggatagcattaggagatatacctaatgttaaatgacgagttaatgggtgcagcacaccagcatggcacatgtatacatatgtaactaacctgcacgttgtgcacatgtaccctaaaacttaaagtataataataataattttaaaaaagcctatttaaggataattattcctgggaaaagtctacttaacatgaatccacttaaatgggaagcaacattttacagcaaataatgg

SEQ ID NO: 515014 - DNA, 115 bp, Homo sapiens
agggccaaagcacagctgccatgccatgtctgagcggccagcagcctccagctctgaggggcaaggggctggctggagtctcagagcacagaggtaggagaactggggttcaagc

SEQ ID NO: 515015 - DNA, 196 bp, Homo sapiens
ccaccccaggtcctggaaacttacgtaaagcttgtgcccacggcagacctcccggccgtgggaaccccggacgtcatttgcagggacaaaaggggcaaggttttttttggggttcccactgtgggcagctactatgggggaccagggtgggggaagcccttatgagcccctttgtccaataaatgaatggccggga

SEQ ID NO: 515016 - DNA, 916 bp, Homo sapiens
tttcttttatcgtttgctttttgttttattttcttgagagacctcaaaattattaaatccaacagacgctgccggtcggtcagattattattaatattattgttgttgttaattattattattatttcatatgctgatgctttgtgagttcttttccactcctttaaagttgggaaaacttgattcgtggggcaggagattgtttcttcattcttctgacagcccccatctgacgcgtaactgcccattttaaggaaactcttggtgctacaaaaccctgaccagacacttggcaaatttacctctttcttcaaaagaaaaactttaagaaaatgagccaatgggcttcattctcagtcatgcccggagatcacccaggagaaataatacaaacaccaccactgtccagagagagtaaagaagcagaaagagaaagaatttgcaaccatgaggaatgttcccacctcccgacgggacgtgcatttggaaaacacagaatcagccctcagggtgcactccagccacctcagtgctctaagctcacagaagtgaaataatgtctgtgggttggcaatggctttgtgggatcatatgtcttggccaaagatgggaaaacctatgttgaagaggcagcccttgagtgttaatttgtcttctaaactgtgtaaggccccttcaagttcctcttgttggtttcaattatattaattataaaacaagtggatgtggtgaccatccacttgtgtttccctaatgatgggcagttggccagggcactgaccagagctgggaaatttgtatctccaaggcggctctgtctctgaaataaatggcatcaagtgcatgtgtgtatgcgacatgccctgcctgaacaggtgctcaataaatccaagtttccttctcttgaaaaaaaata

SEQ ID NO: 515017 - DNA, 347 bp, Homo sapiens
cgggagccttaacccttcagaaagatacctgcacttgcatgtttattgcagtgctcttcacaagagtgaagatatagaatcaacagattctatcaacagatgaagtgtccgtcaacagatgattgggcaaagaaaatgaggtatagatacacaatgaaatactattcagccataaaaaagaatgaaattgtatcctttgcagcaacatggatggaactggaaagttaagtgaaacaactcagaaacagaaagacaaatgccgcatgtttcacttatggtgggagctaaataacatgtacacacagacattgagtgtagactgatagacactggagacttggaagggt

SEQ ID NO: 515018 - DNA, 168 bp, Homo sapiens
gacacttacgttgaaaatttattaacaacagaccagctctggaagtgagtttattcttgtctgtatatcaccaatgttatttccaaatgtccgtgaaattatctatatatcctattctccttgactagcttagcgtacggagtaatagctaactaatatagccgatct

SEQ ID NO: 515019 - DNA, 982 bp, Homo sapiens
ggaaagagaaacagattgctaagcttgtgtgaatttacgctgtaactactttatcactaacatgtcctgccttattatctgtcagcatgcaaaggtactctgtgatgtagatcatcagcttcaggactttagttccgttagcattatttagttggtcatagctctggggtgaagcattattgttgtaaatgggctcaaccagcaacagtcccaaggttcatgcacgttgtcgagcaagatgggaacgtcgcttctgtagtgtattcagtgcttaatatacgctgtatatgttaccgttgttgctcataatcttagttggccacgttaactgtcatgttcaccatcaatataaatttatttctcaccccagaagtaagattgtatttattctctttcgtatccttcggaatatccgtaatagcttgtcatcactcaagagacaagttgtatgggtgactatagcacaaagagtagtgtattctgcgagatatagtctcgattgcgcgactatcctttttttttagattcccggtttcgtcacgtttggtgctggatatgacaagatcggtcatagttacccctttttttcggacccagtgtgtcttacgtagtcccatttggttgcttggtcctaggtaacatatggcatttggttttcactgcctgtaaggcttttagaccctttctggacggattgggcttccttgtctcatctggactttagtcatctgggcctctaagtttcgcaagtgcgtcttttgctccatcacctgtagtccaggttacctcgctagtgggacgccacctgttctcgtgggtggcactccattcgtcgtccttccacatccaggtgacctacctttgtttcttggccctgttagtttttccactacttattgcactcagggccgtgttcggccaaacaagggggggcggtcagaaccccgggggccccctacctcccgctttgtcgggggccttg

SEQ ID NO: 515020 - DNA, 796 bp, Homo sapiens
  misc_feature (796)..(796): n is a, c, g, or t
acacccacaaagtggacatggacaatgctcctgtgggggccagatcgggctggaggacttcatcttcgcccacgtgaaggggcagcgcaaggagtgtggagtgtgttcaagtcggaggatgcactcgtgtgctcaccatcacggacaacgtgtggctggctacgccttcatcaagctgcatcaaggagggcagctggtgatctgaccacatccacctcatcagctgtgggctgacatgatctgaggccatataacggggcagagcctgctgggctgcctggcactacagaggtggccctggctgctcaatggagctgccccgaggccgtaccttcacgctgaaagctcacggagcctcgcaaggccatatcgacatgatcagccagagtatcagcgggtggacacgacctggctctggcccacaacatgggcagtggccgagggaccctgcggcgtcctgatcccggggccccgacaaggtggaggatctgcctctgcctttgaatgagaaggccattgcagcaaggtggatgacctgctggagagtaacatgggtatcagggacacggagctggcaggcacccatggtgggagctgggacaagggcgagaaggaaaccggatgagctggactgagagcctggaagaacggatggggtgacattgccaaccctgaagagacgaataagacgtaaaggggcgcaatgggacgcaaagacggcgatataagatgaccggactgcagcaataacggcgcacaggagggcacagaggacagagagaacgacacagcagan

SEQ ID NO: 515021 - DNA, 118 bp, Homo sapiens
  misc_feature (25)..(25): n is a, c, g, or t
  misc_feature (92)..(93): n is a, c, g, or t
  misc_feature (98)..(98): n is a, c, g, or t
  misc_feature (103)..(103): n is a, c, g, or t
gcaggcccggggttggccggtgttnttaaggattggggagcgggcgcacacccctcctgcattaaggagagttctcagggtcacgctccganngaccntaganggagcggcggtgtcc

SEQ ID NO: 515022 - DNA, 995 bp, Homo sapiens
gggtcacagttccaggcgaaggcggagattctcgatgcttgtccccaggtagcacggacctctgaggcccgacaaggcgcagccgtgcgggcctcgtgcggggatgggagccttgagagggatatactgcagtctcagcagaagggaagacatggttaagaggttgttacggaatgaagttctacacgagggtatgatgaacatcgggagagggaagccatgttctagaggtatgggcaatccaaggtctggttgcggggctggtctcgatcgaggaacgaggttggcgtcttgtgatgatggatcctggtacagagtgtagctcgagggatgaccaccggagtttggtggattctagtgagttgagcgaatgcacaagtggggcactaggactgcaaagtcgtcgtcttgcgtgagtgtcgctgtactaaacgaagcaatgcgtagccctatgatgatacgaagggaagtaagtgggaatgctgggctataagctaacaaaggattgatccatgggacagttttaacgacttgggtggtctaaaggggcgctttggaatgtattgtgtatcgaggtcgatgagcgatgcggaagggatcgaaaactagggaaggacttgtgctcagccggagaggagggccccacataaaacccccacgtggtacgcgcataggggttggaagagatcctaggtgtacgggaaaggacattcatccgatttggtgcgccattttgacacacagtggagccaacattcactcgacgttggtctgctaagtgtgcccatgaattccgagtcggagtgcccaagagagaaaggtccgacaagggggttttttgagaacaccgatagtgggtgtgccgaacacgttaagagcggcaaccagctttggatagcgcgtttgtgcaccatttccgatcccacacatagcaaaagggttccttatctttgcaccatgtccacagatggaaaccacacctaggcgtggatgga

SEQ ID NO: 515023 - DNA, 421 bp, Homo sapiens
atagattcttatctatcactaggcctagtctttccaccctgaagaactacccttcacatttcttgtatggtaggtctaagggggcggggttctatatcaagtaaatctagtatagactggaaatctatcacatatacctatcatttttgaaggatatattctctggctatagaattcaaagtctgtgatgtatatactattgggcacttaaaaagatataggttcgcttaatacttcttgacctagcactagtatccaacagaaaggtctagctagtcatccttaaactattagtgcctactagtaagatactactgcctttatatcctatctagttatcatttaaacattatctattattaatacggttttagagcaatacaattatacaagtgccttaatgtaattttctaacatgttt

SEQ ID NO: 515024 - DNA, 278 bp, Homo sapiens
cggccagtcctaactggctcacggtgttcacaggaccctagagtatagctacctgcaagcaagagcccttggacgctgatgtcatcaggcatacagaataggcctgaatggcctccttatcctttgacgcccttaatactactactccaaaactacatacgcatctctcctagaagactaaccaagctactttatcgttgacattgaagccacataaaaatggttttacacggttcttcaatatgcaccaggcaaagaggaaaccaggaacggcacat

SEQ ID NO: 515025 - DNA, 393 bp, Homo sapiens
agatcgtgcgactgagcctttaaagaacaagagacgttgattattgaaccagagaaaaatgcatcccagtattgaatctctggaacaagaaaaggttgatgaatgaagaagaaggacaagacaggatgagtctagcgtgctctaagtgaagaagatgaggaagatgactcggaatcagaagctgaaacagataagacaaaacccctggactatcatgtaactaatgccaacactatctagatacacaatgcagctcctgatagactgttacaacacactactgctgatcatcagaatcaagacaacaacctacatcaccatattaaaaagtttccaaccacagactacaaaacatttctcccaacagaagacgagagaaaagatgagtctcct

SEQ ID NO: 515026 - DNA, 205 bp, Homo sapiens
tgtccaagcgtagtaccaagggcttcttcgaccccaacacgcacgagaacctcacgtacctgcagcttttgcagagggccaccctggaccctgagactggggctcctatttctttctctctctctacagtgactgtgcttcctccgtgcagttttctgcaaactcttggagaagtggaggcatactttgtgtgtcttgggttgta

SEQ ID NO: 515027 - DNA, 470 bp, Homo sapiens
cacgagggcggctcgagcaggatctcgcgccctccgagatcgagcacggtcggcgtgctgatcgcgagcgtgggaagcacgatcttggtgccggcgaaagcctcctcgccaagcgcttccttgttgatcgagaggtaccgatccgcccttgcgctgaggccgcgagcaagcttgtgatggccgacgaaggccggctgatcggcttcgaaagccgcgtttccgaacacgtggtccggatgcatgtgcgtgttgatgacgtagcggatcggcagcggcgtgatcgagcggatggcctggtgaagacgggccccgatacgggcgctgccgccggtgtcgatcaccgccacgggctcccgcccgacgatgaagccggcgttcgagatgtcgccctcgttggccggagcgtagagcccaatctgacctctgtgagcataagccccgggcgcgatttcggcgacaaatgagcccgg

SEQ ID NO: 515028 - DNA, 931 bp, Homo sapiens
  misc_feature (526)..(526): n is a, c, g, or t
  misc_feature (696)..(696): n is a, c, g, or t
ggacatcttggacgtttgctggcagggcagatccgctcgcgcgccgcctagtagatcgggcagtatccagcatgcagggcgaggctgtatcggcagtgtgcaggcaccacgaaggcctgtcagtcagtatgccaccactaggcgcagcggcgacgcgctggcagactcagggcccccgtggtccggccagcttgcgtgctggcctcgagcatagcgcgttctcatggtcgtagcactgatcgcccgagctggtcgatgtgctcaacgccccagggcgctagccgtgcggctcacgggcgcgtcgtccgtcttcaccgtcgtgcggtgatggcccctcgggtgaagtatgcggcgcacgagctgtcgtctggccttttcccgacttgccgaatcctttggccttgcacggaggcatggctgcattggcatgtcgcccagggagcgcgcgctcgacgacggcaggggcactagcgatttgaccggggggagcgcactctgtcgtgtcggcggggctcggggggacagnttgtgatcgggctggcgggtccccggggcgtttgaggtacgcagcttcgtcgagccgagttgggggcacttggtacagcgcggggtcgggcgtccttgatgtgctgcgcccccgtgaacatgcccggagaagcccgggccgtttggcaaacgtcggatggccgccgatgngtcactaagggcccgagcaaggaggtggctcgctagacgtaggtgatcgcgcaacgtttccctcgatgagttccaagcctcttgacatgaagccgaccatgcttgcacggccagaacgggggccaggagcgtcatagggccccaccgtaaagagcggtcgtccccattgggacgcaacttgtgaagcgatggaatcgtggggcattttaccgcacaatatcgtcagcaagacatt

SEQ ID NO: 515029 - DNA, 572 bp, Homo sapiens
gacgccgtgtgcagcggggtgtgtgcccggggtgccctgtgtgtgccctgggatggggaaccgcggtggcttccgcggaggtttcggcagtggcatccggggccggggtcgcggcctgtggacgtgggcctggggccgagtgccgcggagctctgcggagtgcaatggccgaggataaggatgtggatgcccgtcaccaatgttgggccgcttggtcaaggacatgaagatcaatgtccctgtgaggagatctatctcttctccctgcccattaatggaatcagagatcattgatttcttcctgggtggcctctctcaatggatgagtgttttgaagattatgccagtgcatgaagcaagaccctgtgcctggccagctgcaccaggttcaaggcattttgttgctatctggggactacaatggccacgtcggtctggtgtgttaagtgctccaatggagtgtggccacctgccatccgtggtggccatcatcctggccaagctctccatctgtccccgtgctgcagagtgctacttgggtggaacaagatcggcaagccccacactgtccc

SEQ ID NO: 515030 - DNA, 337 bp, Homo sapiens
  misc_feature (20)..(20): n is a, c, g, or t
  misc_feature (32)..(32): n is a, c, g, or t
  misc_feature (72)..(72): n is a, c, g, or t
  misc_feature (77)..(77): n is a, c, g, or t
  misc_feature (125)..(125): n is a, c, g, or t
  misc_feature (132)..(132): n is a, c, g, or t
attagcccttttgcaactcnacagacctaacngttacaatgaagaagaagcctagaattcaagcctgtgacntccanccttagactgattggccctaaaatgtgtagcttccggtcttgatgagnaaggaanggaacccttagcacctgggcccatagctgctgctcaccataattgggagaatgaacacattatggactgagagggtagcaccgacatatatacactaccatgtgtaaaacagatagccagctggaagctgccatatagcacagggagctcagctcagtgctctgcgatgacccagagggatgggatggggtgaagtgggagggag

SEQ ID NO: 515031 - DNA, 186 bp, Homo sapiens
aatgtatacctctggattaaaaactcttgtaaaatgattatcccctgcacatgcacaatataggacactgccatttgattcataagtaggaaccctctggtagttgcaatgacgtaatcagatacaccgatatcaatgggcaacaattaactgatccttagcactttcacattgctaattgccaga

SEQ ID NO: 515032 - DNA, 126 bp, Homo sapiens
aacttcttttatagtgctagtgtatactgactcccgagttcctggcccccagagcaataagctactgtcagagacaagaacatccaactgctgatatgcagcaatccccatcatgccccgcagctc

SEQ ID NO: 515033 - DNA, 112 bp, Homo sapiens
  misc_feature (51)..(51): n is a, c, g, or t
cactaagtgagtcaccattttttggttccatacatacgagtatctttacanctatactgcagtctattaagtgtgcaaaccattatgtctaaaacactacaggtactaccta

SEQ ID NO: 515034 - DNA, 357 bp, Homo sapiens
ccgttgtcagtactggggaacggtgtgagcaaaactgcagagaaggaaaagaatatggaacagttatgggtaaaggagttagagatgtatggctaacgaaagactccagtgcctacacacttgaaacacaagagtccaaattcctagtgaggtcacaattcagataataaaaacattctgaggatttgtttttctcctaccaaaaaagaaagccaaagtttgattcaaggtgtcacaaactgagatatcagcagtaaaggaccaatgcaaaataggcaagctaacagctaagcagcatgctccaccatagatcttaaggagatgaataagcagatgcacacactgacaacggggagt

SEQ ID NO: 515035 - DNA, 1377 bp, Homo sapiens
gctccctcaaggtgtgacgcgagctctgccctttaaccggaaacgtctccctgctcaccccacacccctgctgcatgactgcatgttgctgatgcaccacatgcgtacctgtgatcaaatgacgtgactgccctgtgatgctggatgttactggctgtgctactgtgatgcctgagtctttgtgctggccaatctgtggatgtccctgcgtgcggtgccacctggagaaactggaaggagcctggttcgagctcagcccctgagcgtaactgtgtgtggctcctcgctgccagaggcctcacctgcactgcccctgagccttccatgtcccaactgcctgtggtccctgaagccatccctacgccccgagctgcggcctccgcggccctggagctgcctctcgggcccgcacccgtgagcgtagcgccttcaggccgaagctgaagcgcgctccacaccaaggccccgccggctctagactcggtcccgagacgttccgccagcgtttccggcagttccgctaccaggatgcggcgggtccccgggaggctttccggcagcttcgggagctgtcccgccagtggctcggcctgacatccgcaccaaggagcagatcgtggagatgctggtgcaagagcagctgctcgccatcctgcccgaggcggctcgggcccgcggatccgccgccgcacggatgtgcgcatcactggctgagcggtggagctgcgggtggccagggccgggcgctctgtgcggactggggccatgatcgggcccgggggcctgagcctgggaccccaccccgtgttaatgaaaaatgagttttggcagcgaaaaaaaaaaaaaaaaaaaaaaaaaaaaaaaaacaaaaaaaaacaaaaacaaacaaaaaaaaaaacagtggtggggcgcgcgcgccgcgagccacagagaaagccttcttcaaaccacccgctggtggggggcggcgggagcccaaaagggtgaagaggaacacgggggccaaaggcggtgcccacagagagagacaccggggggccaagaacacgggggcgggggtttctcccaacaaaaaaaaacccccgggggggaaaccggcagggtttcaggaaaaaaaccacaagagggagcttgcgagaggaaaaagaggggagcaacaaacaagggggcacagagaggaagcaaaacaaaaataaccccccccgtgggtcaacaaggacacagacagacgagagggaaaaaaacaacgaaaaaagaaagaagcacaagaggaggaaacaaaaagaaaggagacaggcgcaagaacaggaaacaaaaacaagacggaacagcaagcagacacaaacgggagagagagcagaagaaagaaaagagaca

SEQ ID NO: 515036 - DNA, 1012 bp, Homo sapiens
  misc_feature (762)..(762): n is a, c, g, or t
ctgtgctgtttccccatggtgtaccccatgaagatcacaggaaccgtgctgtgatggcacttgtactacatctggcttcactcgctcatcggttgcctgccacccctgtttggttggtcatccgtggagtttgacgagttcaacatggatgtgtgtggttgtttgggaccgggagacctggctacacggccttctggcagatctggtgtgcccttcttcccctttcatggtcatgctggtgtgctatggcttcatcttccgctgttgggcaagggctcaaaggcacagcaaggtgcactgtggctcctagttcgtcatcgtggaggaggatgctcagaggaccgggaggaagaactccagtcatcctccacctccctcttcgaggctagcaggaggaagtgcctttcaggctgtggtctatttcggccaaccagtgcaaagccctcatcaccatcctggtggtcctcggtgccttcatggtcacctggggcccctacatggttgtcatcgcctctgaggccctctgggggaaaagctccagtcatccccgagtcctggagatcttgggcatgatggtctgtcctttgctcagcgatgtgtggcagcccctgatctatggagtctggaacaagatcagttcgcatgagaattagtgggcatgtgcttgggggaccggtattatcgggaagcatttgtgcaagtgactgtggacttccagggtcttcagcatttccaacatgatccacagacctgtgtctgtcncagagctcaatgggggcatggggaggtggaaagccctggggccaggacaggacgggtgcctggttcaggtgtcccggatccgggccgattaaagtggtggggagaccgcgtgtgaaaacctcccttcaaggtggcccccaaaaagggccggcgtgggggagggcacccaaaacgcgagacatctctgaagggcaactgtgacccttggcctgcggcaccattgggggcggggacacacggggggcgggat

SEQ ID NO: 515037 - DNA, 775 bp, Homo sapiens
taaaaacagtctcactctgttgcccaggtgggagtaaagggcaggggatgatctcggtcatggaacctccgcctccggggctcaagccatctttccttagcctcccaagtagctagaactacggggtgtgtaccaacacgttagtggctaattggtttgggtttttgggtgtgtgtggagacagggtttggccagtgttgcccaggtgggtctcgaacgcctaggctcaagtgatctgcccacctcagtctccctaagtgcggggattacagacgtgaaccacggggcccagcccaaaccttcaccttctaagggcacggggatgaacagaccgatcggcttgagggtgggcacaaggggtgtgggctaggttataaggaagtggtaccaaataacggtgtgcctgagttccaccgcaagattactaaaagcgggaccagaccagaaatgctaaagaacatggcctgttgacatgtcatgagtcacctgaccccaaagcatttttggtttttgataaaccctccaattcctgattctcaaggagtgtttcaccggttcgacaaatgcatagtgggatattttggggccctttcaatgtggaattgggcctctttaatggttattccaactttatcaatgttttttgttccccttttaccggggaaaggggaacatttttggcaggggttaattatttcctaggcggcccacagtttgtgcagggtaagggaagtttgttcgtgaccaactgacaaattttgtggccaaattttat

SEQ ID NO: 515038 - DNA, 161 bp, Homo sapiens
  misc_feature (47)..(47): n is a, c, g, or t
atcttactgcaggatctgccgaagaaaagaagtgctttgagttcttncctctgctgactagacatgatgttactacatgcttcaagctgaagaatctaaatgtcgtctatgactcacgtaccaaataatataatgctatactaattacttgtgaaaacaac

SEQ ID NO: 515039 - DNA, 395 bp, Homo sapiens
agagtgaaactctatctaaagcaaaacaaaacagacatacaagcagccaacagacgtaaaaaaatgctcaacgtcgccaatcatcagagaaatacaaatcaagaccacagtgagaccaattaatagctcacaccagtcagaatggcttttgttaaaagtgaaaagataatagatgttggtgaggctgtggagaaaagggaatgcttgtacacttttggtggaaatgtaagttagtttagccaccatggaaagcagtttggagatttctcaaagaacttaaaacagaactaccattcgacccagcaatctcattactgggtatatacccaaaggaaaataaaatcgttctatcaaaaagacacatgcatggcaccagggaactcgaaccccgtgag

SEQ ID NO: 515040 - DNA, 150 bp, Homo sapiens
ccaggtcacatgcagatctcatcctttgccaatttaagtgtctgtgatgggcgcaaagcgcgttttctctagagtggcgcgctctgtgttcgctcgctcccacgtctctcttcgctctggcgccacgactttgaagcgctctccgtatct

SEQ ID NO: 515041 - DNA, 387 bp, Homo sapiens
accgcccgcgccccgggaaggaaaaacactcgctcccggccatacttgggtgtgagttttgacccctggaggagcccctgtggaaacagagcaatccccatggagtttgtgattaagcaggctttaggaggggccaccaaggacatggggaaaattctggggggtgacgaggaaaaggacccaaacccccccaaaaaggaggaggagcggcaggaggccctgccccaggcggaggaggagggcatggcgccccgggccccgagtttaacttaaaccgtggtgtcctctgtccgtttgtcctgggcctgcgcctcctcctgcatgtcggggcccctgggtgtgttctctccggatggaatcccagccaataaaccccagtgatttcca

SEQ ID NO: 515042 - DNA, 386 bp, Homo sapiens
  misc_feature (326)..(326): n is a, c, g, or t
aaatatatttttttaactcttatttcaggttcaagggtacatgtgcaggtttgttatataggtttgtgtgtcttgtgggtttggggtttggtgtacacgattatttcaccacccagtaataagcatagtacctaatagggaggttttttggtttggtttggtttggtttggtttgtgacggagtcttgctctgtcgcccaagctggattgcagtggtgcgatctcgggtcactgtaaccttcgccttccaagttcgagggattcttctggctcagactccctattagctggaattacaggcatgtgccaccatgctgggctaattnttgtattttcagaagagaccgagtttcatcatgttggccacgctgtgctcgcccctgcct

SEQ ID NO: 515043 - DNA, 427 bp, Homo sapiens
aactagtggtgcacgaattctgcacgagacgccttcctgctactctgcaggcatgatctgttcattatagagagaagcgtgctatgtgacaccagtgcccatatgtcaaccttaaggactagctgttgtttcccagctgagacgctctgatctcagagatataagggtccgctgaagcccggggcacgcatcttctcctttgacggcaaagacgtgctgaggcaccccacctggccccacacgcgtgggatggctcggaccccaacgggcgcaggctgaccgagagctaatgtgagacatggccgacggaggctccctctgtcgccaagactcattctgttggggggcaagctcctggggcacagagccgcgagctgtcattacgcctacatagtgctttgtattgagcacatttatgctggcttcc

SEQ ID NO: 515044 - DNA, 321 bp, Homo sapiens
gtctatgagacggacactaacctcggtcgcccagggtggagtgtagtggcgtgctctcggcgcgctgcaatccctgcctcccaggttcaagcatgtcttctgcctcagcctcccaagtagctgggatagcaggtgtgcaccaccaggcctgatttttggtatttttagtagagacggggttcacctcgttagccaggatggtctcgatctcctgacctcgtgatctgcccatctcggcctcccaaagtgctgggattacaggcgtgagccaccgggcacggcccccagaatttcttaagaagataaaaactctgggctaaa

SEQ ID NO: 515045 - DNA, 589 bp, Homo sapiens
ccgtaacatggtcatagcctgttcctagaggtaaaacggcattgtgtttgcagctgctccaatggcaaaagcggccctcattctattcaatgtcacagagagatgacacagtaagctacacaatgttaaatctcgagaagccacgtcgagtgcccggcgcacatgattcagtcatcctgaatgtcctctatggcccggatgcccccaccatttcccctctaaacacatcttacagatcaggggaaaatctgaacctctcctgccacgcaggctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaagctacctgtggtgggtaaataatcagagcctcccggtcagtcccag

SEQ ID NO: 515046 - DNA, 175 bp, Homo sapiens
acttgccattccagggctggctgggccggtttggggctggcgggcctggcgttggggtccccaggctgcagggtcatggttgtgtgtcttctcctgcggaacgtgtgaggtgctcccataaccatcatgactaccccgccgcaagggaaacagggtcctggatcatcctaagggt

SEQ ID NO: 515047 - DNA, 1614 bp, Homo sapiens
  misc_feature (736)..(736): n is a, c, g, or t
  misc_feature (996)..(996): n is a, c, g, or t
  misc_feature (1005)..(1005): n is a, c, g, or t
  misc_feature (1055)..(1056): n is a, c, g, or t
  misc_feature (1074)..(1074): n is a, c, g, or t
  misc_feature (1102)..(1102): n is a, c, g, or t
  misc_feature (1141)..(1141): n is a, c, g, or t
tggggtcccaaatttcttttttggaaggaatggtccaaatcaaaaaacttaaggggtttgtttgggtacaatcttataaaaagggtaagggaaccaccccaactatgcttgcactggccttggtgcaccagggaatgtcaccccagggttaatgggggaatattacgcccgaggtcttagctttcatttatcactggtctcccagggtggtcgcttgtcaacagagtattattccggccaaggccaaattcggggcgccccctattcttggccgcaatgttggtcgtcactgggtgtccccccaatttctttgagatgggtttacacaccctggtctccatcacagggtaaatggtgtgtctccaagtggacagtgtcacaccaaaagtgggggggtgtaacattatttggtccatgtgggccaaatttgtgtggtgcagagttccccagagtttgagtgtgacacgtgatatctcccaactttttttttctccccaagtgttttcatagtgcccacaactctccatatgtgccatattcagagcccccgtttatctctccccaagtctcaatatcaaaaagaggtcggtgggattctcggtggtgaaatatactccctgtgaaaaagggacagagatatctcgggggccccccacctcctcctggtggtggtgtttctctcagcagagctttctccaaatccagagattctccctcacagacagtgttgtttccnccctctctctcctctcaatatgacagcaaattgggcggtcgaaacacgaaagcgatcttattttcgggcgcacacaagaagtttctctttttccaaaaggaggccccgaaacattattacataatcgccgggcggggccccaaaaacaggtcttcgagctacaaaacgcacacactttggtgtgccaccgggctggcttaaacaacccgctgataacagcggaaggcggcggctgactaacagaatggtcctcccccagngcgtggttntcaagaacgcactatggggcgcgaccagtgtcgatagtcaagacatcatnnggacgacagcggcaggcnccactactttgagagaaggcatccaccntgggaggagagagaggggcaacaaaccatatcagtgtgngcggagcagcccacacccacttgtgcggcaagcaaacgatgtgtgggacgaccgcgccgggacgtcaccgcgaaatcaacatacagtggaggggcggggcccacaaaccagctaaccagggcgaaacaagaagcgccctcgacgatcgagaccagatcgcataaggtacgaagagtatagatatcactatgcagccggaggacagccgattgataaaaacgagcacgacgagcgagggtgggagcccgcatcgagtgctggggacacccacacccaaccagggtggttatcgtgagtgactaaacaacaacctgatgcaaacctgcagaacagggcgtcacgtacacataataatagtgccagcggccccgctagccagcgtgctggtggtggcgcaacaccacacgccgcgcacggaggtagtcccgagcccacacccaccagcgtgtggtcaccacagatactccaacaga

SEQ ID NO: 515048 - DNA, 923 bp, Homo sapiens
  misc_feature (2)..(2): n is a, c, g, or t
  misc_feature (114)..(114): n is a, c, g, or t
  misc_feature (165)..(165): n is a, c, g, or t
  misc_feature (168)..(168): n is a, c, g, or t
anggagcgcggggaggacgtaccttgtgagatgcgagccggccaacagcttgcaagcatgctccgctggacccgagcctggaggctcccgcgtgagggactcggcccccacggncctagcttcgcgagggtgcctgtcgcacccagcagcagcagcggcggccgnagngggctgccgagccagagcgcttctggacaagggaaggcagacctcccggaacgtacagatcatattttgcacgggcatcttcggcagacaaaacataacattcaactcacatcgccaagatcttggcaccagcagacaggccagtagggatgctgacggtggaattgctcgtaacacacaggatgacagaaccccacagacgcagacaatgagacatacgagaagtcatagagccagagaactgaaggaacctatcatgccaccagcatgggacctggtgccactgacgtcgatcagatatggcacacagacaatgaggcaggacaagacaaggcaatgatgcatggacactaacagaaggccagcagctggtggcaacgtctcactatgactgtcgactatcagccacagtggaaacagcacagagtgtctcaccaacataaagaaaaccatatgtggaaagacaatgagaggccatcgaacatcgcaggatgagctggaaccggaacccgatggcccgaacacactgacggcatgaaacagactccagaacaagacagtccaggaaaatgggacgtaacagcaagcaccctgagtcgaataaactgagataagggtaaacagggacgctcggcgcggacaggagaaccgaagcatgaccagacccaaagcaaggaacacaacagaggaacacaacaagacaggaaacaaacacacgaccaaaaacaaagccagaccgaagcaccaagcaagca

SEQ ID NO: 515049 - DNA, 648 bp, Homo sapiens
  misc_feature (2)..(2): n is a, c, g, or t
  misc_feature (114)..(114): n is a, c, g, or t
  misc_feature (165)..(165): n is a, c, g, or t
  misc_feature (168)..(168): n is a, c, g, or t
  misc_feature (290)..(290): n is a, c, g, or t
anggagcgcggggaggacgtaccttgtgagatgcgagccggccaacagcttgcaagcatgctccgctggacccgagcctggaggctcccgcgtgagggactcggcccccacggncctagcttcgcgagggtgcctgtcgcacccagcagcagcagcggcggccgnagngggctgcctgaggccggaggcctgcttcctgctttcctacgaggcttccttggatcggggagggcagccctcccggccgtcgtcttattttgcacggggctccttcggcaggcaaaactaancttcagactccgatcgccaaaggatccttggccccgaagcagacagggccggtacgggttgcctgactggttgggactcgcttccgtaaccactgtgttgacatgccctccaccaatgcccatgacaatgcagctaccgagaatcaatggaggccaaggaacccttgccatggaacccctttcttgcccccaagcttgggcccttgtgttgcccctgcagtcggtccgtatggcccagcagcattgggacggcacacacgaccatgccatggcttgctgggccactaacatgagtgccagaagcttggttggaaacggtctcatttgctggtacgaatatcaagccccagtggcaaaa

SEQ ID NO: 515050 - DNA, 204 bp, Homo sapiens
cacgagggggaatgacattacaacaaccacaaggggtcttcctgtgtccctcagacatcatatcactgcattacatcaccatatttctttctggacaaatgtccctggacaattcaccctgacataagtcacctgtcattcttgctcaacatgatgctgcggctttccagatgtggatgatgatatgccaaatcaacccttaga

SEQ ID NO: 515051 - DNA, 774 bp, Homo sapiens
ggattcagtggcagagaggtgctacagggcggcgaagctgggcacctggactggggaggtacgcgcccatggcctggagctggaccatcgtgttcctggacgcagacattgggggccgcgcgcagtaccacacgtgcccgcgtgatgccgtggccacgagccgcgaggtggcccgaagcccagccactgcagccgaggcacgtgagggctcatctgcgacgtggggatcggtgaacgtcgccttctaagtgacccctgtgtgtgactgcgtacccgcccctgtgggcgacaagaagtcatgcgtgacctccttctcttccatgagcggacaagaattgcttcctacaagcagcctgcagggaggcaaggggcagccccaacactgcctacagcagaggccaccctgcagaaggtgacgggcgggtgagcaggcccagcccccaggggaccaggagcctgaggctgtgctggcaatgctcaggtccctagacctggagggcatgcggagcacgctggccgagagcagcgaccacgtggagaagagtccgccagtccctcctgcaggacatgctggccacacgggaggcttccatgcagggggaacgaggcacgacagcgtactgagcagaagccagagtctgtccactggggcgtcaggaccaagggaggcagcaccatgtccttcctgtgggacacagcgagccaccagggctccagcccagacccggtggatgcctctggggaagcaaggacaaggagagaagcaaggtcaag

SEQ ID NO: 515052 - DNA, 239 bp, Homo sapiens
  misc_feature (82)..(82): n is a, c, g, or t
  misc_feature (215)..(215): n is a, c, g, or t
cgctgggtgatctagaggatctcctcgggttgacacgggtggctatgtggacagcaagagtcgttttcgcggaagcgactgncagcaggctgtcgggccccgatgctgcccatttcccttccagcaaactcactcggcaatccatgcacctaagataccagcacaagtcggttaatccctgtctggactgaggcctcggttggcttctgaaactncaatcctgcagctaaacccttcca

SEQ ID NO: 515053 - DNA, 338 bp, Homo sapiens
caaaaaaaaaaattggggggggggcccatttcaccccttgttttttgcccccggggggcccccggggccaaaaccaggaattccccccccgggggggggggggccccattgggggggccccccccccttttttaggggtttttccaagggttttaaaaaaatcgccccctttgttgcgggtccccctttggggcccccccgggttttaaaaaaaaggccccgggggggccccccccccgggcccggggccttttggggttttttttggtttttttgggggggggggggcccccccctttttttttccccccctccccggtttttgggggggggtttta

SEQ ID NO: 515054 - DNA, 523 bp, Homo sapiens
  misc_feature (136)..(136): n is a, c, g, or t
tatcactcgtccttacgttacagactcaacatactaggtcataggcttttcctgctgttacatatttaccacaacacaatggggctcactcacccaccacattaacaacataaaaccctcattcacacgagaaaanaccctcagttcatacacctagtcccgccagttctcctcctagtccctcaaccccgacaatcagttaccggggtttgtcctcttaaggaaaaaaaaaaaaagagaaaaagaagaacaaaagaaaaaaaaataaagaaaaaaaaagaatggggcggggggcggcgggcgagaagagaacactcttcgaagaacccaatgcgtgggggggcgccgcgggccacccagagggcgacgtacgaccaagctgggcacaaggtgtgtcccagggagaaaccgcgcggccccaagcatagatgcgggtgggttctccacgagatgaaaagaggcgggggggacaacgcgtcgtctgtgaaacaaccccggaggcggcgagcggaccctcgcgggc

SEQ ID NO: 515055 - DNA, 226 bp, Homo sapiens
  misc_feature (136)..(136): n is a, c, g, or t
tatcactcgtccttacgttacagactcaacatactaggtcataggcttttcctgctgttacatatttaccacaacacaatggggctcactcacccaccacattaacaacataaaaccctcattcacacgagaaaanacccagaacgacccaccgaagaacgacccaccgaagaacgacccaccgaagaacgacccaccaaagaacgacccaccgaagaacgaccca

SEQ ID NO: 515056 - DNA, 147 bp, Homo sapiens
gctgccgagtcatcgcgtctctccacgagaggcatccagcgaggctctgggggtaggggaggtgctccatgtgaagacagagtcctggcaccccgcacgtgtctcctgggagatgacccaagcatcctcatttgaaaccgtccagat

SEQ ID NO: 515057 - DNA, 930 bp, Homo sapiens
  misc_feature (321)..(321): n is a, c, g, or t
tggggttggactcaggtttaaaaaacgggaacggtgaaggtgacagcgtcgtttggagcgagcttcccccaaatttcacatggtggccagaggactttggatggcaccattggtggtttttttataaataagtcattcccaaattatgatgatgcttggtacaggagaatgtccctggccatcttaaaagccacccacatttctctctagggagaaggggcccagtcctctccacagggtccacacgggggcgggtgatacgcatggcttccgtgtaactttcttgtcgttgcaacactcttttaaatctccgcctaaaanaactttataattggggtctcattttggaatggatagagccttggggcccccctttcccctttttgtggtcccccactctggacgtctgtttcgagggctttgggtacccccctgggaagttgggttggcaggcacgccagggtttcacctggtacatctgacttgaagacactgttggaataacacgttgctaccctcaaaaaaaaaaacaaaacacacaaaacacaacttttgcggggctgccggcgcaagaaaaaagtttcaaaacaactgtggttggcgcgcgcggcccatagtgcaagtacccacggccacagtgggtgcccaaagaaaaccggggctcagcaacttgtggcggtctctacccaaaaaaaacccgcggcggagccggggttctgtagaccaaccagggtgggtcttgggcacctgtgcatcacccagagccaagggcgtattatccgcccccgtggtggaggaagaaaaaagagaagagcaacagacgagaaacgacacacacaacagcagcaacactacaaacgagtagagaggacacaaaaagaagaaacgagaagacgagagaggcaagcagaggaaagagacacacaccga

SEQ ID NO: 515058 - DNA, 351 bp, Homo sapiens
gcaagagaccgaaaaagcctaaggaaggaagaggtgggtccacgaaagcaagcagctcatcttgtactaaacaaccccccagatgccttccgatgggaggctgcaggacatacggaaaccaaagagaagggaggatgggtttagaattaacaggcatccccagcccaccccagctcactctgggggctctgtgtgcatcatctgagcagacaccctgagccacaaagtgcccaggtcagtgctgatggctaacacagagtacatacccagcacatagtacaggctgcccagcatgtagtacaggctgcccagcatgtagtacaggctgcacgctgctctcctggaatgggg

SEQ ID NO: 515059 - DNA, 192 bp, Homo sapiens
gtatcagaggtggtgggtgaggaatatgatcagatattgaaggtgggggatctcactaaactgacttagcaggattcttgctaaagctgaattctgccaggatggaaacggaagccagggagaggctgggtagagaagaggatccagaggagcctgactaaagtttggccagggagagagtctgtcaggggt

SEQ ID NO: 515060 - DNA, 918 bp, Homo sapiens
ggcaaagtggattgtgataatcatggtgcccctcggaacaactgtattgctgtggagcctcttgagtatgtggctccgggtgtggaagcgggtctgtgtccgggctcggatccaggccctgtgtagtgtgccgcgtccgtggctccgaacgctgggtagcttgctctttgctgcgatgaggtgctgcctggccgagcaggttcaatgctccgatggcccgggagaatctggtatgcccagagaccacaagaatacctataatcaatggatgatgagaatgtccaaactggcatactctaccgacaattgacccggcttgaagctctcggacagcaattgacgctttttgtcaaagccaacgtcgtatcatacaggaggaccatctggtaaagaacaagccataaaccttatatagctatatcgacatcacagggcacaagttggagatgatagctcacataggtacacggcacgatacgcaggggcgggctcgaaacagtactgcatcgtcaacatcaattgcccacctaggttcatggaccacgcgaagtaccgcaggtaaaatgatgtgtccactcttgaacgcgataacgatcacgggatggacacatgacacccagcgcaaaataattgtgttaacactggatatcctcaagttatggacaattaccaaacccggtgacgtcggatataatttgacaggtccagagaagaccaatgttgtgcgcccatagggccgaaggcatccttggtgaagaacaggtgcaaccgagtaatacacaggttaaattccccagagagacaggccgtacaactgttgaccacacagaattccagggtaagaacccaacttcggataaggtctggcgggcgcagatatagcatgctcaagcactgacgcccgggtgacaacaatcc

SEQ ID NO: 515061 - DNA, 84 bp, Homo sapiens
tttttttttatgtttaacaacaaaaaaaactttattgaattacaaatttttaaaatggatcacttaaaagtgagattattttat

SEQ ID NO: 515062 - DNA, 298 bp, Homo sapiens
ggtaccggatgagtggcagtgacgataaggagacaggtgtggccatgtgagaaatgctggtgtttcataccaggggatgatactggatttatagtaaaagctggaatcagtgcttggcttaggtggcatgtgaagtggtgtagtatttgcatataactatgcgaatgtatactttaaatatctctagattacttataatacctaatgcaatattactgttatatagttatactgtattttaaaaatttgtattttttattgtatttttaaaaatagtttttacctatggatgcagaca

SEQ ID NO: 515063 - DNA, 283 bp, Homo sapiens
ctagaggatcccccgatagcactactacaccagcctggacaacagagggagacccataatgtagaatcagatgtgcgttgttaagtcttgtccttcctgcgactggtatgttcccagctcctgtctgtgtggctccttgcggctccctcgctcacgggttggggacccctgctcgagtgcatccgaaaggagccttcccataccattcttcctaggaacgacatataaggcactctcccctgaattctacatcacatattttgtcgccgagccccagttgcgg

SEQ ID NO: 515064 - DNA, 308 bp, Homo sapiens
tacgaaggagtatgtttaatagtatttgtataaatttggaggttctgttattttattccgtttctgtcctgtgtagaggtaaaaactttacttatatttcaccataattgattttgagctccaatttgacatttcatatactgcccaaatcggaagtcagtcatgaattttactctttaactacaattcagtaattgttgatagggtcacttacctagatcatccatactcatattattcaaatatataggtggttcttgtgaaacaattacattggttctgttggttgaactgaggttcatgaatat

SEQ ID NO: 515065 - DNA, 111 bp, Homo sapiens
tatgagacgactctagaggctccctcattcgaacctctgcggaaagcaatataagaacccacataaacgcgttaattggctgtagtggtctactagtatacgggtttaggg

SEQ ID NO: 515066 - DNA, 318 bp, Homo sapiens
aaaaaactggggggggggggggggcccccccccggggggagcccctttaaaaaatttgaaagggggttaaattttgaaagaaattggaaaaaaattgggaattttatggcccgggagaaggggggtggggtttaaaaaaacccgttttaatttgcccacctaagcccttagggaagaaggggtaaagggtctttaaaagtttccaaagggttacccaaaaggatgtgggggggatggggccaaaagttcccaaatttaacgggggggccgggggggtccttgggcgggtttttttttttttccaaatggtttaaagga

SEQ ID NO: 515067 - DNA, 605 bp, Homo sapiens
  misc_feature (421)..(421): n is a, c, g, or t
  misc_feature (576)..(576): n is a, c, g, or t
ggggaagccctttcatttgaatgctgagaacgacgcgctcaaagaacccagcgaacaaaggagagggttggagcccacgcaaaacatgggtgtgataaagccacacgcgacctgagcccccaccctcagtaactactctccagcgcccaccgggaggaggggtccgcttttgtttttgggggggtctgcttctgcagaaaacatggctaccaacaggttctgaatccacctgcggaggggactgactgctctgttattcccccagcatctgtgaagaggctctaactggataaagaggtgatatagcgatcaccccaggcctagccaaccatggatggagaaaaggaaaaacgttttgaacctaggttttcggagctacccacaggaagctaggaggaaacgggaaaaagcccgcatatanggattaagccagtgcccaaattttcaaagatccttgtactgtaaaaaccggcaaaataaaaaaaaaaaacaggcaataaaaaacaagcggaaatagttctctgaacttgaggaaactttaacattccctcaaaatttttccatcaacaaaacaanaatgctaacaaggctgggtcccagaaaca

SEQ ID NO: 515068 - DNA, 347 bp, Homo sapiens
aagcggaatgcccgtgctcccttggtagcctgccgggatctcacgggtgttcctgacggacgtcatgatcattgttccgtcagcaaacttgactatctcgcccgcgccattccgtgcgttctgggtgtccagtcggcgccatggaacggttgtgccgttgattttgcctctgaagccgcagtagctcgcgtccgatgtcaacgcgaactgggtccagtttccggatgggatgtcgtatgccacggtagaaacggtgccgaaaccatcggttgggcggccgactgtcgaggggccgaaccggttaaattcagtgacggttggcgcctcgatgttatccctgtaaaccg

SEQ ID NO: 515069 - DNA, 400 bp, Homo sapiens
gcatgaattaaggtatgtggaatggcaaatcatctgcccctcttcatcctcgttaggcagaacatgtgtgtacttgatacttccctggtcatctattcaccatacagtccactcatcggaagccctcttcacgcattcatctttcagttgcagtggagtcttccaatagctctggagccatcatctttacccataaggggtttatctggttcagcatataggctacgttggtgtcgctaaacagttcgtgaggactggcacattgataccaagcgtgatgagtcagtaaccgcagacgtataatatacaggacatcaatgggcaccagtacgaggacaggggcttcggatgttcctccacaccagcgcaacctccttgggcgtgaaaatccaaactgcag

SEQ ID NO: 515070 - DNA, 163 bp, Homo sapiens
  misc_feature (48)..(48): n is a, c, g, or t
  misc_feature (68)..(68): n is a, c, g, or t
gtgaggcaatggccatgggagtttattactatcgtctcccttctcttncttttagcagagatggaacntaagaagatctccggaccccgcattaaatctgggagagatagttggttggtgccggcctgggttcaggtgtggcagaagcttgcagatgcgtccg

SEQ ID NO: 515071 - DNA, 396 bp, Homo sapiens
ctacaagagcgagatgctcggccatgtgcatggtatttaggtcaagtggcatgttctgtaccaatgcacacagcaaaggtcctcaggcactgattcacattacccaaagtcatcatattttagagttgtctccgtggctgacatttcttagccttgccctcaaacttggcaggagggaggcaagctcgtttaaagaagggagaggggaggagatccaggcaattggcctaggggttggctttgagagagaataggttgacccttcctcggaaagagggaagggggaagcagggagccacgaagagagagaggtgccacgggaactcctggctgccgactcccgtcttcttggtgaaggagtcaggattaggtgtgaaagtgggagatgaggggcat

SEQ ID NO: 515072 - DNA, 1055 bp, Homo sapiens
gagcggggtggggggtggggggtgggggggtgggtgcagaccataaagactcagctgagtgctgctgtccgggggccggctggctgcgccctcattggtcccattccctagctgctgcggtggccattgcttcgttgccgggttctggcatcaggcaccgtggatcgcagttgcacgagctttgctttatccggggcttgtgtcgcagggcgccggtctgggattccgccaatcttgcgacaatcctgaggacaagagaaaagctggcggtcgttgctgttgcacctcccaaggcttctcagtgttcccatcaccatccgaacaggactgaacagcccatcgtttctggcacgggggcattgtcgtggcactgttgactgcccagcttaatggcagtaggtaacggaaacgttccaagaccctagcgcaccggggcaacgggaatgctcagggagcgcagcggggcgctccgggctgaacaacctacttcaccgttctcgtgtctcctcaagggcccttccccaagggtgaacgcaccttgttgtgggccgtggatcgaacaaccgcaggaacacttcgttcaaataggtgtgccgtaaaacgggctgcaacaatttccctccaaggattggaatccggcggtgcaaacgcgctggaagatttgtgccacgacaacataattgtgcccaagaccgtttgctccctgccgtcgcggtataaattcctgcctactctgaacacaagtggaatccacacaacgcaagttccatcccccttaaggcccttaatgcgcaaaaaagcggtgttaccaccttaagacggggacaaccctcagcgtgaggggaaaacgccgctaactgcgttgcggcgggcccgcctgtccaaggagtggctgccgactaacgaccccgttggaacgcagcccccaaggccgggacagtaacttgggggcggcgacagaagcagagccggacataaacgggcaaccggacaaacgcgccatctgcactgcggggaggcacccaccggcgcagaataaccctcgcgcacggccc

SEQ ID NO: 515073 - DNA, 567 bp, Homo sapiens
  misc_feature (70)..(70): n is a, c, g, or t
  misc_feature (72)..(72): n is a, c, g, or t
  misc_feature (75)..(75): n is a, c, g, or t
  misc_feature (107)..(107): n is a, c, g, or t
  misc_feature (120)..(120): n is a, c, g, or t
  misc_feature (125)..(125): n is a, c, g, or t
  misc_feature (136)..(136): n is a, c, g, or t
  misc_feature (143)..(143): n is a, c, g, or t
  misc_feature (149)..(149): n is a, c, g, or t
  misc_feature (160)..(160): n is a, c, g, or t
  misc_feature (169)..(169): n is a, c, g, or t
  misc_feature (185)..(185): n is a, c, g, or t
  misc_feature (192)..(192): n is a, c, g, or t
  misc_feature (194)..(195): n is a, c, g, or t
  misc_feature (202)..(203): n is a, c, g, or t
  misc_feature (209)..(209): n is a, c, g, or t
  misc_feature (219)..(220): n is a, c, g, or t
  misc_feature (224)..(224): n is a, c, g, or t
  misc_feature (233)..(233): n is a, c, g, or t
  misc_feature (235)..(235): n is a, c, g, or t
  misc_feature (244)..(244): n is a, c, g, or t
  misc_feature (246)..(247): n is a, c, g, or t
  misc_feature (260)..(260): n is a, c, g, or t
  misc_feature (267)..(267): n is a, c, g, or t
  misc_feature (275)..(275): n is a, c, g, or t
  misc_feature (277)..(277): n is a, c, g, or t
  misc_feature (283)..(283): n is a, c, g, or t
  misc_feature (289)..(289): n is a, c, g, or t
  misc_feature (296)..(296): n is a, c, g, or t
  misc_feature (299)..(299): n is a, c, g, or t
  misc_feature (312)..(312): n is a, c, g, or t
  misc_feature (320)..(320): n is a, c, g, or t
  misc_feature (360)..(360): n is a, c, g, or t
  misc_feature (383)..(383): n is a, c, g, or t
  misc_feature (390)..(390): n is a, c, g, or t
  misc_feature (405)..(405): n is a, c, g, or t
  misc_feature (411)..(411): n is a, c, g, or t
  misc_feature (441)..(441): n is a, c, g, or t
  misc_feature (457)..(457): n is a, c, g, or t
  misc_feature (477)..(477): n is a, c, g, or t
  misc_feature (560)..(560): n is a, c, g, or t
gaattttcagagctgtcattccggatctcagagctggcccgggagccccgggggcccagagaacgcaagntntgntggctcagcggacggagaccctgtgcagattnacttcatccacanccatntccccggggangatcaanaccgangcactgtgganctgctctcnctgcttctctccttangagcacncnnccacccnnattaanccctggggcnngggncaggcgacnanggcaccaancnncaggcgggagganccggcangggaggancngcggcncccggncaccttncanctgtggcacggancgggaacngcggcagcagcagcagaccggcggcgtggggggccccgangaaggatagcctcttgaagccanggctcanggctgcttgtgggangggccnccgccgtgtccactcaagccatccacaacngctcccctaagtccantgcctcccaaccaggggctncagcggggcagggagcccccgcccctccccctgcctcccaagagccccttcccatagctggaccaggtgggacagggattttnggaggag

SEQ ID NO: 515074 - DNA, 659 bp, Homo sapiens
cctcattcatcacttgggacacatcgcctttgcattgtcttgtcacacctccctcacagatcttatagacacaatatacccaatatcagtcccccgctaatcgtgagggcttgggcccaatggtatggtcggaggaggagctcctgcctgcggttttgtgtatgtgtagtatgtgtgtgcgtgttgtgtgcgtgttacctccacaggggacactctacaccagtgtttgatctgctgtgaacagggccagccaggagtggcatggatctcaatctctctgtctctctttctctccttctacccttttggatgatatcgaaatattgtgatttgactaagagtaagggccttgaattatggaccaatattcgtcggtgtgttgctatggtctttacttctaggacaacaattaacaattgcagatggcccattcttgtcattctacacatatgatcctatacggggacatatgtataatatgataaatatatatatagaagccattcccctctgtccccttggcttcggatggaggccttgctgttgagctgaaatgcacctgcagctgggtgctgccagcagctttgcaggccccagccctgttccaatcaacgcagttgacccataaaggaatgagtatcgtccaaaaaaaaacaaaa

SEQ ID NO: 515075 - DNA, 1208 bp, Homo sapiens
tcctggcaggaagagattgagattgaggttgtgcagctgcaagaaacagattgcctgtggatgtgcacagtgagatcctgcgtactggacaaggatgctcatctgctacatgtgctgcctgtgcctgcctgaggcctgaggcccacctgcatccagcagatttgcctgatgggtgaaaatggtgaatgcatggtcctcttgtgcacatgtgcatgatgtgcttgatgacagatcctgcaaatatctggtggatgtgctgtgaatgctggcatgtcatcatgatgtgcgattggtgcaatggccagtatgtgcttgatgctgtgattgaatgctccaatggtcagaacgacactaccacgaacatacaggggattgcatgccaatgactggccttgtggttgctagatggcccttgccccaagataatgcttgccagaaatactgcttgtccaccactttacgcaatgtgtctgatgcagatttggtggtccatcacgttggatgacaacaatgtaatggtctacatcatgaatgtgaaccctgacatagcattggccatgaagcttgccttggcctcatgttgcatagccactccacacgtgcgttggaccctgatctacagatagccacattgatcagagacagtgccaccttggtgtagacaggatgtgagtgctcccttgcacatgtggcccaatctacttcagacagaccacccggtggcctcccctccacagcaaccacgtaataaatacccacgagaaacaactggggaacagttactggactacttggtgccttatcctcgaaagggaccacgacagtgcctgtgtgttacaggacatctctggctgtacttcctgtctcctccttgtatggtcaacatccataccttctaccacctccgtttaacccaaagtttcaccttgcaaatttcaactcaagggataggcggcagcaaaaatttccccctgcagcttgtcattttaccaccgttggacggtgctcttcgccttatcccaccccaagtggcgacactcagttgatcagattaaggccctgcagcaatttgctgtaatacaatctaacatcctgtttgcagcgtactttaacatgataggctccacaaagcaacatgcggctacactcaaagaactctcgagggactgaacaaaaccaccatatatgatactgtgtcacaatcaaat

SEQ ID NO: 515076 - DNA, 279 bp, Homo sapiens
cccggggccgttcccccccccgggttttttccttggccccggggggggttacctttttcccccgggaaccgcttttcccctttggccctttttggggcccccctaaacccagttttttccaaaaaaaccggggggggccgggccgggtttcccggggttttttcccccccccggccccgggggggttatttattttttacccttttttaaattttccccccggggggggggggggtttttttggggggttaatttttttttcccctttttttattttta

SEQ ID NO: 515077 - DNA, 217 bp, Homo sapiens
cctttgtggttctctctgtgaagtgcacattcttttaactgtattctcccatgagaccgttgatgttcacagttcctgataggctctgtggttccactgagcatcacatttggccattctttgccctggctgagagtacactcagtgccatgtttgatccaagaggacccggtgaacgctaaccatattcatttcgtccaggcaagctcttggtgat

SEQ ID NO: 515078 - DNA, 268 bp, Homo sapiens
taatttttaaaaagtagggtccacattttaaagttgtggattttttaaaatgtttaaatcccacatttaaaatggttaaatcccacatttaaacattgccaaccacgggtcttagcaacatctggatatttgaaagctcccaggtagccgagtgtggtggctcacgcctgttatcccagcactttgggagactgaggcgagaagattgcttgagcccaggacttcgagaccagcctgggcaacataagcaagaccctttctctacaaa

SEQ ID NO: 515079 - DNA, 893 bp, Homo sapiens
tttttactcttcgctttgtgaatttgtggtgttaggtgtttgttcttgtgtttgtacgtgttagttcttttagttaaatcttgttttcatatcactgtatctcatttggtgtgtgtgttagctaggtagtcgaagcaaggtgtcttgacttgtactgccgctctttcatgcgtatatggtttgggtattttatttctggggtggggttttttattctggttgtgttcaaaaagttgtgagatggttgtgactagatggggcttcgcttgttgttcgtagatctttggcacctgtttcgctttgaaaatttgtctctacgtggtttcccattactacgtccctggaacgcgcatcttagcgctatgcggccatgttcttcctgccccctgtccccaacctctcttcgtcgttgtcctcatagggatgcttactgacactatctctacgtctcggatgtctcttggacttggaacaactattggagtccatattgtggcctccttgaatgcaagctctcatcgtcctttaatccttccgtgttcacatctccattggaaacctcctagactggtgacacagtgcgtgaagccataaggagagctctgatagtcagtgatttgtgaagagtgcacgtgactggtcaacgaagtgacagacatttacggtagatctcacggaggcgtcaaagagtaacgcaaagtcagctgtgattgtgatttgatgttatttttcaaaaactccttgtacataacgtgatctaattattcagctcctgctgcacaagggctggactgtcggtagggataactgggattttgggccacgtggattttccctaaatttgtcccccctttactctgccctgctaagtttttctctccttagactccatc

SEQ ID NO: 515080 - DNA, 1002 bp, Homo sapiens
cgggacagcagcgagatccaagcccgagccgcaggcgccggtcgccatgcgctgggtccgggcgctgtagaagaatgcgtccctggcaggggcacccaagtacatcgagcacttcagcaggttctccccgtccccgtgtccatgaagcagttgtctagacttcggatccagcaatgcctgcgagaagacgtctattcactttcctccggcaggagactgcccgttcgcctggccaacatcatgaaagagatcaacctgcttcctgaccgagtgctgggcaccccatcggtgcagctggtgcagagctggtatgtccagagtctgctggacatcatggaattccgtggacaaaagaccccgaggaccaccggactctaagccagttcacagatgccctggtcaccatccggaaccggcacaatgacgtggtgcccaccatggcacagggagtgctggagtacaaggacacctatggagatgaccccgtctccaaccagaacatccagtacttcctggaccgtttctacctcagccgatctccatccgaatgctaatcaatcaaacacaacctcatctttgatggcagcaccaacccagccaccccgaaacacattgtggagcatcgatcccaatgcagcggtcttgatgtggtgaaagacgcctatgaatggcttaagcttctgtgtgaccagtattacatggttcccgtgaactgagaatccggaagtcaatgccccaacgcaacagccatcacatgtctatgtccttccactgtgacaagtgtcttgactcttaagaatgcctgcggccatggggaaagccgagcaagggtgagaccccccccaaagatatggggccgggaaaagatgtcatcaatgtgccggcggggtgccttagaaagaaggtgagacgtgcgcacacccacccgcggggatccagtggtggggagccacacaaagagagaggcatagggaaagaaagccaaggcgaagacacaggggc

SEQ ID NO: 515081 - DNA, 137 bp, Homo sapiens
gggtaaaaaaggtttccaaaggcccgggtatttgggaggggaaaaaggtggggggcaaggggaaatgcccccccctttccctggggggagggggggggattttttttccccaccattaaaaaagaaggggtttttta

SEQ ID NO: 515082 - DNA, 193 bp, Homo sapiens
gtgaaagaggaggagatctgagatctgatcttttctgtaggtattccatctccagagtgtcatatctttcccgattaccggatttatccacagacttaagctgagaaacgtcgccatccaggaggcgatcgatcagggctaccagctgctcggacacgatgtttcggaggttgctgtctgcctgtggataaga

SEQ ID NO: 515083 - DNA, 645 bp, Homo sapiens
gtttgcatctacataatacccccttttgactttctgatatagctgatattcatggtgttagcacacagtaggaccttgaacatgttgataagcactccttgaagaaattaacttttgagaggctttaaatatatagggaagtattttctgggttttgaagaatagcaagccatggattaattttattggacagattaatacattggcaacaattcaacacattctgattcaattgtgaaaggggaggcctttaagctaccaacaactatgagtcaggtaataaataaatgaggttggtaatgattagaggtctacagtgagggagtcaatattcaggctaatctgctgaacttgagcatactaatagtacgtttctagacctgggtcaagtaggcacatgtgtctaatcatgctgtatctgcatactgggggtctctgttgtattggacagtataggtactactgtcttactttgctctacgaaacagtggtatgcttagattcatttgactatgagtgataaatctagattatgttatttatgaggatttaagtgtaacaggtacttatagagctcttgccctagattgagcacatatggctagctttcgaagtggtatatccagtgtcaagcttgaaatatgt

SEQ ID NO: 515084 - DNA, 212 bp, Homo sapiens
cgagctgtagtacccctagttttagaagtttcaatagcagagatggggtttctccatgtggccaggctggtcttgaactcctgaccttaaatgatctgccccccaccccgccccggacctctggtttttgttctagagcaattgtaactttcatggcactagtaagatgccccaggaggtcaatgtgctagtgataactgtctaaaactagg

SEQ ID NO: 515085 - DNA, 928 bp, Homo sapiens
  misc_feature (711)..(711): n is a, c, g, or t
cgcggtggtcacagctgtagtcccagcagttggtgaggccgcgggcggcagatcacgaggtcgagagatcgagacatcctgtgaacgtggtgaatccctgtctctactaaaaatactcatagtcaataggttactagccatgtgcggcgttaggcgtcaaacagttgaaaacgtaggtattatagtgaggctaccgcttcgagggagggacactatgaacagttgataagagatacgcgtgtggccggcatggataaaccgtgttcctaggcactctgacggtgtgggaattgaaggcgttttacgctggtgtaccatggtgttgtgccacaaggaattttgggaggaaagttcctactgaaggccctggaattttattccccagtagaatgggggagatttgttgatatgatttacagtgaccgtgtgtctttatcctgccttaccaggttttatgtctaacatacgtggtgggggtagataacactctcactttttgcagtgcgactctttttaaaagatcgaggatttcgagccgctatgtttgtgtacaaggaccttgactactccatgacgcaggaagaaataaggggtcattttaagaggctaggtaagggccataactaaagtgcgagggaaatggcaaagcctcagtgccaagggccacggatgaacccagttggacgaagatagaccgtccggaggtgggcncttggacacccggagtcgtacggggggagcacgtatagtgggcaaactgtgcggcttggagccacaaccttcttttgcacacacagctacttgaccttgaagttggacgtagcaaaagcacttggaaacaaccggggatgtccttccaaatggcctaccctaggcatgcggttcaacgcacgcactggctacacaatccagtggcgcacaaaaaggc

SEQ ID NO: 515086 - DNA, 276 bp, Homo sapiens
  misc_feature (147)..(147): n is a, c, g, or t
  misc_feature (149)..(149): n is a, c, g, or t
aaacggattttttttttttccccggggggtttcagggtcctggggccaaaagggccccccccccccccttccaaaaggccaggccaaattttagttttttcccctccccccatgccccccaaaaggttttttaccctttaaaaaaangnccttccaaaattggtttttttggggggccagtttttttaaccggaaaatgtaaattcccccccaaaattttttttttcccggtcccccgaacaaaaacccccaaaaaagagggtttttggggtccca

SEQ ID NO: 515087 - DNA, 547 bp, Homo sapiens
tcggtaccagtcttacccttactgttagcatggtagcacaaaatgtggctgggtcgagttttagaaggctactctgatttctaggaaaatgaattgtacatagtcaagagagagagcacaacgaccagttaggtggacagttgctgtagttcttgcaagagatgacagtggcttgagttagggaattagcagtgaaggagggaaaaagagaccctgaaaatatattgtggttgcaaagccagcaaaccttgctggtagattggctgttgggatgagaaaatagaggaaacaagaatcatttgtaggtttggggcatggttgatggtggcaagtatatatatggcagaccaggaggggaagtgatgtagtagatggcaagtggaaatcaagagttttttgggccgtgttatgattgagatgcctactaaatgtccagttttaataagtcagcaggtacatcatgcgtgtctgaagccaggaaagaatcctgactagagtataaatttcagacattgcacaaagctgtcatttaatgacaagactacta

SEQ ID NO: 515088 - DNA, 731 bp, Homo sapiens
gccaagaatggcggcagggatggatgtggataccccgagcggcatccaagagcggtgacgtgcaagaagcgctttgaagtgaaaaagtggaatgcagtagttcctctgggcctgggatattgtggttgataactgtgccatctgcaggaaccacattatggatctttagacgggatctgcgcgtttggtatgccacaggtcgtggttctctgcacacttggcttcacagtgcatctctcctctactttggccttccgaacaatgttggcgcatctataggcgtgcacgccgacatgtggcttcgcgcgctgacatatttctcatagtcatccaactattccatgaaacgctaaagagagtagaacatcaaacaaaggcatagaatgtcgaaggctaaaccaaggcgtccgcttacttcagaagagtagtaactggttcagctatggaggagtcgtgtaaccatgctttttctagcttccactgtgatctctcgcatggctcagaaaggaagacaggtgtgtcgcatgtggacaacgagagagtgggaagttcctaacatagtatgggcactaggaaaagacgttcttccaatcaagcttaattgttttgttattgcatttaatgactttccctgggtgttaccataattacgaaattggatggaaactgtgtttttgttctgctttgtttgtgtcagtttggtgtttctggtagcatattgtattctgtgt

SEQ ID NO: 515089 - DNA, 335 bp, Homo sapiens
accctttttttttggggggggaaaacccaaaaaaaccgtccctttgccccccctcttcccccggccccgggggttaggggttttttttggccccccccccccgggggggggtttttttcccccccccccccccgggccccctttcccttttttgggggggggaggggggggaacccccggatttccccccccccccccccgggtttttaaaaaggggtttttttccccttctttttgcaaaattccccccccccttgggggggggggggggccttccccggggggtttttttttttttttttttctttggggcctaccccccttcccggggggga

SEQ ID NO: 515090 - DNA, 134 bp, Homo sapiens
gtggagcctacaccaaaatgcagatttacgtgaaagcccttacggggacagaccatcaccctagtgggtgaaccccttggatacgatagaaaatgtaaaggccaacgatccagggtatggaaggagttcctcct

SEQ ID NO: 515091 - DNA, 101 bp, Homo sapiens
tgtgagcctgcagtatgtgaccgagaaggtgctgctgctgtctacaaggctctgagtgaccaccacatctacctggaatgcaccttgctgaagcgcaacat

SEQ ID NO: 515092 - DNA, 237 bp, Homo sapiens
ttctccgaaaggcacatcccagagcttatcctgaaggaaggtttcgcacgctgtggtggactggtcgattgagtatacacccgggcgcagaaaagctgagggcggcagagaggtttgcaaagagcgcaggctgaagaatatggagagactatgttggctcccacagctaatttggaccaaaaggacaagcagtttgtagccccaggtgatgcaggttctgaatgctgatgccattgt

SEQ ID NO: 515093 - DNA, 87 bp, Homo sapiens
ggatcgtattactatggtccggggagttattataacgagcactactttgactactggggccagggaaccctggtcaccgtctcttca

SEQ ID NO: 515094 - DNA, 1208 bp, Homo sapiens
ggtgttgttagtacgacaaaagaaacgcacctcgcgtgtgaaaaagaaaatagtgaacactctgtggttctacttttggtacacagacagactacccggtttccttggaccactgtgtgatactttcttcctctggtggggggaaagatacagagggagtgttggttaaaagcaaggcaatacttgctgagggttctgtttacaagaaagaatttcctacagagaaaggcaaacattattcgtggtggtggacaaaggtgggccataagatcagaaatgtggcccctcacgaaagcttgtcagccgaccggtgtttccttcccgaggaggggaaagcacgatttctcaacacgcaagggggccaacgacctcttttcttttgtggtgtgagagaaacagcgcgcctggctctgttggtttcggtacggatgtggggagtatttctcccacagagagagaatttggaaagctgtgttcgcgcacgagggcgcgcgacgtgttgttgcccccctggttgtcgtgcacgcttaccctctgtgaactggccacaggccacacgtcacgctctctataacgcgagtgtctaccttcgagtaaacacgcgcctggcgaggcacaccaaacaagggggagatacgttgtgggtccacccccgtacatgttgtgagtgatagggctgaaaaattgaggagaaacacttgcggtaagaaagaagttttgcaaataaggccccctgcttggaggtttcttcgtaatttggggaaaatttctgcgcccggactgaagggggctcgttctcacagtggagtgcaaaactttgtccacagcttcttgctatgctgaccacgtagaagtgaaagaataaaactgttttttgagggaggaacacacctggcttttaataggtgtgcccccacggggaacctgagatcccccacgagatttttaaggcgcggtggagaggtttgggtagggccaccctctgtctttgtgctaaggagtcaccctaacttcttctcttcagtcgtgcatcgctttaaaagggccgggaacacattgtcggccgagccacgatggactaatgtgttagagggcacaagagttggaggttttattttagggaaattcaaggcccccacaaggcaaaaaaatccctggtttgttttcaacccaacgtaaaaaaagggtttatttttttgtttccccca

SEQ ID NO: 515095 - DNA, 119 bp, Homo sapiens
aggaggtgctcctgtaccctggccacagcccaatcctgccactgctgacatctggggagactttaccaaatctacaggatcaactttcagccagacccagccaggcacaggctggatcc

SEQ ID NO: 515096 - DNA, 490 bp, Homo sapiens
tactgagtcaaacaaacaaaccaacaaaataacaaaaaaaaaaccgaaaggcaaggcatttcaggatttcttctaataggatctcagactattctagggagttctgatttgtttgggatatcccagttctcctcctgggtatcttggaatgttgcactaagcccagagcagttccagaggagaatgacaggcagaactgggtcctctagctcattctcccccgctgaaaatcctgcatggccctggacctctttggattctcaggtggtaggcaaatgccttagcacttgctgttccttctacccctgaggctgcttgggttttagttggtatatttatttatttattagggacaaggtcttgctctgtcaaggagtgcaggctggagtgtagtggcgtgatcacgactcaggtggtgtacaccacctgagtccagagcccttgctcttaacagctatggtgaacagacaactttaatccccaggggtgg

SEQ ID NO: 515097 - DNA, 107 bp, Homo sapiens
cacatttcaacaccactatcaacatccatcacagtcaacacattgcacactcattctcacacagtgcacatttccacacacaacagcaccaagtggcgccatccatc

SEQ ID NO: 515098 - DNA, 353 bp, Homo sapiens
gaagggcaaacccattttattgagtggtcgtttaaactgttcaaaggcctttaaaaagggaggaggagaggaaacaggaggtgagggaaaaagagaagggaagggaggaaaaaaaggagggaaacttttcttgaaaaagttatctgtacattgcttgatggggattaaaattgcgatcactcctttaatacacccccaaatcaattgaaaccaacttatattcactaaaaatttcccagggaatgcttttaattgtttagcttgtcacagcactcacaaatctgaaactgacaaacctattatttcctctaaaaataaacatggaaaacaatttcctgaaggactgctgctga

SEQ ID NO: 515099 - DNA, 107 bp, Homo sapiens
  misc_feature (84)..(84): n is a, c, g, or t
ctgtgatacggtattcgccatgcatagttataaagtaccattacgggtcataggtcatagccattatgagtccgcgtacatacntcggtaatggccgctgcttgcgg

SEQ ID NO: 515100 - DNA, 313 bp, Homo sapiens
  misc_feature (117)..(117): n is a, c, g, or t
  misc_feature (170)..(170): n is a, c, g, or t
ccattagaaacaaatcagaaattcccttggcacaaaactctccattggttataaaaggactaagaggtggagactgttttatatattttatatacacaaagacatgtgtaaatgttnccagaatttgtcatagcttaactgaaagaaagtaaaaggatcacttagtgccntcttacagtgaagtataaggatcatttagtgtcttgtttacaatttagcaatagattatctggtagaatttggagcagaaaggactcagttcatctcatgggtaactcaaccctaatttgtcaaaaataaaaaaaagtgacgt

SEQ ID NO: 515101 - DNA, 966 bp, Homo sapiens
ggggcttgtcccgcttggcggtgcgccctggtgtcggcttgcaggttctttctgtgttgtctctgccctgcaagggcgtagagctggtgcgtgcggtagcggggctctccagagaagcctgactgccgggcggccaccaagtggtcaacctcactattctcctcttgaaggggcctaccgttggggggccactttaaccatccggcttgccttggggttgctggccaccaacatcgacacggtcatacccgaatgtgtggttggtccacaaacaatggtgtccccagggatggcccggtttcgaagacgcaggtggggctccttattgactccatgggcccacaacaacaggccatggggagcacaaaacttcgttggcccttcaaaatctaaggaagtgggatccggaattgggtaattggattgaggggagcccacgcttcttttaagctctttattgaaagaggttgtggggtacttgagtgggtttattccccttcttgcagtcttattggtgaatcaccacttgttggcgaggacttgggagggaaaacgggaggcacggtgaacgtccttggtgagttctacaagacacacagattgctggaaggttacggatacgaggggggtttaagaacaataacatgatgctgactttaggggagcaatagccggggaccagggcaagggcccctttggaccacactggacgcgaccttcattgggtagacttgcacgtccatcactggcagttccgtgtacacaacagaacagccgagaacaacgcgatggttggcgcgcggctcggaaaggttctaacacaacgtgggcgggggccgagtgagacagcgggcccctgtcccgaccgcgcggtgtgtggtcccaaaacggggcgccctcgaccacggtcgggacgcacaggcaggcgaacacccaggagaggacccacaacgaccacttgaggga

SEQ ID NO: 515102 - DNA, 997 bp, Homo sapiens
agtctaactagatacatactgtggcgcggggcccagaaggaaagtagtatgagtgaaaggtggaacatagaagtatcttgggcatgatatatgctgcatatcttgaataaagtaggtgcgaatgaaccgatgcggtcgagaatcaaagtgccagagtgaattgttgtggtaaattactggaattcatcgaggaagagagcgtagcttgagctcgatagtcataatttatgccctgccctcggtcggctccttgtaaccctctgaggccaataagacaaatttgttttccgaaaaaaaaaaaaaaaagaaaaaaaaaaatttttgtggcccggtcttggacctaaaaaaaaggttttaaaaaacaactctttggggggcgccggcgcccccaaaactgggtactggtcgaccggtgcccccaacacgtgtccccagtaggacacactccgtgactcgtaaaaaacgtcggcctgcagtgtcctaccaataaaaaaaaaacgcccggtggtacacaccgccgaacgttttggaaccaacaaactcccaagacaagggcggctcgcaagggcacaatgacagggcatcataaccaacggaggcgttcacaacaacacgtgccaaacatcaaaattaagcccgacgcccggtggaccactaaccagacacccattcacgctcgcctagcgaacctactgggtcattccggcacacctcccaacgaccataatcaagcacacacgcgaactcacaactatcaagacacctccggataccactaataccgccccacccacacatcaacgaccaacagaaaccacacagcgtccaactacacgaactctataacaacagcacaatatactcacgaacaccagcaatcatcacacacccctcgaacgcctacttgtataacaccctacctactaggccatcagcaacacaccgttcccttaccaatactctcttaccacaagagcaaacacaccacacactggat

SEQ ID NO: 515103 - DNA, 623 bp, Homo sapiens
gatccatatgcattagtggcctagaggagcttccagtgggacaagatctggaggtagaaaacagtgatgttgatcatactgaccctgtgtaggcctacgctagtatgtgcatttgtgtctttgtttttaacaacaacaaaaaagaaaattaaaaattaaaagatgtaaaattacaaaaaaatcttagagaataaggatataaggaaataaagtatttctggtgtacaatatgtgttttaagctaagtgtggttacaaaagagtcaaaaagttaaaagataagttaaaaagtttataaagtaaaaaagttcacggtaggataagttgaagtatctcggaaagaaataagtctcttgcataaatcttcataaatgcagggctcataaagtctacagttttgtacaaggatgccctaggcatttaggctcactcaccacttactcactaattctcccagaagcaattcctagccctgaaagcttcatttatagtaagtgcctaactcaggtatagcattttgatgttcgactggatttttactgtacttttttatgtttagatacccaaatatttaccgtgtgttgcagatgctaaagtattcagacagtaaatgtgaataggtcg

SEQ ID NO: 515104 - DNA, 841 bp, Homo sapiens
  misc_feature (152)..(152): n is a, c, g, or t
  misc_feature (580)..(580): n is a, c, g, or t
gtggcccgaagccaggaaggcccccatccaatgggggaagtggacaaatcccccccattgaacacagggaccccgaaaaggtttcttcggccgcacagggagccctccaacgaagcccaccggaataattctaaccccttgagagtcctttnttggtcaaacaatttaataaccaaggttttccttggccccacgaagggaccccagacgtcccgccccagtgtctcaacaccagggtttgtggtgtgaaaagagggttgtttttattgagatctcgcgccgccaaccccggcccgcacctcttgtgccccctgttctccccgcgagtgaatccccggagaagaattaagcccttctcctggcccggggaaaaaaccaaagccacggccacgtgtgttttggggacccaataaacctgagatgaatgtgcacgggttttctaaggagggtacacccacaacctgagaaggtaatgttgccacctgccgcgttgaccccagcccgggccccgcacagccgcattcctccacagggccagggggcacaagattcctccaccttttcgaggccacagcttggncccttggacttcccctcaaagggcttgttggccctctgttcctcgcttctcccggtgcctcgcaaagggccgaagaaggtgtaccggcactttcggccaaggccccacggaaccccgcaccacaccaccaccccaaccctaacgtccgctccaagggccggaaagtttcgagcgtgcccagaaggccgaacgggcccaccgaggctaccaaaactaaacctggatcctactcctttttatttaaaagatttttgctgacca

SEQ ID NO: 515105 - DNA, 200 bp, Homo sapiens
taccctatagtccagcagcacaagctactactccatctagtgatatcctcatctccagacaatgtggtacatagaaagacagaataaattctactctgggttcgtaccagtcatctcattccgggtttacgttctcctagattccccctttaaatccctgtgacgaattccagatataggtcttccaagtcatgctttcc

SEQ ID NO: 515106 - DNA, 163 bp, Homo sapiens
ctagagtatcccaatcgcacgacaaggagcattcagctgaaattcggagtagaaggaaaactggagtgtctcattcacttcactctgatttgaattttttatttggagacaagctcttgacctttgtggcccaggctgctgaattcgccgggaagcagagttt

SEQ ID NO: 515107 - DNA, 622 bp, Homo sapiens
  misc_feature (226)..(226): n is a, c, g, or t
  misc_feature (228)..(230): n is a, c, g, or t
  misc_feature (232)..(234): n is a, c, g, or t
  misc_feature (241)..(241): n is a, c, g, or t
  misc_feature (259)..(259): n is a, c, g, or t
  misc_feature (280)..(280): n is a, c, g, or t
  misc_feature (544)..(544): n is a, c, g, or t
atgacttttcagacactcaattcacacatttcatacaggtatttaaccctaaaaaaagctccaacaagcatcaccttccctccaaattgctccttagatgaaaagtgcagcacatgggctggagtggggtcaggttaagcagcctctatgaagctgcccaggacaccccacagcagccgaaatcagatctcacacttccccctctatgcttccagaacactcattnannncnnnctagtgntgttataagcccatcttnagccccgtatgtgccttcagnaaactttggtcataggaatgagaactccctgagagcaggaacagtgtcatattcattttctgcagaaaggtggagtgccttatgttcaataaatgtgtaatgcattacaatatcaggaagtgagaaaacccaagcccaagggggagatgacctggaggacacgggagaaagttgagagctcgacttggatcccagcaatgtagatttaagcagagcgggctgcgtgctaagcaccaagaaacgtccactgtaaaaagaggagtnagggttcccgatcatcctggagagactcaaagccttcctttctcactagaccatcctgtaccgcatggaatcccacgc

SEQ ID NO: 515108 - DNA, 1056 bp, Homo sapiens
agcggggagccggaagtggtgcctgggctcgcggctgtgccgcggctgactggcgggagccaggacgttggacgccgcgagctcgctgggcgagaccgcggggcgggggtctacggttcgacgcctcgagactccaacccgctccgttccaccggcagtcactatccgtacgaccgacgcgcttctggcactgcgtgcgtcgaacccgtcgcgcgccgcgaggtatggatgagcgggtcatcggggcacgtgagggctctggggacaacggcctccggaccgacttgagggctagtttttccgtggcaacttgcggcgcgggcagtgacggctgctccagccatcaccgctgcgtcatagcgatgaaccgctgctcgatccagtgtagggtcgatgagcccgatagcccccacagcacttgtggaccaatggttgcctggggatgtgcaaggatcctctgatcttgcctggagcttgcttcatcctacgctatagtacatcagtgcacccgtggcatgcgtaaggattacgggcttgttcctgagtggctgaggtactcccggtctgcatgtctcgaaccgaccactctctatcgtgctgactacggcgtgtagctactgaacgagaggtgttgtcgcgcatccacgaatggagcattgaagcagcgtttcctgagcaagaggaatgcactatgaacgacttccctggaatgacaacgttgctcgaaaggaagaccttcgcgtagctgagattgactgacttgccatgttgttgttgtcaccggcgagtgcttggggccaacccgcgctggatcgttgatctcgaaatgctgcttgcacttgggtccgaggtagtcgttggggtaaccgtgggccagggcacaaacggctacagctgtgtggtgccatggaagtcccccgattgggggcaactgattgctcagcaacaagcgaacagggggttgcctcgggaattcccttcgtacggcattatagtcccgttcatccttccgtgcgacgaaagcatacgaatatctctgtgacgcgcttcttaccc

SEQ ID NO: 515109 - DNA, 431 bp, Homo sapiens
  misc_feature (218)..(221): n is a, c, g, or t
  misc_feature (225)..(225): n is a, c, g, or t
  misc_feature (376)..(376): n is a, c, g, or t
cttcttatgacatttaaattctttaagtagtttttttggtccaataaactagacgttgtataatctaaattgagcccttgtatatctaaaactgatgagttgtttctaaattgttgattgtccatttacttgcctttggtattaagataatgcaagtaaagtttagtaagtcattggataatgaaatgattatgtttctgaagaccatattatatttnnnntttnagaggaatcatgccatcccccaaaaaatcaagaaatatttgaattttaaatataagttcatttgttaaaagacatttttacaaatgtctgaaaatcttaaaatactttacatctacctttaagtagtagaatacagagctgtaaatttccntgccttttttcctgatattaagttttatagtaaaaaagcaactagtgattgcaca

SEQ ID NO: 515110 - DNA, 676 bp, Homo sapiens
accgtacgttggcttctagatagtgtacgccgaactctgcttggtcctttcctctggacattcaacacatggatatcgagcattgatgaggagcttgaccagtggtaactgcagccagcatcatcgacggatgacgtagtggatgatagggtcagtgtgctggtcagagagctgctagcataactgatttctctgtctctaattattggtctcaatcaatcctatgtgatctatagggatccaagaaactatgagttatcgtgtttaaataggtctttgggaactcgagagtaatgaaggtcagaacaaatttgaggagaaatatttttaggtaggtagtatgacggtaggaatattgtaaattggaatttgtaatggatgggaaattagaagatgcgtgtaaaatgttaactgtatataagtgtaaattatttacgccttgaattgtttcgcactaatatgttggcatccgtagtactggatactgtttattacacctattattgtgtactaatgttaatcagtcgaggttgactcatttggggcaggtaatctcctagtggtagatacattcttatatgctaatataatatttgtttttttgacaataaagtaatattagctattgggaactagaggttaagaagtaggtaacatactgcaagtaatcattcta

SEQ ID NO: 515111 - DNA, 937 bp, Homo sapiens
gttatcttaataagtatactttgtctagggagaagttaattcatttccagtctagtacaatatatgtaaatatattaatgtcgtcatagtgtcgtgatgtaagtaaggagatgtacatacaaattcattggaggtatatagatactcatctgtctaggcagtgtcccaatgttctgaaggaatgttagacagcaaaagtttactagttctcgtttgtatgtaaatagtgacaacggtcaaacaatgtcacatcacaagaacactagttacatcgaattctctagcagtaataatacgacttgctgtaagtcattgttttctgatgccatacccttgtcgatacatattatttaaaagtgaccaatattagtgtatgaagtagacgaaaaaatttactcaaacttcattcagatcctatatctgtgatatatttatcgtgtctgtatattctaatttataagatccaaaatacatttgcatttttaacgctaattggtctcaaaatttgcttgatattttcggatcaggttacaagtcctgtggatcccctgaatgttattgtccctcttgattggtatcacttctgagctatacgtcaaaagacacataagcttcaaaagtccagacaaaacctcatttgccataaaaatcaagatattagatgtacctgtccgtaaactcccttgaaaacaacaatttttcacaggtctccattaatgaacctggtttcccatgcaaacttcagtttagcttacttaattggagtaatcccctttcctggtagctgaaagctcaagcattgtttccagcatttaagtaactgggaaccatccaacaacatgggcgaagaaggcccgctggggtgagtacaatggcaattataaaaaggattctgcaagatggaacaccaacctgacaccccctacgggaaaaacct

SEQ ID NO: 515112 - DNA, 136 bp, Homo sapiens
agggcgccgctggatgtccaccacaatgtccttccctttcagccggaagttcacacagaaatgggacctgccaggtccagctcctgacagggtcttgggtccagcgtgtaatttgggcagtgtcttgcccctgttg

SEQ ID NO: 515113 - DNA, 424 bp, Homo sapiens
aaaaaggggggcccaatttatgaactgggtattgtcttacaatatagacactcagggtacccgattctaatacgtcttacaggaactgatgccaggcaataactcctgtaataaggtttgtttgtcatgaactacacaacgtagagaaggtgtgttcacaatgcccaagtaaagtcgtagctaagaagagcttaaacgggaatttaatgaccatacattaacaggcggatctgaaaaagtgtgcatcgacagttattcgtgaaagaaagtgagtgtctgtgatgaagacgggatttgcgccaaaggcgggcatgataggggtggttctgtggtactgagacaaagcatgcctttggcaccaggagaagtatcaagacacccccatgagtacccagagctgcttgagaaccaaggcgggctaggc

SEQ ID NO: 515114 - DNA, 158 bp, Homo sapiens
agaccccaagggtcatgagatgattcctatgaagccaggacaagctctctaacaagtatttcacacacagacctatccaccagagagaaattgagaggctagaaggcagtttatggtatggaggagtaacatcgttccattttagtacataggagagg

SEQ ID NO: 515115 - DNA, 120 bp, Homo sapiens
tctcaaggaaatacgtgtgtgtatatgtagccacagagcatacataaatgcacacacacacacacacacacacacacacacacaccccaagtacataagcgcacactgactatggcagtt

SEQ ID NO: 515116 - DNA, 386 bp, Homo sapiens
tcccaggcccacattgaaaccaccaaggagcccggcctgttttaaggggtttttattaacgacagcttgggccaggcctccccaaagtttaagggggggtttttttgggaaatcaaaaaagctcaaagggccggggccttaggctttttttttttttttggccccccgggcccaaacagggccaggggagaggcattttgccccccccttggggggggattgggcagttttgtgcccttggcccgcatttggggtgggggaaatgttgcccctggggttggaaaattttggggggccccccccccccccctcggtggggggtcccctgtccctttttttccttttgggcccgggggggccctcctaataaaaaaactgttggttta

SEQ ID NO: 515117 - DNA, 329 bp, Homo sapiens
agcctgctgaggcaagagaatcacttgagctggagtttgaggctgcagtaagctatgatcacaccacttcactccaacctgggtgacagagcaagatctcatctcaaaaaaaaaaaaccagaggctgggggaaagaagggccaaaaggagggccttctggcagaggcagaaggatctctgacagaaggaatgggaccaagaaaaaggaggggtgaggtgtggggcctcacgcctgtaataccaacactttgggaggctgaagcagccagatcacctgaggccggaaattcgagaccagcctgaccaacatggagaacccctgtctttac

SEQ ID NO: 515118 - DNA, 155 bp, Homo sapiens
cgattacgctcctagacggaagtcagcttcagctgtataccatactcacaagggctgaccatgatgtgccctgtctctgcatgaggactcacaggacagccagggtcactgatgcctgcaggactgcatggccgacaagatgatgcacattttaa

SEQ ID NO: 515119 - DNA, 287 bp, Homo sapiens
ccggtcttgagggggaaatagaatgatcagtactgggtgggtaggcctaggattgtgggggcaatgaatgaagcgaacagatattcgttcatttatggttctcagggtttgttataattttttatttttatagggcttatggagtagtgtgtagtagtgtccagtgtagtgtagtagtagtagtagtaagtccacaactaggccagaactaccactaaacttaccaaggtttactcctactagctatacctatttccaagtggagacagatacagtagtagagacca

SEQ ID NO: 515120 - DNA, 105 bp, Homo sapiens
  misc_feature (19)..(19): n is a, c, g, or t
  misc_feature (76)..(76): n is a, c, g, or t
caggaagctgagacagtgngatagcgagcccaggaggtcgaggctgcagtgaaccatggcagcgctgcactccagncctgggtggatagagccaaatcctgtcgt

SEQ ID NO: 515121 - DNA, 278 bp, Homo sapiens
  misc_feature (207)..(207): n is a, c, g, or t
cagttgacactctgtatctagctgctctggtggagccttggagaacctttatgtctagctcagggattgtaaatacaccaatcggcactctgtatctagctcaaggtttgtaaacacaccaatcagcaccctgtgtttagctcaaggtttgtgagtgcaccaatctacactctatctaggctgctctgggtggggggccttgggagnaacttttgtgttcaatactctcgtatactcaactcaatctggatggggggacgtggggaggaaccttttgt

SEQ ID NO: 515122 - DNA, 1383 bp, Homo sapiens
  misc_feature (874)..(874): n is a, c, g, or t
tccgtaataaaatgtcacgttaatggctacagggctgttcatttccagggacaggtctctgaatccccctgtgaaagagggctggttttaaagtctcccaattcatctccagccagctgtgtgtgttgtgacaggttattcaatatattttcttttaaaaaaaattttttggaaaaccatctttgaggcacctcagaattcacacccccacacccccacaataattgtggtggttctcccgaggaacgcgtgggtggtttcttctcctctccttcggcgccgggggtgaatcctctgcgggagtgaaattctctatattgacaaaaaaagcgcaacgagttccacagagagggctaatgtggggcgcccacgtgtgcgccacccacaaagaccctaataggggcgcaggggccccggagagcgcaaaaacacaaagaggggagagagaggcgcaaagggttcccccttataaaagagagatctcaaaatctctcccccgaaaggggggcgcgccatgggggagaaacacgccacaacacggagaggaaaaagcgggaggacagagagtgcgaaccgcccgagaagaaaaaatggcgctctctacttcccgccttttcacgaggcctttgtgggcccttgagagaactatgggagggggcccaagaagatattacaccaggggcggccttctttgggcggctgtgggagcctttagtgggaggggtggtgtctcccccctttgtggggattttttttaccccctattgggggggggcccccccccagaggggtttcccccaagaaggggcccaaggtgcttgttggggggggaagacgaggggagggacctatccacgaggagaccaaatgctancccaagagaagaactccatacccgggggggggggggaggaacaaccacgagggggagagggggagaaagcttctcactccaagggaagagatgtttggggtggccacgaggggtggagggaacaaagacaatacgcccacatgaaccactttgaggaaacagggcgggggagcttttaaacccaaaagcggcacccaaaggccccacaagagggggcctccccacaaagcggggcccatacaaaatgtgagaagaggaaagagggcgccaactttaaaaacgggggcacacatgttgtaaagggctccccccaagaaggtgataatgaccacagggggcgccccaaaccctcgggggtggttcgctccacgaggatgttaacacaagagtgtggccccaaaaagaaattcgggaggtgtgggaaccagtggaccatatggggagatatccccccagggggagtaacacagacacacttgtccgaggatataaaaagaagccccaaaagg

SEQ ID NO: 515123 - DNA, 116 bp, Homo sapiens
  misc_feature (35)..(35): n is a, c, g, or t
aaaaatatatgtatatattgtatgtctccatcctnggtagcggttggcccattttcccacatggactttatttggtccccagtatttattgaacagctgtctatgccaggctctgt

SEQ ID NO: 515124 - DNA, 169 bp, Homo sapiens
cgctattctgtttctgcagccggaccaggaagggaaggagctgctcccgatctttattaataagccacagggatatttctaaatagtgctcgatagctgttttctaatacctcccttaaaagtctagcctgtgatcccagagacctgcaggagacctgagcaagccagg

SEQ ID NO: 515125 - DNA, 468 bp, Homo sapiens
ttgtctctccctcctccctggaaaacacatccacccttcctgcctccacttttcaccctttctcctctgctcttatcactttaagatctcagagactctaccctgcagttcactacatttcaccaaaaatggtcatcagaaaagcaccacttctctctttaacactggattgaatctgttggcttatagagttcccagcactcttgatagttgttactattttggaataacataactcattctcatccgcattatgcttatgaacttgtggaatgacacaggtttccttcacttatctgtttgaccttgggcaacctctttatccttctgaagcacagtttcctaacccctgaaatggacatagaagtgccttccttatgggttatagtgcaggttcagtgagggtgagcacagtgctgactcgcggagaagtgtctcataaatgttagctgctgctgctaattatga

SEQ ID NO: 515126 - DNA, 351 bp, Homo sapiens
  misc_feature (145)..(145): n is a, c, g, or t
  misc_feature (241)..(241): n is a, c, g, or t
  misc_feature (282)..(282): n is a, c, g, or t
tgaggttcgttataggttcgtcaacatcacgccagcctgaggtgggtgtcctggttggcaaaagaccggtcaagtttttacgtgaatgggctgacacttgcgggccagaacatgttcgtgtgataccgggactcactagctgcanggatggcggaatttatgcagtggactcctcgtacccaagatgcaccgtgtgtggccccctacctctcaagtgtcacgtgtctaccaagactggcanagacgctagtccgtgctgatgggcaaacgaaggtgtccacngcgtggtttgatcaaccaacgaaatggttatgaaatgcgcctcccaaccttcggcgttcccatgtacga

SEQ ID NO: 515127 - DNA, 180 bp, Homo sapiens
agaggaggtcatccttccaaaacttatattaatggaccattcactgtgagcgacacacttttctaagaactcgacctacaatttgttaacactgcaactcccatttcacagacgaagaacccgagtcacagttgattatctcaaggttacattcggaggttcattgttctttcacaaccc

SEQ ID NO: 515128 - DNA, 129 bp, Homo sapiens
gtgtgtgagcagacgtgcaggagccctgtgcttcctggccctgcgtaacgccgacaacagccgcaccatcgtggagggtggcgggctgtggcagcactcagggccatgaagcgacgcccgcagaaggcc

SEQ ID NO: 515129 - DNA, 112 bp, Homo sapiens
cgtggttgaatactatttgcgtggaggtgtatataggtcgtagcggaatcgggggtatgctgttcgaattcataagaacagggaaggttagaagcagggtcttgagtgagga

SEQ ID NO: 515130 - DNA, 514 bp, Homo sapiens
  misc_feature (12)..(12): n is a, c, g, or t
tgttattcgatntgagctctcaacagattgaatgatgcccactcacaataatgagggtagattttctttactaaagctaccaattcaaaggctcacctcctctggaaacaacctgcaagcatgttttaccagctatctgggcatcccttagcccagtcaagttgacacctaaaattggccatcacagcaggcaatcacattgaagcttctgctcatcctggtgtaagtcacatctgctcagattccattggcccgggctgacaacaaggtgtggaagcacaacctgcccccgtttatgggggtgatgtgaggtcacctgcaatgaacagggatgtctaatcctctctgacacagtggaggagtgaacagctgcagatgataaaaccatctaccatcaaatcttccagaggtttccactgagttttgtcagtgcagtcagccctctgtattcttgaggtcctcatcttcagattcaactagccacagatcaaaaatatttggaaaaagaacaatt

SEQ ID NO: 515131 - DNA, 150 bp, Homo sapiens
ttggggggggttttttccccttttatgtggggaatagtagtttcctgtgcccagaataattttgggataattttttttaaaatcccctctgaagctaattggtctaatttgagattgggtttgttcctaataaaagtgaaggggatttta

SEQ ID NO: 515132 - DNA, 122 bp, Homo sapiens
  misc_feature (111)..(111): n is a, c, g, or t
tccaggcccagtctctctcctcaaaaaaaaaaattctctcttaattttttttccctccctttcttaattagattttggggaccctctagagtcagaccctggacgggtctngcaagctctgg

SEQ ID NO: 515133 - DNA, 171 bp, Homo sapiens
tggtagagagaactgagggacacacattaggtgacagaagcagagggatccatgggactgctgaggctgactgggccaggagcatcttcaggggatgatggatgcctctggaagggcagcaatgtccagagtctggcctccagcaacccctgaagtctctcccaggccagg

SEQ ID NO: 515134 - DNA, 175 bp, Homo sapiens
  misc_feature (130)..(130): n is a, c, g, or t
cccctggtctgaggtgtccatgatggtcaatgctcactcaagttcctggtccagccaaactgccgcagcaaagagtcccaaatttagtatcaagttcctccggaagtcattcctatcagtggcaaagcgnagacgccccgaagccaatctcccacgtgtccggaatgttggccag

SEQ ID NO: 515135 - DNA, 628 bp, Homo sapiens
  misc_feature (593)..(593): n is a, c, g, or t
cgctggtggcggttggtgtggagaactctgcgagtctcttgggttttttgttttttgttttttccagcttctttccgcctctattctgcctgttctgtagggcgcagttatgggtcgcaagaagaagaagcagctcaagccgtggtgctggtattgtaacagagattttgatgatgagaagatccttatacagcaccaaaaagcaaagcattttaaatgccatatttgtcataagaaattatacacaggacctggtttagcaattcattgcatgcaggtccataaagaaaccatagatgcagtaccaaatgcaatacctgggagaacagacatagagttggaaatatatggcatggaaggtattccagagaaagatatggatgaaagacggcgacttcttgaacagaaaacacaagagagtcagaaaaagaaacaacaagatgattctgatgaatatgatgatgatgaatctgcagcctcaacttcctttcagccacagcctgttcaacctcagcaaggttatatcccaccaatggctcagccaggactgcctccagttccaggggcaccaggaatgcctccaggcatacctncattgatgccaggtgttcctcccctgatgccaggc

SEQ ID NO: 515136 - DNA, 271 bp, Homo sapiens
tatatgcaggattgcctcttggatacacaccaaggaggggaaatgcctaggctgttcaactttacaggatgaacaattgttttccaaagcgtttccaccaatcatactcccaccatggatccacatccactccaatttggtatgattaaactcactttttgccgatctagtggatctaaatggtatctcactagggcctaatttgcttttccagaagctgaaaatcttttatctgtttattggacaaccatgatacttctctgaaactgac

SEQ ID NO: 515137 - DNA, 1329 bp, Homo sapiens
  misc_feature (570)..(570): n is a, c, g, or t
  misc_feature (624)..(624): n is a, c, g, or t
gctccgattggagatgattgatcctagagatagcattgtatgatcaccaggcatcctcatccgactcctgggggacatcgaagagactgccaatttctactttgatccgccaaaggtgccgtattggtctagactggttcagcgtggtcttacgattgtctgcttatattacatacggataactcgcttaatctgtgacttgtgtcatatgctcgacctgaaaggcgagcttaagctcctcataacgcgtgtgcccgaagagactcctatacacgagctttccctgtgcgcacctgcaaaggcccaggcaaatgcctctccttggggccagtgcatcacggctcgtcagaatggggtgaattgtcgttgtctcgcacaaaacaaaacagatcccgaacatgtccgaaaggggaccaccactgttgccccctgacgttccggtgagtaagcctcttggtccctacaacatgtgactgattttgtagaaccgagggattccacaagcacggcctctctttaagcaatagcagaagtatagaaatacgctggagaatgagaggtgaggctcanccccttgtgctctgaccgcacttgcttagtggagttacagtgtagacagtttcnttgactatgtcgctgagttctcaaaggaacaaaccggtttatggaccctaataatctctaggaggtggggacctgccactttgaggctttctcatagccgaagtgttttcagcgcccttgagggagaacatcgtaattcgacattgagacattgttaggaatctacggaacacccacgacctcatgtggaccatggggacaggacacacggaatggtggcaacactacggacgcaactactcagcaccacccaattgtttaattccacgagctgttaatacctctgcgttatatagaggaacacggacacggcacctctatgttgtgtgccaaattgaacacggggggcgcttaactgaggcaccaatatactaagtggcccacgcgactccataaggttgaggcccgcgttgtgggaggaaagaaagaaccttaggctcctcgccaacagagggattatctaatagacaggaagggggcttttcaattcgattagccaattaactcctataccgtggggaagacatgcgcttatagcgcgttcatttgtatttggccctccgaaacatttacacaaagcaccccctaaggtttctagaaaaattggcaccaccgtctcccatatgtccgggttattcgacaccataagttcgcgcgattataccacggtcctcccacattcttgggtgttacggtaccacatat

SEQ ID NO: 515138 - DNA, 319 bp, Homo sapiens
cccagattcctgagatttgcaggttgttgtcgggaatctcccgaagccctgcgatcgtggcgacaccaccgaggcgtccttgcgctgtcccctgtgaccaaaaacgtgcatgcccattggaataggtgcaactggtgggcacgttgatgccccatatcgctatggaaggggaacggtaatgacccagccaggtactggttccgagaaacccgacaaccttggtgactccagctctcgtggtgagtccagtcctgcccaggacggaggcacgaatctgccatctggagccgagcttcagcctgaggactcccagcacgat

SEQ ID NO: 515139 - DNA, 342 bp, Homo sapiens
  misc_feature (10)..(10): n is a, c, g, or t
  misc_feature (32)..(32): n is a, c, g, or t
  misc_feature (81)..(81): n is a, c, g, or t
  misc_feature (321)..(321): n is a, c, g, or t
  misc_feature (325)..(325): n is a, c, g, or t
gcaaatcgcncggatgttgaagagccaaaaanacaagcacgctgggcgggcgttacgtttaaaccaagtcaacgtgttgcngggccaatagcaccatctgcccccaatccttgccatgcctgaaaacgtttaacggcttccaccagttcattatcgtaggcggcgcgaacggcaggcgcaggtttactacgagacgtcgtttgcttatccatcggcttagtttctgctgtttcaacagtaacagcggatgggctgactaccgcgtcagttggcgtgtcatcgccaggtagagtaattttcggccccccgtccaacatgccntgtngttgcaatatttcgcgc

SEQ ID NO: 515140 - DNA, 252 bp, Homo sapiens
agtgtgatgcagaaggctgcattcgaggctctccaggtgaagaaggacctggcgcatcggcagatcaggaaccagattaggctaatagaaactgagttactgcagctgacacagctggagttaaagaggaagtccctggacacagaggcgcttcaggagatggtctcagagcagcgctgggcactcagcaacctgctccagcaactactcaaagaaaagaagcagcgagaagaagaactccatgacatcctg

SEQ ID NO: 515141 - DNA, 236 bp, Homo sapiens
ggtcagtcgcctctatctataagatcttcccagtattttgagacatagaaggggtgtgctctttagctgttcttaggtagctcgtcaggtggcgggggtcttagctttggctctcctagcaaagtgatatctagttaattcattatgcagaaggtgtaggggttagtccttgactatattatgctaggtaataatttttcatctttccctatgcggtactatatctaatgtgagag

SEQ ID NO: 515142 - DNA, 447 bp, Homo sapiens
gtatgaaattttcactatttagatcctctcaagtttcatttcacttcaagatgttctgtttttgtttttagagaaaaccactccactcacttcagctttgaaattgtttaactttttggtccatgatttaaaaaattaaggtgctaaaggctcacaacgatcatgtagactgactttaaactgatacgttttctgctgagtttatttaagctaatttgtttttaattatttttaaatcacaggttctaaattagttccattctggagctggctacaaatgggtaaagacttactttttaaaaatggggcaaatgccagtggcacgagaggtctcttgcaaactcgaaataaaaaagaggtggttagcagtcttcagttgtgttcttatgcttcagtgtcacatttcatttcatttgaaactaaaattttaagtaaagctgaaataaa

SEQ ID NO: 515143 - DNA, 193 bp, Homo sapiens
atgtctgcgatgtatgtcacagccatttggtctggtcctgctcacgtcgggccctagcgatgcggtgctccgcggacccgcagagaagcccgactcttggggttcaacgaggtctcgctacgccgctctacatgatagcatcttcctagtagtcgactcagcgcatcccagcgagagatagggagtacgcttg

SEQ ID NO: 515144 - DNA, 150 bp, Homo sapiens
gtcctgggctaggcatacgcagcggtcggcggcacatccaaccacaccagttgattgggggtgacgccccagcgagccaactgcaggctaaacctgcagtcggcggcaggatttccgcgctgctgtaggccgccaacccttcatgttggt

SEQ ID NO: 515145 - DNA, 649 bp, Homo sapiens
  misc_feature (311)..(311): n is a, c, g, or t
gtgggtgttagcggtaatattttgtatatagtgaagaaaaaggtattttaatttttagttaaattagtaaaattattttagtaattgtactttaatgtaataacatgtacgttcttacaattataagttatgtgtgaacttaatattttattaagattttattaaatatttataaaattgtatttaataaagttagtatgttattaattttagcttattttattttacttactggtgtaggtaaaagatggtaatatactatttggtaatataatggataaatatttctagtaatcctttttgtcagtgantttaaactgcaaggaggttaaagaatgttcttataggttaaatatttatttctcatctaagtttatactttttaatttttgtggatacattgtatgtgtatatttatgccatatatagcacattttgatacagacatataatgtgtaataattacatcaggaaaaattaagtatccatcatctccagcatttatcctttgtattataaaccaattctacagttttagttttttttaatgtacaattgttattgactacagggctatttttatggttatgctaaaaattatatagaagtataaataaagtccacacattctgagtcctaaataagcatt

SEQ ID NO: 515146 - DNA, 1679 bp, Homo sapiens
  misc_feature (587)..(587): n is a, c, g, or t
  misc_feature (880)..(880): n is a, c, g, or t
tcgtgtgtgggggtctccctcgccccgccgtgtgttgtatttcccccggggcaccatttttggcttgtgacccacgtggaggtgctgtcccactcatgtacatacgggtggtggggtttgttgtcctcctgctccgcccgcgctctgtcgtgggggctcgtccctcgacatgtcgtccccccgctcttgtggaatgggagtttccctcacagcgtgatgtgttctcagttgtctgcggctcagtgctctccctctccgctcactgaaggggcgcggccgccacaaggatgtgattcacttccccggcgtgtgttgtctgggggataacttttcccgcgtgctgtgggtggccgtctcacctccgattgctgctttgtggggccgcctttccttaccaatggggtcgccacccacaccggttggtgtgtccgccgaagccgccaaggagaaatatgcgtggtgcgtagagtatttttacgggcgtcgaagaagcgcccccgaggggggagaggtttgcgatctgtgtacactcggcgatgatttctgcggggggcccgcgccccccatgtcgctgccgagcaaaatantttgggttcctccctcaccccctcgtccgccagtaatattatggccgtcttttctggtggtagatactccgggggaatcagcttctgtcgtacgtcgcgaagaaaagagtggtccctttatagccacgacttgtgtgtcgctgcgccacaattgtggcggcttctaatacatttttgaggagatgagagtattggaggagaaaattttgtggccgcccccctccttggtggccgacacagatattgccgacacgacgccaccacgccctcaacatgggcgttaataggcccgncttctacttctgcggacaatatgacttcttgtggtgatattataaatagcgcccctcctttcggcagaatataaaggagaaatatctgggtgctcgctccttgagaagagcgctcttgttgatatctctcgaatagatatgtcacagcgcacacgtcgcgagatctgtttatggagaacacctctcgttctgcgctcggaggatttttgtggaggccacctcttcgttattatgtcgagaaagctgtagtaaacctcggtgtgtcgcccctctctcgcgtgatatgtatcaagcgctgcgtttcacagcgcgggctcgagagatggtttctctcgcgagagatgtttttctctctatcagagaggggctcgcgcgcacacagagacacccacagctttgttggttgtggttgctctgtccagcgtgttgctcgctcacacagcgggttggagacaagtttccacacgcccgctgataggagacccaccgctgttgcgctcttttcttataggctcgagagagttctctttgggccacagagaacacccgctcggcgctcgttatactctggctcttgagaggttggagaagccggtttgcaatttaccgccctgtaaaatgtaattcaattctcttaaatttatatgtaaaggtttttgtttgtaccgccaattcttctgaattcttttgaaagagatgaccaaccaaattttggttttcttactgttatgtgagaaccttaggcccccagccacacgtccttgtgtaaggaaaaactaaaagtgctgccgttacccca

SEQ ID NO: 515147 - DNA, 241 bp, Homo sapiens
ctgtttggttttgacaacctaccctcaggtggccaaaccaatctcccacattgatctcccttcgactaagcactcatctcaccgagacagagcttttccatccccccaaaaaatgtgcatacccaacgaggtatgttccttctcttttgaggacatccatcttcttagggcagggaaggggtgttaggtggacctggttagttttggaggctcttgggtttgtgcagtttccatctaccct

SEQ ID NO: 515148 - DNA, 399 bp, Homo sapiens
gtggttcacgcctgtaatcccagcactttgggaggctgaggtgggagcatcacttaaggccagggcagcctggggacatgacaaaaccctatctctacaaaaacaaaaagcagggccgggcgcagtcgtcacgcctgtaatcccagcactttgggatgctgaggcgggcggatcacctgaggtcaggggttcgagaccagcttggccaacgtggtgaaactccatctctactgaaaatacaaaaaaaactagccaggcatggtggtgggcgcctgtaatcccagctgctcgggaggctggggcaggagaatcgcttgaacctgggaggtggaggttgcagtgtgccgagattgtgccattgcactctagcctgggcgacaagagtgagacttcctctca

SEQ ID NO: 515149 - DNA, 290 bp, Homo sapiens
  misc_feature (11)..(11): n is a, c, g, or t
ccccccccggnccaaacccttctgccgccaccctccttgtttgtttcatagctcctctgtaaaacgcggagcttgtttgtgccctcctacccccccccattaatttaataagtcctgccctcctattatttattgtgtttactatctattgtcttaaagttttgtatattttgtaaatttttttcctcaattagtagatgtctaaattcattgtacatctgattcttttatattccattgttctgcatcaaagtgtggtttttattttgaatataaaaatgtaatttgaa

SEQ ID NO: 515150 - DNA, 165 bp, Homo sapiens
  misc_feature (45)..(45): n is a, c, g, or t
agacctgtgcaccaccatccatgttggctgcaaggttggtgtgtntccggacacttacccttctagggtgtttccaccccagcttttcacccaaagggcttcccctgtttgtgaagaatttccatacacgaagaatcaatggctgttaacactagcagggaatat

SEQ ID NO: 515151 - DNA, 299 bp, Homo sapiens
caaggaaaacggcaagatgcaccgagctccgcacacctgcccgacccaaacaccatcagctacctcttcctgctggaacactagaacagggttgccgagaaggagcccatcagcaaaatgccactgcacaaccaggctaccgcgagaggacccacgccacagagaccctcagaagtggagagcaaagcacacctcacctcggctgcggacatctgctcccatgacgtcatggcgcaggaccaggtgctcctctactacctgcagcacccccccattaccttcgcagaactcaagcggaa

SEQ ID NO: 515152 - DNA, 229 bp, Homo sapiens
  misc_feature (88)..(88): n is a, c, g, or t
  misc_feature (101)..(101): n is a, c, g, or t
attggaagcatttctcagaattaaaaatagatctagttaagtgtggttattactggggaatgaagctctgggagacttacttgcctgngttattgctttanacatatactacttttatttattatcaaatttcttgatgtgtcgtttccacatgataaacctcaaatatttaaaatgtgcaatttgataagctttgacggatttcacacctttaaagccttcaccacag

SEQ ID NO: 515153 - DNA, 373 bp, Homo sapiens
gaaaatgcaggctgggtgtggtggcttattcctgtaatcccagtactatgggaggctgaagtgggaagatcgtctgagcccaggagtttaagaccagcctaggcgacatagggaggcctcatctctaaaaactataataaattagccgggtgtggtggcatgtgcctgcaatcccggctactcaggaggccgatgcaggagaatcgcttgaaaccgggaggcagaggttgcggtgagccaagatcgcgccaccgcactgcagtctaggccacgagagtgaaactctgtatcgggagaaaaaaaaaccaattaaaaacagtgtgggcacagtagcggtgcacacagtaccaggctatgtacaatagagacatga

SEQ ID NO: 515154 - DNA, 243 bp, Homo sapiens
gtgactatcagatctcatgagagtcactcactctcatgagatctgatagtgagtgactatcagatctcatgagagtcactcactatcagatctgatagttttataaaggggagtttccctacacaagctctctcattctctcttgttgttgccatgtaagacgtgactttcaccttctgccgtgattgtgaggcctcgccagccacctggaactgtgagtccattaaacctttttttcttgat

SEQ ID NO: 515155 - DNA, 684 bp, Homo sapiens
ggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgccttggcctggccgtaggtttgtaactgtttcatagaacgagccctggagaagacagtagaatgagcctatctagtttaacaaaataaagaagcacgttcgatttcgaaacaacaccaaaacagaccaacacacacacaacaacaccttctttggcgccgcgctcggacaccacgaaaaagcgactctataaacaacccccggatgggagccacgcgggcccaccaccaaggcgcaacacggcaaccactggcgcgccacacacgcaggactacccctaacgagcaccccagcgggtcaacgcgcacacaagtggcagaagagcatcttccacccacccaaacaaaaaatccgccccgagagggcgcaacagcgaggcgtgctccagacgaccaactaccacgag

SEQ ID NO: 515156 - DNA, 914 bp, Homo sapiens
tgcagtggctcacgtctgtaatcctagcacttgtgggaggctgaggcgggcgaactgcctgagctcaggagttcgagaccagtctgggcaacgtggtgaaacctggtctctactaaaatacaaaaaataagccgggtgtggtggtgtgcgcatgtagtcccagctactcgggaggctgaggcagaagaatcgcctgaaccggggaggtggaggttgcaatgagccgagatgtgtgccactgcactccagcctggacaacacagcaagactccagctctaaaaaataacataaatgatactacacaaaaaattattaacattaaaatttggctagtaaacatcctgtaaatcttttatcagatacatggttgtgaatattttttccatctgtgaaaatatttcactttctgtgatggcatcctataaaatataaaccttttaaatttgatgaaaccccaatttatctgaatctgacatactgtgaaaaaacatttttcaaccaaacattttatattcctcattaagtaaaaaagttttgtcgcaactccaggaattcggggcaaccataggcctgtcttaaaacaccaagtctagtcatttgtggctccagaaaaggtcacttaaaaaatgctaataagtatatggaacttctgaggggtcccacggccatttggtcaaggtcatgcctaaatgggtttccacattaggttcacccacacgttggcatacttttgtgaactcaggctgaatgattttaaaaacacattggtctccatttcgacaccaggcataagggcaggcggacaaatgccttgtgggttgtgcacacagttggcacgggagtttcacacccaaggggataacatctgggctacaggaaaaacccacgaggcgcgggggcacaaaactcgttc

SEQ ID NO: 515157 - DNA, 458 bp, Homo sapiens
  misc_feature (120)..(120): n is a, c, g, or t
cgaggaatcctgttaagcacggtggcagccggctctacggggtgtccttctgccaagagccaaggggaggtccccttgggggtcaaatggggggacaagcccatcccaggcaaccccccncgcgtggtggggccctgagtttgggggcggtgccaaccggcagcccccaagtttgccccgcttcccaaaaaggccggcctttttccttcaaccgggggcgaggccgccctggccgcccgcctgttttgacaaccgcccctgccttgtgccgtgttgggctcccctgcctccccagccagcggttgccctttgggctttcctttgggcaaagggagccctttggggggcccgcttgttttttttggttttggggggggggggggggggggggccgggcccccccccccccctggtttttttttcccgccaaggggaaaaaagttttgtttcccttttta

SEQ ID NO: 515158 - DNA, 189 bp, Homo sapiens
  misc_feature (40)..(40): n is a, c, g, or t
  misc_feature (47)..(47): n is a, c, g, or t
  misc_feature (171)..(171): n is a, c, g, or t
gtgccaatcgcctttcaaaatgttttctatttgctcaccnttccggnagtgctaacgtttagctaatgagtagagtgccttccttcaacatattgttaccttgtctagccttaggaagcaaaacagtgccacctgaaataatacaggctcttttcgagcatctgctgaatnccgtcacagcatttcgaa

SEQ ID NO: 515159 - DNA, 974 bp, Homo sapiens
caaaaaaataacgcacactaacagaacagtatctttagctgcaatagacttcacacattgttacgctatgtatcactttagacgaactgtcttgtccccctttagtgcacccgtcctttactggctccgtgtacttttcctcctctgtgatgtatgagttttcccgttccctgtagacgccctaggaatagcaatttcttgaccgaaccttttttccaaggccttttctttaaacaacccggtgggaaagtttattccgcgaaatcattcgctgtcccgctcggcaaagagcactggttcaacccccccaagggggcatatatcccggtgacccccagaggagtgggcgtgaacaaacaggaatcctgttttgaaaccgcttttccagtcgtgcccccctcgtcggaaaccccacatctgtgggccaatccttcggcgaagcccccaaaaagtggggggcccacaaaacaaatatccagcacgttatctcgtagcaaatgagaaagtttgagaccgccgccgcgctgggcttgtctctaatgaagagccccccttcttgtgtaaccccccgtcaaaccggaatggtgtttcaacacctagttgtgaatagcccccggggcctgcgtatgtaaccaattggtctattcggcaggggggccgatcatgcacggcaccagcgagcaacactttgtagtcacctggttgccccaggccctcaaacattctgcggggtggcgtagtaggacaccaccacacaaggattcagtagcaccagctggccccttctgtaccgctcctatcgccaaaattttctcaggagattcagccccttgtagtagataacaaatggagtgaagtagccgcccagtaggatgcagcagcaccccactgcagtagtatcatcctcttgctgtgttatacatggagcaccctcacattattcccccaaaaaaaaaacccctttcaaaaaaaca

SEQ ID NO: 515160 - DNA, 380 bp, Homo sapiens
  misc_feature (11)..(11): n is a, c, g, or t
ttacgcccaanactccagtcaagggttctatatgaacagccataacacactccagtgaagggtctctctgaacagccctaatacactccagtgaagggttctctctgaacagccctaacacactccagtgaagggtccctctgaacagccctaacacactccagtgaaacggtctctctaaacatgcctaacaaactcccagtgaagcgttctctctgaacagccctaacacactccagtgaagggttctctctgaattagcctaacacactccagtgaagggtctctctgaacagcgctaagacactccagtgaggggtactctctgaacaggcctaagacaactccagtgaggggtactctctgaacagcgcctaaca

SEQ ID NO: 515161 - DNA, 1119 bp, Homo sapiens
  misc_feature (403)..(403): n is a, c, g, or t
gctcctctgacacccagtgccttctagatgtgcagcagtagagagagctctgctagtgtcagtgggtggcggatgccaccttccttctcacaaatacttcttggccctgtgtcctgtgctgcccgggcaggctccccatggctcagggtgtctgacgatggctgcttagctgactggtcaggtgtgcaggcgcccaatgccgcgtagcttcgtgcctgggtcgattccggtccttgacctatgcttgttctgaggaacacgctgctgtgtgactgctggctggtagtgatgccatgtactgtccgaccttgtccctgttgaccgatcggccatggacgggcccttgctggggctgtactggggccttgcagtggcacgcgacgtgctgtcgcactctgtggantgtccagggggcaccttttcttctattcgggagatcctgtcgagtgacccttcgtgtggttcccgtggggcttccttccggcgggtacacccctgttgcggtcacctcgctttgcccctcgtatggattccggccgctggcacggcattgtgtcgatgggcaagggcgcgaaacggctccccggttctcatgtggttcttccttgaccgtgttgagtcgccgacaatcggcacgtacctgcagggccgctgggagtgcttgtgcacggccgcggctgtgctgctttgtggcccattccatccttcgatctatatgttgtcgacgcattgtcgaaattttgctcggtccgtacacgaagtcgaaggtggatagcaattagagcatcggtttttcgttggagaagccttagagaagttggtatttcccaaataagacccaggatagtagtaacgcctctgagaacgagatcttgggcacagaattttgctctggtaaccacctaagttgagccccgttaacccagtttttgtcgcgcaacctgggatcgtatacttccacacacgttagacacaggcccattggttagtttgaaaggcagaaaccttgggttttagcttcacctttacgcatacaacttgacacagcaactgaacttgcagcgacggtgtggtttttaactttccaggtggttccccggggacaccaaccaacaccct

SEQ ID NO: 515162 - DNA, 137 bp, Homo sapiens
aaaggaggtaagccgttaccaatactactgcataaacgcttggacctctccacgtgtatgccgtctctggcccatctcaggctgagcttacctgtgacagcagctctgtccccaccccatgggcctcatgaataaat

SEQ ID NO: 515163 - DNA, 184 bp, Homo sapiens
gtgttatccggtctgcatggaggtccagtatgagtctgatactgtggctggctagtccggactgggcggcgtcgtatgatgtactgtcatgggaaaggcctgttgcattttaacataccaaaggagctcagccatagcaatcaactaaaaacagaatgcaaacactctgggatttattagaatt

SEQ ID NO: 515164 - DNA, 694 bp, Homo sapiens
  misc_feature (2)..(2): n is a, c, g, or t
  misc_feature (136)..(136): n is a, c, g, or t
  misc_feature (166)..(166): n is a, c, g, or t
  misc_feature (189)..(189): n is a, c, g, or t
  misc_feature (194)..(194): n is a, c, g, or t
  misc_feature (211)..(211): n is a, c, g, or t
  misc_feature (315)..(315): n is a, c, g, or t
  misc_feature (317)..(318): n is a, c, g, or t
  misc_feature (326)..(326): n is a, c, g, or t
  misc_feature (350)..(350): n is a, c, g, or t
  misc_feature (358)..(358): n is a, c, g, or t
  misc_feature (417)..(417): n is a, c, g, or t
  misc_feature (425)..(425): n is a, c, g, or t
  misc_feature (460)..(460): n is a, c, g, or t
  misc_feature (480)..(480): n is a, c, g, or t
  misc_feature (523)..(523): n is a, c, g, or t
  misc_feature (579)..(579): n is a, c, g, or t
  misc_feature (598)..(598): n is a, c, g, or t
  misc_feature (610)..(610): n is a, c, g, or t
  misc_feature (627)..(627): n is a, c, g, or t
  misc_feature (660)..(660): n is a, c, g, or t
antatttatggtaaatacatatatataacttacttgcaatttaaattacaaaattcatatacaaagtaagcgaaagggcacacataagaaatccaccttgaccacagaaatgtagaaaacaccagccctaatgacnaagacaatgtttcaaagaacaacaaacaanaagaaaagttgagattctacaanaaatnatattaaacgcaagcantatgatgcacagacgtgagccctgaatattttctaaagcataaaacttagggaaaatcattttacgggggatctattcatattccaaacagcattttaaaaaanannaaacttancttagttttaaaaacaaaattcanacccaaanaatcaagaaccagaaaatgggtttcttaccttttgtttccggtgggatgtgggctgaanagcaaggngggttattcaatctggtgttatgaaaagtaattgnttcttaaagggacttaagtntttccttggttagaaaataattataggctccctaaaatattcnaggggggcataatagggggggggggggggaattccaggacagcttttgttgtatcnaaagggagtaactttcttntaataattgccnatacggatagagacctnaaggtccattttatgagacaataaataagggcngaccatacatcccatcacagctattagctgtctg

SEQ ID NO: 515165 - DNA, 1016 bp, Homo sapiens
ttctcccccctcgtgtttgttttggtttgttttaaacttttcgtacatgtacctctctcccagctttaacaagcatgacgagaccactctgccatcctttctcagctacccctgccccacctgtactctttattttttggctggagtatattaaggtaaatcatagaaaacataatgttaccccaaaattacttcagtatgaatcctttttcaaaaagcatagctatagtgtcattatcatatccaatgaaattaacagtgattcttgaatatcatctaatagctagttaggagatttggggctagtagccagatttttgacctctttaaagaagtgttctttccactctctgagtattaagtagctgtatctgtcacaaatgagtacagaattcaaatgcagttaactgtgtgaagagttagtgtttagtttttcctgattatctcaactatattttttattgtggccaaacaaaattactcatcttaaccatttttttgttctttttgtgttgttgatcttaaccattttcaagatgcaatagttcaacagtgttaggtcatattcacattgttgctgcacaattgcatctaattgatctgctagcaactttttcatcttgcaaatctatatacccattgcagcaacaaggcgtccattatcccccttcctccagcccctggtgaccacaattctactttctgtttctatgcaattctgactgctttagatacctcgtataagtgaaatcatgcagttattgtcttttgtggcgggcttatttcagttcagtcataatgaccttcaaggttgtggcacgtgactggatttcctcgtccttctctaaggctggaactacagttaatactcttgtattttcatgccaacatatcgttcatatccatgtcgagcatgtctcatgggctagttggacactgttataacttcttggagaaatgtctattccagctccttatggctatctttccaatcaggtccatcaactcctccgctg

SEQ ID NO: 515166 - DNA, 111 bp, Homo sapiens
taaatacaatgtttatataacttgcattgagaactttttgaggccaggcgtggtggcttatgcctgtaatcccaacactttgggaggcttgaggcaggcagatggcttgag

SEQ ID NO: 515167 - DNA, 400 bp, Homo sapiens
  misc_feature (94)..(94): n is a, c, g, or t
  misc_feature (192)..(192): n is a, c, g, or t
  misc_feature (396)..(396): n is a, c, g, or t
ccttttttttaaccgggggggagaaaagagtgtccccccccggaaaggcctcccccccctttgagcaccttttaagggccggcccccctttccncccaacaaggggagccttaggcttcagttttactttgctgcaaaataaggcgggcctgcaagcggactacaccctccgaggctgttgaggacaatttncattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctganccca

SEQ ID NO: 515168 - DNA, 1582 bp, Homo sapiens
  misc_feature (454)..(454): n is a, c, g, or t
acggacgtggctgccttccgtgcgctctcgagtgctggtcttcctcgactggcaggcaagcacagagtctctgtatcagcagcagcattgctgtccatcctgtggtgtgtggcttgagagctggtgtattcggtctcctgtctgttccagtgtctgtgggaccgatgtcctcgatgagaccgcgtggacaggattcgtcgcgcatgcctggctggcgcgtggtcctgggcgcacctgacctctcggcgtatttagggcctacccatgctgcgcacatcggatcctgatactcgcacaggtgtcctgtcgtgtaggagcgcgctgagccaagtcaggtcgtcgtgagcgcaacacgtgggtcacgagcctagtaattatccgaaaggcctgtggtggcatctcgtgtgctagctgcgtgtcgctatgcagcgcatgcggcgcgtgcccccaaccngaaccacggagcggcggccgtccttcgagtgtagcacgcagggaccttgggtgccctatcccacatggtttatccatctgcgtagcgtagatcccgcacgcacaaggtgccccttcgttggctctagggctatgaaaccgaagccaatagtaccccattactcagattctgagcaagaggagcctacttcgtggggaggcatacgcgtatgaaaagaggtcccaccgaaacggagatgcagattccgctgttggtacgggggtgcaccgccactcctagtccctagagaacaatttcgaccactagggcacgcaccgtgggcgggtgctccgaggggcatctgagtggtgtgtgtggtgcccgctatctgtgggtacttgtccccctttaggttcctttgcttcccccaggtggacatggttggtgtcgcgcgttggcgcccacgccttttggcttggtcccgagtggggcgctaagggcccaaccggcacaggtgggacacagaggcccgtttgtttgggtcgggtttgtaggggccagaagggccgtcagggttcgctaggattggggggccctttggaaaggcccctggactatttgcttggggaccgattccggagctcgaatggtgaacctctgggacatttcccccaggtttttccccctcccacagagggacacactttttgccccccgggcgggggagcgccgccccattgggggcggcgagcacgagagtgaaatgtggccccatgtggaccttgtggtgtggccatctggggggtttggttccgcaaatcttgtgggattgcgggttaaaggggccctgggggatagtaggaacataaaatattcacctccaaaaaatttgctctaggtattatacacacggggcccaggattgctgagtggtgtgggagggcccctatctaacaaagggaagggggggtgctatttggtagaccgcggcggagcacgagtgtgattagcaaagagctagaattgtatgtacaccccccggctctgatgtagaagagacgcgtgcgtacacacacgagaccttgctgacaacggagttgtctaccagacgtggggtggacacacttaatcgaacaagtgaaaaaaaag

SEQ ID NO: 515169 - DNA, 522 bp, Homo sapiens
  misc_feature (14)..(14): n is a, c, g, or t
  misc_feature (226)..(226): n is a, c, g, or t
  misc_feature (470)..(470): n is a, c, g, or t
  misc_feature (473)..(473): n is a, c, g, or t
  misc_feature (498)..(499): n is a, c, g, or t
  misc_feature (521)..(521): n is a, c, g, or t
agatggcccccagnatagcccccggggtgtgggatgggttggaccccacaagggccatgtgcccctcctgtccttgcctgtttggtgacccccggttcctctgaacccctccctcatcctcatgccttcccttcccaagaactttcctggaaagagatgctggctttggagatgatatagggttttcctccttcagacccacctgttcctgccctagcaaaaaggncctaccttggccgggcacggttgcgcacgcttgtaacccccagccctttgggaggctgagacggtggatgcttaagccccaggagttcgaaactagcgtgggcaacttggcgaaaccccatctctgcaaaaaatacaaaaattagctgggtgtcatggtgtgcgcctgtggtcccagtacttaggaggttgaggctggaggatcacttgagcccgggagttgggaggttgtagtgagccaaganttnccactgcacttagcctggctgacanngacccctgtctcaacacaatana

SEQ ID NO: 515170 - DNA, 361 bp, Homo sapiens
  misc_feature (55)..(55): n is a, c, g, or t
  misc_feature (137)..(137): n is a, c, g, or t
  misc_feature (153)..(153): n is a, c, g, or t
  misc_feature (357)..(357): n is a, c, g, or t
gcccttctgcatggccctggcccaccttccccagcaaccacgcccagcgccctgnagcgccttcagcttttactctgcctgccaaaatgcaagcgcgccgcccttcaagcccgcactacacctacgcgcgcgcctgnttgcaggcacaatttncattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctganccca

SEQ ID NO: 515171 - DNA, 297 bp, Homo sapiens
cggggcttcccccccgggttgttttttgccagcagcagcagccaatgagcatttagggcggagcctaggaaaggggcctcccctatagggggacagggtttgggggaaatccctgccaacggcacgctggggttttgttcctgaactttgggtccccgaaggcaggaaaggaaatgaattaagccagctgggtttggcggggggggcccctgtgggggcccctccggggccccttgggctccgtgggggggccgtttgggttttcccgaaagaaccgaaatataaagtgttgtttta

SEQ ID NO: 515172 - DNA, 824 bp, Homo sapiens
  misc_feature (204)..(204): n is a, c, g, or t
  misc_feature (280)..(280): n is a, c, g, or t
gcggggccatggtgagaggggtgggtgagactcctcgggactctggcggggttagggcgtttccccctaaacgttggagcggctcccagaaaaccagagctgctacaggaggaatctttggcactcctcatacgtctggattcttgggctctaagcctgagggccagggcctcaggcagagtccagagatacaggcacagaggncctgatccctcacatcttggaaccgtttacatactggcactagccgaaagagttaccggcccaagcttccagtggnaaggcccttgggattgggggagcccccccttgtgaagagtcccccttttttctttggcagggcgaattggttgtggcctttgtggccacccaaccaacacactttgcgaaggattcccagggtcctttgggacacaggcttggggggggggttgggtgggaacccctttggaaagaattgggggggggaaattttccctttccaaggaggtttggttcccatttccacggtgggttcccccctttggtccaagggccccaataggcctgggaaaaagtggtttcccccccctttgtaatttgtgggatgtggaactttcccacatcgtggggggggggccatgcaccacggaatagtggtggactctccccccccccacaaaggaaagtgtgcgccttttgtgggaaaggggtcgttcccccttcctaagccagcttccccccctttgtgggaaagaagatttttgccctcttgtggtgtgttcccccctttaattaggttgtggaaacaggttgggggggttcccccaaccccccttttgtgg

SEQ ID NO: 515173 - DNA, 333 bp, Homo sapiens
taaccaaggactgttatgttgcttttctgattatttctgctgtgtcaatcacgattcttccactatacttactccgatcctttatattattgtctgcttatccatcctttgaaaatgccatccacaatcccaattgtcgcttcttctgcatgagcataggagccaatctgagccatgatggtcatcaatgcaacttgtttttatgtaggagctctttccacccatgtttggtccggtaattatcattactctctctgagtcctctgataaatctgtattatttgggacatattgatcctgttctcccagcaacacatcaatcacaggggggga

SEQ ID NO: 515174 - DNA, 378 bp, Homo sapiens
ggtgtgtagcggctgcgaagacggtgtcgtcgcactatgcgaagtaaggccgtcctgagcgcaaaaaccgcccccagatagagagcacccacaacggtcttagcaccatttaatccacacaccgccgtgcgggcaaggcatccgagactatggattcttccagtgcatctacctctcattactccgttggtctaacccagtcccagacgtgctggtcggtgcatccggctagctcgcagaggagcgtcaaatcatgttggtgactgaaatatgcaccaatattattacgaagcacaggaggcatggtcacggtgaatttgtcgaggtggggctaatgtaaaggtctattccatggctctatgtgtctagtgagcggaa

SEQ ID NO: 515175 - DNA, 408 bp, Homo sapiens
cccctgtcctgcaagaggattaggagtttcttctcgggaaggcggacaataccctgtctgtcattccaaggccagaagtgactgggtaggcaagacatccctggagtgagaggaaccttactttctatggccctactggtcaggaggcctggcctcaagacaaggagatgcggaaagtcagcctagacgcatggtggaagcagaccaagcgctagaacaatggaaagaggtgccctggaagagatgctgagagcagtctacactcggacttgacaagacaccactggcagtctgcactgtacacctggactgcacatgacaccactgatagcagcctacactctacaattggacttgacgagacgccactgacagcaggttacactaggacttctcgacgccgtgctg

SEQ ID NO: 515176 - DNA, 1082 bp, Homo sapiens
gggcagctgtaatcgttgcgacagaaggagcatcagaaggagcatccggcggcacaggcgggcctgtaaggacagtgtgggtcgtcggccccgtgagggcaggcataaggccaatggtcgaatgtccccaagacgaagaagagcctgcctgggtgctggtggaacctggacctgcagagcgatggagatccagggtcgtgagaagtcccgtgccgatcttgtgctggtggctctcctaaggccaatgccagccacagttccagcccctccatcagctcctgcaccttctgcccagcccacaccccgcgtcagcctctgtccctggaaagaaggctcggtgaggaagccccagggccaccgggtgtcagcctgtggccgacatgctgaagctgcgctcacttagtgagtgggccccccaatggagctgaagatccggctcatcacagggtagaccagtggtgacaagggagacctttatcgcctctgcaggtggaacgagcggcgtgctgcgccatggcaagacctcaccatcagccacttgtggctgcttgacgtcgtgcgcgccacgcaggaatgccaaggtgaaagggaagttgtcggagagtcctacctttcccctgcccagtctgtgaagacgaagatcaacattgaggagaagctgtcccgggcaaagattcaatccctccttaacccaggcatctatctggagagcaaagcgggattgctttctcaccatgtccttgctgcaggtctgtacgagacctcgaaatcgcatcacagtgatccggggcctgcgggatccctgcggtcaactttgggcctcttctccacaagaccctgtggaagcagtgcgaacacaccgtggaagtcggaaccaggtgcaagcaaggcccttctgattaggaccggtggaatttgaacgggactccgcagaatctggtctttgagagctccggttccaaaccaccatttgccagttgcccaagaacaagggccatcctcaggagctctagaagacaaacgagagttggaatataggtacacggcgaaaacggagtaatgccataatagccaaagaagac

SEQ ID NO: 515177 - DNA, 113 bp, Homo sapiens
ggtacccaggcttgatacggtagtgctatcacagctcactggcagccctgaactcctggggctaaggatccctcctacctgagcctccttgagtagctaggactgggtctcca

SEQ ID NO: 515178 - DNA, 1001 bp, Homo sapiens
tggggggtaacgaaatctttatctggaaaaccaaaaaaccgggcaaaccagaggtcattccaaacgaggaagattggtggcacctcgtatagcacaaaacaaacacaaacccgagaaaacaaaaagaggggcgggggcgcccggctcaaaaaaaccgagaggggggagcgaaaactcgaggaagaggggcggaaaatttttcctctttctccacatttttctttataaagaaaaaccccacacccagaaggaaagaaacaacaccacacacgacaacacccaccccaacgcgttgtgtggtctccgcgaatgtataagacaaccctatacaatgtggggggccaaatacctgcagaacacacgtgcgtgagttctttctctttctctcgcaaaagacaaacaaaaaaacaaaacgtgttcacaaagtaagagaggaaaaagcgcgaggagttatgggaggttgtgcgcccccctcgcggagagagcccccccttctcgcggggagggccgggggtgcccacaacgagggggggccacccgcgaaaacacgccgcgcggtgtcttgtgtgctcacacaccgcagggggggggaggggacgcgccaccctaaagaaagataatatctcccccccgcggggggcgggcccacaagaagtttataacacgagggtatacaccccacgagcatttctctcgtggggtactccacacagggggggggccccccctatagaggagggggagggcggccggcaaattaaacataacgaacaagaggcgccgtgaggcacccgcctgcgttatacaaacaacgccgctcgcggcccgcgggggcgaacaaccccgcgtaccaacgctggggaccactcttcggggggaagagagacacccctataaatctgctcgggggggggggggcacccacactatgtggcgcccaccacaccacaccctcaacagaaagaaatttcaaaacggcctcacaaaggggcgacacattt

SEQ ID NO: 515179 - DNA, 214 bp, Homo sapiens
gcttgctctgagatgtctcctgcggtttgagtttctacataagactgtgtgcagcataagtttctggttgtaatcatggagtttgtatggttaattatgcgttgcaggaagaggaagtcgaaattatctttcagtttactgggcttggggattgagtaatttatgatacgggtgattcggggtgttatagagaggacgctacgttgagaagctt

SEQ ID NO: 515180 - DNA, 195 bp, Homo sapiens
tgagggcggggcaaagggagcttgacgggaaaagtgaggagaaaagaggaaaggaaggccaggttgggagaaaggatcagttaattctgaggaaaaaaaaaggaagggagagggactatatggcttagcagattgcaattgagggcgactgtggggcgctcgtgccgggaactctctagagttaaccggaaggct

SEQ ID NO: 515181 - DNA, 137 bp, Homo sapiens
ttactgcacagacacacacgctcacacttgcacacagcagctaagcacacagcacattctacgaacacagctcacagctacactattcacgcagcacacacgttgcacacgcttagcacccacctgcacacacacaa

SEQ ID NO: 515182 - DNA, 230 bp, Homo sapiens
ttgacagcatcctaacaggatgtactgttcctgcccagttccctcaactccacctacccatctcctcaactccactaccccatctccctcatgctagcaccccgcgactgtcactgcaccgaccgggcctctgaggaccctgctctctaggttcagaaagcgaaccctcacgtgcacacctgacctgggctgagaggatgcctcagagtgtcacctatcaccctggaacg

SEQ ID NO: 515183 - DNA, 358 bp, Homo sapiens
aagccggaacgacttattattacaactggccatatgctatatagttcgttgtggtctcgtctaatcagcaaccgaggaatcctctataatcacacctcgcgtcggtccagcttggctctgtccagtacattcaacatcgttcttgaacttgggaaacccctggcggctgtgttgcccaagctggagtgcagtggtgcagtcctgggtcaccgcagcctgcatctcctgggctcagtcagacctccttcctcaccctcctgagtagctgggactacaggtgcctgccaccaagcccagctaattttttaaattttagatggggtttcaccatgttagccaggctggcctcaaactcctg

SEQ ID NO: 515184 - DNA, 515 bp, Homo sapiens
gtcatgaagaaagttctgttcaataaagttttggaatgtttccaaaaacaaaaacccaaaaaaacaaaaaaaaaaacaccaataccctcacaattaaaagacaaaaaaatacacaaaaaacacccccggaattttaaccatttttcccttaaaaccaaaataattgtgcctaaaaaatgtaaaaaaatgttctcttttttaacaaaaaaaacctttttttgaagaaacttaaaaaaaacaaattacccccaggttctactttttattgtgcaaaaaaaaactccctttttatcccccattataataaaaaaaaacgggaaccccccatccccccccttttataaaacatcctttcccccaaataataaaaaaattttttaaaaacccccacaccccaagaggcccccaaaaccaatttccccacaaaaagaaggccttacaaaatcaaaacgcccgtttaaaaaccccccccccccgaaaaaacccccggtttccccccatataatccttttaaa

SEQ ID NO: 515185 - DNA, 401 bp, Homo sapiens
ctccaaagcaactaggacgaattgggagatattccttttctagtttccagcaagagattgttttgagtctgtgttaattcttttttaatgtttgatggaattatccagtgagttcatttggatctggtaatttcctttttttttttttgggaattcttggaattataaatccagtttcctggatagtggtagagcttttcaattgatctattttattattgggggagttgtggtatttggctttattggaggaataattctattttgcccaatttgtcaaggtttttgttgttgtagatgttgtccctagtattccctatttatctttttccatatctttagagcctgtttcatcactatttgttgggtaatttattgtcttttttttttgggcagtctgg

SEQ ID NO: 515186 - DNA, 965 bp, Homo sapiens
  misc_feature (308)..(308): n is a, c, g, or t
  misc_feature (316)..(316): n is a, c, g, or t
  misc_feature (529)..(529): n is a, c, g, or t
  misc_feature (535)..(535): n is a, c, g, or t
  misc_feature (566)..(566): n is a, c, g, or t
  misc_feature (592)..(592): n is a, c, g, or t
  misc_feature (616)..(616): n is a, c, g, or t
  misc_feature (655)..(655): n is a, c, g, or t
  misc_feature (663)..(663): n is a, c, g, or t
  misc_feature (670)..(670): n is a, c, g, or t
  misc_feature (676)..(677): n is a, c, g, or t
  misc_feature (680)..(680): n is a, c, g, or t
  misc_feature (694)..(694): n is a, c, g, or t
  misc_feature (698)..(698): n is a, c, g, or t
  misc_feature (700)..(700): n is a, c, g, or t
  misc_feature (707)..(707): n is a, c, g, or t
  misc_feature (709)..(709): n is a, c, g, or t
  misc_feature (713)..(713): n is a, c, g, or t
  misc_feature (728)..(728): n is a, c, g, or t
  misc_feature (734)..(734): n is a, c, g, or t
  misc_feature (744)..(744): n is a, c, g, or t
  misc_feature (746)..(746): n is a, c, g, or t
  misc_feature (749)..(750): n is a, c, g, or t
  misc_feature (752)..(752): n is a, c, g, or t
  misc_feature (754)..(754): n is a, c, g, or t
  misc_feature (756)..(756): n is a, c, g, or t
  misc_feature (758)..(758): n is a, c, g, or t
ggcaaagcaggggaactgatcccacacgtgtgcgcaaggcttcttccccaagacgtcgattctcgtggaacgacaaagaaggggaattcaccaaaggacccggggagcccgctaaaggagtcccggccccacaatgggctgcaccacaaagatctaactcgggtaccgcgtccgggagggccataaacgacgcaggccagcgcgccccagtagggcacctcaccttgttgggagttaatccgggaatcgtcatcgacccggagctctaacgaggccctcagtgaagtgggagaatcggcattgaaggngtcttcangttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggnactatncccgggaccaaactcacggaccactcgaggnctgcaaaccttcctgggaggacaggnaggccagatggcccctccactggnggaatgctcccagctgtgctgtggagagaagctgatgtnttggtgtnttgtcanccatcnnccntgggactcggagantatngnctcgccncncccnccctcctcttggaantacaanccctggggtngnagnntnantntntacgctgcaagtgtatctcgtgttatctggtgcctctctcagacccagtctcagacactaaatgcagacatactccttcctccatgcagtacatcctggagtgatgccaaggaggcctgggagaggccctaggggagcaccgtgatggagaggacagagtaggggcttcctagcaccttctttctggactggcgttacctccagaac

SEQ ID NO: 515187 - DNA, 446 bp, Homo sapiens
  misc_feature (281)..(281): n is a, c, g, or t
  misc_feature (382)..(382): n is a, c, g, or t
  misc_feature (390)..(390): n is a, c, g, or t
  misc_feature (430)..(430): n is a, c, g, or t
cccattttacctgtcctaaaaccagacaagacttacaagttagttcaggatctgtgccttatcaaccaaattgttttgcctatcccccttgtggtgcccaacccgaacactcttttgtcctcaataccttcctccacaactcactattccgtgcttgatcgtaaagatgcttttttcactgttcccctgcacccctcgtccccgcctctctttgctttcacttagactgaccctgacacccatcaggctcagcaaattacctgggctgtcctgccgcaagnttcaacaagacagcccccattacctcagtcaagcccaaattttcatcctcaatctggttacctatctcgggcataattctcacaaaaacacacgtgctttncctggtgnttatgtctgattaaatctctcaaaactcaaatcccttacnaaacaacaacttcttt

SEQ ID NO: 515188 - DNA, 237 bp, Homo sapiens
gtgccagaacaaactgatgatcccagcttattgtagtattgcctccctgtgtcgagaccaattcaaccttcccagaggcagtcagacctcaccccaggacagagtgtcaggagcattgctgtgtgctccctcaaccctatgcacaaagcaaacggttcagttttccctgagcatcacgcatcccaggcctgagtgccgcagggtgattaggagtctctacagagaattgcagcggca

SEQ ID NO: 515189 - DNA, 292 bp, Homo sapiens
gatcgaccctgcatggtccccatattctgtctttgaaaaggattgtgtggcttatggttctgagatgccagggaaaagggaacagaagatgatatgaaccatgcttataaggataaaagaagcatattcactttgaatatcacttcatgcttcatcatctccaattgcctactccagtaacagtcttcagtattcttgtactggcttcaagaaaaggtgtttttaggttactggaatagaaaacttcataaaaataagtaaggatccattgtcaagaggtatagtagcttac

SEQ ID NO: 515190 - DNA, 280 bp, Homo sapiens
gggatgggagatgtctggagccggatgtaatgggcttctctcaggtcagagtaggctctccagaggtcccgagccccagcaaaagcctcgccaaggaacgaaaagacgcttcgggcggctgacactcaggaccagggagcagaaaaccaggcccgtgagaagctgcagggtgctctctagatcagaggagataagaccccttcagaagggtagggcggtatgccccaggataactattttttttccccaacaagattatcatttccttaaaaaaaaatag

SEQ ID NO: 515191 - DNA, 407 bp, Homo sapiens
gttgacattctttcatgtcccttccctttactcatgccgaaactatcaactgggacattttgggcttttggtttaaaagttaattgatattaaactttggttttatctaaaaagtaaatgtatttgcctttgccaaaagactgacccaagagcaaataagctttaaaatcgggggttatgggctttcccccatttttgagcatattatccaaaatggtttgtataatataaatgagaatgatccagtttaagtaacccttgttaacccattgtcatggacccctgtcataaacccattttttggtttgtttgggaaaaaggcatatgggatttaaccaaattcccttgtaaatgttggattggggatttttgggtaaattttttcaaataaaggctaccagaaccca

SEQ ID NO: 515192 - DNA, 163 bp, Homo sapiens
cccacatgcagcaggacctgcccgcacaatactgtgcctaaagacagagctgccctgtcactgccaccaccacagcccacacacactgtcaagggggcctaagcactgagcccaccctcactcaccagttgccaactgcccagagtacactagccacatgccc

SEQ ID NO: 515193 - DNA, 126 bp, Homo sapiens
aaaggacaccaaagtatcttcaataacatctcgattatcaccattctctggcaaagcttgggaaaaccagttttgttcttatccatttcttcagacatttccttaatgtctctggaacgaatatct

SEQ ID NO: 515194 - DNA, 587 bp, Homo sapiens
acccggcgggggcgtacacacatacagagcgaaaaccctggcttatccacggaggcaccccctctaggaccaaatttgtcaggcacccaaatcaacaggctcggcaggcgcagtgaagcgaaccgacacaattccccaaagagggtattaaactcagagccagctcaggagaaggctggtgctgacccctctcgcgacataagatgtggctggcgctctgaatacaccaccgacttacaaggaagccccagaggaggggggtgagcgcacccggggaatccctagggcgccctaactagtcaaacgggcaactaccccccggcaaactgtaatcagtcatagttcgacgccccccaggggacaaaatgtaaagtcaccctggtagcaccgggggccagcaaacagacagctgaaggcgtcttcaaagaatcggataaaaaaaagcttgcagcccgcagggtgcaccgccacagacaggtacccgggcgcgcggagggcacgagcgcatggagtatccttcgcgggcgcccaagtgcagattcgtgctccccgcgaacagacaaataaaaacgcccgacatgacgaga

SEQ ID NO: 515195 - DNA, 1084 bp, Homo sapiens
aggatggtctcgatctcctgacttcgtaatccgcccgcctgggcctccgcccgcctgggcctcccaaagtgctgggattacaggcatgagccaccacacccggccgaggccttttgtgtgtgtagtgtgttgtgtgagacaaatgtctctacgtctgtcaccaggctggagtgcaagtgtgtgctgattcttggcttaattgctaacgcccgtgccttcccgggattcacacgtgattctccttgcctcagcgtacgtcgggagactgaggcccagagaatggcgtgaacccggaaggcagagcattgcagatgagccaacgatcacgccactgcgctacagcctggggtgacagagcaagactctgatctccaaaatataaaaaacaagaaatggataaaacacttttacaccggactcgagaaatttcagggaaatattgaagtctcgaaaagaaagcaatgctgacgggcaactcaccagtggatacagacagagcaaaccaactccagcagaaggagaagaaacaaagcagaagaaaaagcggacaaaaaacaacaacacaccacaaaaacaacgacaaataacaacatgaaaaaacacaaaaacaaaagcagcacaaagccaaagacgtagggacaaacaatgagcgaacaacagaacagaggaaaacagacaggacacagcagcgcaagaatccaagagccaaacaacaagagaaaaacacaacgaagaaacagagtgagagaagccaacgagccacccgagaagaacaaacagaatacgtagtacaaacaaaacacaagacaaaaacagaggaggaacccagaagacaacaaccacgaagacagcgcacacaacaaaccaaacacagtaaaagaaaaaacgcacacagaaaaccacaccgatgcagggaaaaagggaggacaaaaaaagcgaggaagagcagataaagcaaagaaaagaaggcgaagataggcaaataagacaaagagaaaagcgaagtaagaagtgagagacaaaacacgagcaggagaagagaacaccacacagcagcgcaccgaaaccaaggaacgcaaacaaa

SEQ ID NO: 515196 - DNA, 114 bp, Homo sapiens
atccactagctaaaaaatcccaaacatataactgaactcctcacacccaatatggaccaatctatcaccctatcgaagaactcatgtatagtcataagataaccatgaaaacat

SEQ ID NO: 515197 - DNA, 683 bp, Homo sapiens
aagatgagtgcagtgtagctggcgactctggatttcaggagcgccgatagcctaccacagtgatctttcccagctctctgagccctctccacccactctctggaaggcttgctcactgtgccctgtcagtttttggactgaatgctgagtctgatagacctctgttccccccgtcagcccctttccttacaccagtctctctgggtccacgacccctaaataagagtatcctggagcctggcttacctcaagtgtctttcccagagcagagctagacttcctttacaccaagggtatttctctggaaggctcctttatgtgtatggcttctgaagaagtttgagatgttttacacaatattttggtggccaggagctctaaccctcacccccaacaaccctgtcccaagacttttggctggctctggggagggttcagaatgcatcggcttgagggtgcagggttggcatacacagctggagataacataatgtctgctaagacgcctggtgggtttcagtgtctgttgaatgaatggcactcagatatttgagttgggggtcccagttgccttgttaaatgcttttcctggtaaaccagtgttctacatctgtatctgcaggggaagtgtatacctcatttatcctgagaactggatcagaagtaaaggttgccgggtccag

SEQ ID NO: 515198 - DNA, 315 bp, Homo sapiens
atcgggcacgccgccgccggggaagagtacagggtgaattggcgtcgcacgaacgtattatgcactgtgtggcttgtggtggggtcttaagttgtggtctgagacacagtgctgtggttcccctggattgagtgcaactgccgtatgctggtggacccccaagaagtaccacgggcctctttaccggattctcagttactcttacaagaggactggggtccgtggttcggcatacaggatgggctccgaatttccttggctaactccatgcagggactctgcaaggtttggctttactgaggggactcctcctac

SEQ ID NO: 515199 - DNA, 417 bp, Homo sapiens
cttttgtagtgtgagatctactgtgaagctggtactagagcttatgatgacatgctgataatgtagagcagacctgattgtagcgccacctattaacgcctgacatactggcaccgccagatgcgttccatgtgcacagagaagacatgccgcagtgtctaaggcaagacattagtatactgagtcgtagacgctagtcgtgttagctcgctctattaccggatggtgcgaccctcaacaatctgaagtgtacgcccatgctgtcatcttctgctgtgcactgatacaacgtgaacctccgtgatctgacttctgtggaaaccaactcgagcatgatatcgcgtatcattgcgttaatcttaggaggagaccaatatgacacacgcactgcgggaagatggtccatgtagatgctgt

SEQ ID NO: 515200 - DNA, 111 bp, Homo sapiens
ctgttagctacccataaaaatgctgtttgctgcagttttgtgtcctgggcttggatgctttttataaaagttgtcattgttggaaatttttaaataaaactgttttaaata

SEQ ID NO: 515201 - DNA, 318 bp, Homo sapiens
  misc_feature (15)..(15): n is a, c, g, or t
  misc_feature (18)..(18): n is a, c, g, or t
  misc_feature (84)..(84): n is a, c, g, or t
tgctcttccctctgntcngaagcacttccctcagctcatctcatcctgagctctgtccaaatgtcaccctcccctagaaacagntttccaacccggataacaggattttagtttcttcctcttccttacagtgacctaatcgttgctgtgctgtgttttgtctctgccccatcagaaggcgagctcatgaatctttgtgtgctctgagcactgtgaataggatctggccccagaaccgggctccagtgctggagtgaggaatgcacacagggccaaaggcagtgagctctggggcctcccgagacgctgtggcggccg

SEQ ID NO: 515202 - DNA, 112 bp, Homo sapiens
agatatcgtgccactgcactccagcctggtgacagagcaagtctccatctcaggtgaaaaaaaaaataggcagaggccaggcacaggggctcatacctataatctcagcctg

SEQ ID NO: 515203 - DNA, 659 bp, Homo sapiens
taaatcccaaacagtataaatattgaaataggttgggtgcagtggctcacacctgtaattccagcactttgggaggccaaggtgagaggatcacctgagtgtcaggggtgttgagaccagcctggccaacatggtgaaaccccatctctactaaacaatacaaaaattagctgggccatggtggcgggcacctgtatatctcagctactcaggaggctgaaggcagtagaattgcttgaacctcggaggcggaggttgcaatgaagcccgagaattgccgccaattgacactcccagccctgggcgacgagcaacaactcacattctcagaagagtatatgtatattaatcatatattatgctgaccaaacggcgggtgggcacccacaatactataagggagagtggacaaggacaagtaagcacacaatggtggcgcccagattcgtctgcttcagatgcaccctcggtgctggcgaccacaaataagagagaagccacccacaatctctgccgaagaaatagtagtaaaaatatttgagcacatcatcattgatggctactgcaccgtatacacaccacctaaactaaaccagagaagtgcttggatgtggaccagtcatcacgtgacccccgaggctactccgaacaataataga

SEQ ID NO: 515204 - DNA, 160 bp, Homo sapiens
ggggggcccttgggggggggtttttaaaccccccccctttcttttcgcgctttttgggtttttttttccgggcccccccccccccgggggcccctccccccctttgggggggcccccccccccttggtttttagggggggtttttttttttttcctttga

SEQ ID NO: 515205 - DNA, 1241 bp, Homo sapiens
  misc_feature (911)..(911): n is a, c, g, or t
  misc_feature (922)..(922): n is a, c, g, or t
  misc_feature (924)..(924): n is a, c, g, or t
  misc_feature (933)..(933): n is a, c, g, or t
cccgcgcgcctatattgttgccccaggggtctttacccccctcgttgtccctgtgggcacaatgatgggagttttcaccgttgggagatgtagctgtgtggccaaagggggggccccacagccttttgtggcccccccccgggtatcctctgggccggggggctttccccctttagtggcaccacgcgttttatatagggggcccccacgcccggttcttaattgtgagcccccggatttatggtgggggaaaggaaattttaatttatagggttactgatggggccggacccagaaacccctttgccgcggaaggcccctccgggtggagataaaacccttcgggtttggtcccgccacacgaatttatggaatttctctttagggttgcaaaagccggtgtaaaagagattgtggggcgcccacccaccggaagccccctcgtctatgagagtgccccccccctctggtgagaagatgtgtatagagctcggctttataggtgccgcacgcaagagagggagacacacgccttctctcttggggagaccacacttattgggagaaaagaaaccccctctggttatagacagagagagagtttatcaagagaatgtgtgtagacaccccccacttatagttataggggccgtatataatggcacgcccccacccacactgtattaagagagaaggcgggttttcaagaggcgtcacaccacacccacgctattcgcttaaaaattttctcccctaccactattatacctgtagaactccctccaccacaccccacacattgtgagaccacacttctatgtcacccctcatctatagagaagagaacctatacatggttatagtatatataaaggtatacacactgggaaaccacatttcttcgctcctcngcactataagncnctcggcgtncacgagattataataccacctgagaactgagccacacattatacacgccccacatattctatcacactcacaccctcacccaacgtcacttatttatccctccatcctgttcacaccccacaccacggcactgctcactaaaggaaaaggttataaaaaagtataaaggaaactcggccaatccttaaccccccctgtttatcccacaaacactcaccctctagcactcaccccgtattagaaggccccgccctgccccgtgacacatgttttacggccccggtaccctaaccgtgccaaggtagcca

SEQ ID NO: 515206 - DNA, 668 bp, Homo sapiens
taaaaaagcaaaaaaaaaatttttggggaaaccctagaaaaaaatttagaagtgtacctggtttttaaaaaaaaaagggtgtggaaagggttggaagaggagggttgtcttttaattgggaggtttatagatgaataatattaaatttgtattaaaaaaattaataatgttatttttattataattttataattattatattatatttttaatagatatattcatcaaaattttaattaaataagaatttttatatttaaaatatatatagattaatatgttattattttttatattatatttataaatatattagattaaaattaattatgataaaatattattaaaataagattaatataaaattattatatatgtataaattttattaaaaaatatatctgatttacataaattctaatatattgataatatttataaatattatgtttatttttaataatataatttatttttatctattattataatataattataataatattatcaataattaaatatatataatataatttttataatattatatatatatacccacccccacaccctatacaacactcattcataccatactaactactttcttatacatatacttatctaattaacttatattaatttcttttaaatatctcatttct

SEQ ID NO: 515207 - DNA, 145 bp, Homo sapiens
ctcttatcaagtcagcacacaccttttccaaggattttacgtggcggctagtaagggtgattcgaattcggtgaatggccacctccggctccacgggtgtctttccggtatccttaaaagccatggctgtagcgcgcgggcttcc

SEQ ID NO: 515208 - DNA, 261 bp, Homo sapiens
ccacctcagcctcccaagtagctgaaactacaggtgcatgccaccacacccagctaattatgtgtatttttttgtagagatggggtcttgctatgttccccaggctggtttcaaactcctgggctcaactgagcctcccaaagtgctgggattacaggcgtgagccaccaggcctggctggaatttttatctttctggatggtatcatttgaagcacaaaagtttttaattttgatagaaataatggtggtggtcgttgtg

SEQ ID NO: 515209 - DNA, 341 bp, Homo sapiens
  misc_feature (161)..(161): n is a, c, g, or t
cctagaggatccttcagaggcacaaggaggcagaggcacaaggaggtccagatattaggacatggatatctttggggggaaccattattcagtctaccacagatgcatactcatctctctctcttttttgagatggagtcttgctttgtcacccaggctgnagtgcaatggcgcaatcttggctcactgcaacctccacctcctgggttcaagcaattctcctgccttagcctcccgagtagctgggattacaggcatgcaccactgcgccaagctaatttttgtatttttagtagagacggggtttcgccatgttggccaggctggtctcaaactcctga

SEQ ID NO: 515210 - DNA, 401 bp, Homo sapiens
ttcttcttgctgcatctccattgtgggccatagcaacgagcgttgtgacggcggtatctacattggctctatcatgaagggtggggtcgtggctgctgatggccgcatcgagccaggagatatgttgttacaggtaaacgagatcaactttgagaacatgagtaatgacgatgcagtccgggtactgcgggagattgtgcacaaaccggggcccatcaccctgactgtagccaagtgctgggacccaagtccacgtggttgcttcacattgcccaggagcgagcccatccggcccattgaccctgcggcctgggtctcccacactgcagccatgaccggcaccttccctgcatacggcatgagcccctccctgagcaccatcttgagcctgtgtctgggta

SEQ ID NO: 515211 - DNA, 284 bp, Homo sapiens
tattcccttccattcctgttgattcaatttcattcccttccattcgattcctttccattcgattccattcctttccattgcattccattcgttcccattccatgtgatttcattccattccagtccattatattcgagtccactccactccattctattacattcaattccttttgagtccgttccataacattccattaccgtctattctattcccttccattcctgttgattcaatttcattcccttccattcgattcctttccattcgattccagccgacg

SEQ ID NO: 515212 - DNA, 704 bp, Homo sapiens
acgcgccggtgaagtagacccgtcagcatgggccgtgtgatcctgtggacagaggaagggctgccgggtctgtgtacctgcgcgcacgtgaagcacctgtaaatgtgcgctgcgcgcctgcgacgcctgtggatttcgcatgagcgtgcacggctacatcaatggtgcatctgtcaagtgacatcatcccacagaccctgtggcctgctggctgctgccccatctgccaaaggatgtgtcttaccaggtgatccgatactcggatttaatgaatgcgtgacggatgacttgtatcatatgcctgcctgatgggacattcaacacttgtggccaagttatgtagtatttgctgtgcaaatgaatggcaccagctcaaccattgtgcacatgtgcctcccgtgtgggcaaccaatgacctgaagggatacacatacgtgtgactgccatggatggaagaagccctgagaggacctgtggacacggctggaccctgggcatcatgggaaacatatgccaaccggttaatctacccacaacacctgcagcaccaagaagacccgatgtgaatgctgacccatccggcatccaagaaaggataatctccctcagaccaacaggagctgtggacacggtgtgcgtgcctgcaggtggcccgacatctgacaaacccatcttgaaggctggccaggacgtaccaccaattc

SEQ ID NO: 515213 - DNA, 1114 bp, Homo sapiens
agggagtctggcctagtgaaagtctctgtttcctccttttcttacttttcactcaataaaaccctgctttacacacccttcaaaccatctgtgagcctgaatttttacggccatgggacagacaaggatcctgtctttatctaaactaaggaaaagtcctgcaacatttgtggtgcacaacgtggggctcgagaagtgatcatccaaagtccagctaccacaatatgtctggattgaatcttaaggattcttcctgttattcatgaaaacgcctattttggagtgaaaccagggccgccttatgagctaaacagagtgtgttacagcttcaatagactaaacaagctctaaatttatcttcctatggtcacgggatctcatatattctggctgtcattgtcataataagccactcttggtcatatggaaaagcattcagctgctccctgcctttgctcacagcgtgtggtactctcttagaagctattcctggaaactgcagagaagagaataatttgcaacccattcttctgaggcccaaattaactcaataccaacacaacataaggacactataagaaaacttgaagaagatgaagtttcttcttcattgaaagaaaataaaggtcacgtctgtgatcatcgttcgagaccaagtaccaaagaaaacagcaacatctggctgaaggaggcttcttctgagatggcaacaggcaactgcagaagagaggagggtagtttgtaattagactgatggcaagcaacatttgggcatgtgcaaaaatatctctgatcactgtgttttcaccttaaaaggaagtgtgactcaaagttaggaaccattatttatatacagcttttgtcattcagttcactgacaagagttaaaaggcactttattttatttacaatatctcagtagactttgatactaaataatataaagtgtgaaaaaactgtatatgtaaaagaatatagtaggcatactttggttagaattgtgaatttggggagaaactaaactctaataataggtaattaggaaaattataatagatttacttattcaagctcttgtaaccactaataaatggttatgaagcctctgtcaaaa

SEQ ID NO: 515214 - DNA, 269 bp, Homo sapiens
aggacttcagcgagtagcgtccatggcccctcggagtaaacaaaagaaaaaagaaaaaacatatccttgaaaaattccccttaaaggtaggtttataaaaggtcagaaatgcctggtacccaaaacaagtgcttaaaaaaaaaaaaaaaaaaaaaaaaatgggggcaaccacctctaacaatccaattttttttttttataacttcaaaaaggggaagagttctaatatcacggatagcctcgctgttaagaaggacctccttctcctg

SEQ ID NO: 515215 - DNA, 260 bp, Homo sapiens
  misc_feature (38)..(38): n is a, c, g, or t
catggttgaatggacgagctggagtttattctcagagncagtgagaagccactggacaagttgtttttttgtttttctgtttttgagacagagtctagctctgtcacccaggcagactgcagtggtgcaatcttggctcactgcaacctctgcctcccaggttcaagcgattctcctgcctcaggctccccagtagctgggaccacaggcacacgccagcacacccagtctagtttttctttttcttttttttttttttt

SEQ ID NO: 515216 - DNA, 170 bp, Homo sapiens
  misc_feature (20)..(20): n is a, c, g, or t
  misc_feature (48)..(48): n is a, c, g, or t
  misc_feature (67)..(67): n is a, c, g, or t
ggccaaaacattttaaacanaatgtgctctatacttcaatcttgacanatccataacatcattaaanacatttgttttgttttgttttgttttgagacaggagtttcactcgttgcccaggctggagtgcaacggcgcgatctcagctcactgcaaacctccgcctcccc

SEQ ID NO: 515217 - DNA, 403 bp, Homo sapiens
cagatcagtctggctgctacattcatagccgcactgtcttcgttgagtggtcttcacaaatctccgcagcttgctgctggcggcaggtgttactccgggtatgcgactagcagccccgatcgtctgtggccgactccactgtagtttctctcgcacttcctgggacaaagacacatccctaatagtcaaataatctaggtctaaacggcagaaggagagactacatcttgctgaactaccctttatatactagtagttaataggaacaacactgattcataagtggctactataatacagtctatcagccagctctctacattaagtctacttctatcaagggcactggaacaaagccttggataatagactccatgtcacactatcctcatcattcagaaac

SEQ ID NO: 515218 - DNA, 910 bp, Homo sapiens
cagagcacggagagcggggaggacagagataccgaagcacaagaagacgcgcaacccgaggctgtcccccgatgacgtcctgtggagcagcgtgttctccccacaagtccgtggccccatgagagaggcttcacaaccacgggagggcggcaactctaaggcgcctcacccacaccgagggtgagccacgatgggaaacgacggaactcggttgtaacacagggacacaaaggtggaaaaaccatctcgcggtgggaggaaacagtcttgtcacgacgccaagagtgcttttccggcagagagcacactcccccacatggcgccccgtttgaccgcgcccttttgttctggaggcccgtggctttccgctttgtaaggggcccctctattggggggccaacggctttgggtggcaccccgcgcgctctcccccccaggcggagattttgggacaattggccgccccccccctgcaaagttctgctaactatcttgtccgccgttattgggcccccggggcgttcacctccccctgggccgttggttaacgaaccgttgtcttccgccccgtgccgcggacgattcccccgccgatccgccagggagctcccaacggacggcaacaccttggtgcggccctccgccaagatttctgaagaactttgccgggcacgactagcggagcatgccggcccccacaccgggaacaccagccggcccccaaaaattaccaggagccacaccagacaccccgaggggggacattcctccatacacagcagcagtgagacaggtaaccaaccccggttgggatgcacccaggcgcgtgcccaacagccttgtcaccaaacccccggggcgcggctccccagtaatgagccgcggtgaatccccccaaccccatcataac

SEQ ID NO: 515219 - DNA, 643 bp, Homo sapiens
cgtgattgacatagttattatactagcatttaccatcacactcctaggggtactagtctatgggtcacacctcatatcctccctactatgcctagaaggagtaatactatcgctgttcattatagctactgtcataaccctgaacacccactccctcttagccaatattgtgcctattgccatactagcctttgacgcctgcgaagcagggattggcctagccctactagtctcaatctccaacacatatggcctagactacgaccataacctaaacctacttcactgctaaaactaatcgtctcatcacttatatcactaccactgacatgactttccaaaatgcacatattttgaatcaccacacccacccagagcctacttattggcagtaaccccctactactttttaaccaaatcaacgaccacccatgtagctgctccccagccttttcgtccgatcccctagcaaacgcccctcctaatactaactacctggctgctacgcgttacagtatggtacgccaacgccacttattcagtgaaccattatcacgtaactttcccttttatccttatttccctccaaattcctctaatcctacattcccggttccggccttcctttccatctctcttcgcg

SEQ ID NO: 515220 - DNA, 264 bp, Homo sapiens
gtagccacagctacttgggaggctgaggcatgagagtggcttgagccccaaaaacggaggttgcagtgagccgagatcgcaccactgcactccagcctaggagacagaatgagaccctgtctcaaaaaaggaaaaaaaaaaaaaaaaaaaaaactcccaataaggaaaccggaagggggcccccggaaatcccaggctcaagggccggaccggttccggagcccaattccgaaaccagggccaaagcggttcccggggtgaact

SEQ ID NO: 515221 - DNA, 287 bp, Homo sapiens
caaggcttaatttaacgggtcagaacattaaattattacaacattttttccaatatagcatactaaacagagtccatttcttttaaaacgctgcacaagagactaggaatcaagctttcaacagattatgaataactcataactcattctaccttcttatagatttgcaacgctctccccacccccatgcctgacgcacgtgccactttaattctgagcacagccgcccaagagcaccagcttctaaggctcctgtaggacatgacttcactcttaaatgctctgcc

SEQ ID NO: 515222 - DNA, 350 bp, Homo sapiens
gctgactagcacatgcatgtctgctttctgacacgtgactttgtcagatgtttggggacatactgtatccttagaataagtgagtatcatgaacagcatttaattcaactcttcacactgagggaggagtgatttgataaactaactatggtgtctgcgaatataagatttgttcgtgaaaattagcagagaacaataaaaacagaaataagttgtaaaaatttgcagatgcactatcttaatatatatttagatgccctatcttaatatattaatagactatacccaattcctagatactaaagactggctgtggatttttttgagtgagaagtacagaggtatttggc

SEQ ID NO: 515223 - DNA, 1139 bp, Homo sapiens
aggggtctataatcaggggttcgttacaaatgtcgctcctcacaaaaaccgcgtggtgataataacaagggttaatttagatagggggtctaacccctctataaccctgtgttataggggccatcacacaatggacctttggggggcgcgtcaaagcgtgggatttctcacagctatttttgggggaaacctcgcttgtgttttgggctttccggcccaaatattgtccgaaatttcttaattgagacttttctctattattataggtatcgcccatttctttttgttgaacacagactgcgccgttctcccaaacatgtcgtgttgcccaaaacaatggggtggttatctcaggttaccctaaaggcatcatgggggctgtgtccctcatgggggccccccccatagaatctttgtgtgggcttggggataaataaagaagggcccccttgggccctttttaactaaacctgtgggaacaaaacttaaaaaggggggtacccccccgatttttctcacagggggcacacccctgtgtctgtcttttaaaggtttttctcgggcttttctcgtgttgatacgcacatataggggggtcacatggagtctggggctatattctcttttgatccgctggagaagtgtgaaccacaggccttatatgagtcttggccctcctctgagagccacatttttccactcagctcacccgtgtcacagaagatatgtctccttactccaggagaggtctcacacttcacaacctttaaccacacgctgcgcggaaggaatggctggaattccgcagagttctcccacgtgaccacaatgtgtgctgaatttaacacatgaagaagtatataattggcttctaaccccgctgagaaagaagggtggatgcacgctgcttgtgttttcttggggtgaactgtcacattgggaaatacggagcaccacgtgagcccactcctccactcctaatttaataagtggaaagggccttcacaattgtaatcacggaacttttttttaaagctttggcaccttgacctctatgtgttacccgtccataatgagctgctgcagaagtgactaattgttttacttttttggaagttaaccttaccctactcactact

SEQ ID NO: 515224 - DNA, 140 bp, Homo sapiens
cgttctagaggatcccaacgcgggactttgttgagtctccacaattactgatcgttcctggcctggactatcaatccagcctcccacattattctgaataccacaattgatccccattactgtatctctctgatccacgt

SEQ ID NO: 515225 - DNA, 1058 bp, Homo sapiens
  misc_feature (150)..(150): n is a, c, g, or t
  misc_feature (201)..(201): n is a, c, g, or t
  misc_feature (463)..(463): n is a, c, g, or t
  misc_feature (781)..(781): n is a, c, g, or t
cacaatgttactggaaatgtacccaacaagacattacaccaggcacttaacttcaaaaactgggaaagttttcccactttccttggaataacatttggcgctatccttggaatatacattgtggtggaacttctgcgtagaggttacagnacacctaagttccggtggcgtccaccatctttcaaccgcacaacccagccnttggagagtattaacaggaaacatttattaacaacgggcttggtcacttatattcatatcttccctattagggtaggcggcttaacaggggcttgcgtccctattcttgcgcattagaggtctcactggacacttctgaggtcctctcctgtgaggtcaccagacaactatactaaacagacggcacgacagacacattaacctatactctaacgcgtcccacacacctaaccgctgggtcctctctgcgagctggtatcanatggtgacctctatgtgcccaaatctgtccacgctataaatctaaaacctggggtatcacctggtgtgtctggccctgagtccctatgggtcctaaacaaagcctctctctaacacagcgggcccggaaactctacatgtgcctgtgttgggcgcactaaattcagagtaatgtgcgggtaataaacacttgggatttttcccagccactaatatacagtcctgaggagaagagagtcctagacactccctatgtcctgtggggaaatagggtgatcctccagagtacactacctctttaacggtccaacggtggtgnacagccttcacttggagtattccttccaagaattttcccaacgcaccctcttcaggcggccagtgtctttccacacacagtctcccaccattacaatttgtaggaactgggtatcatccggaaacacagcccgctggcggtatccggggaggcgctctacagtggtccccagatgcatatataactcagctataacttccgcgacgtatatgtggccatagtgccaaggagattggcagtttacgcacatagaccaacatttgggccttcaggggcc

SEQ ID NO: 515226 - DNA, 447 bp, Homo sapiens
tgctctaccacagtgtatctaaataagctgtcaactacaatttatcctattgctgctgtaaaatttttatgaccagaaggaaaacctgaccatgggacccagctagcttgatggccttcagcagcaaacaagaaactgtccaagttaggaggtgaggactagtgcctgaagatgtcctctcagtccacaacatgtacaggtgcccatacacacatcagcactcgcacaaagatgctctggaggctatagtagtgtgtcttggtcattgcaaaccatcagaggcaaaccctgaggtattcccatttcctgtttcctgcttgcagtgtctacatttctctcccattctaatgaaggaatgattcttttataacatgagtgattttatgctgtttataaaagtaaatgttgacatgtgttagaattaaaatgacttagagaaataaaaaa

SEQ ID NO: 515227 - DNA, 173 bp, Homo sapiens
  misc_feature (18)..(18): n is a, c, g, or t
  misc_feature (54)..(54): n is a, c, g, or t
  misc_feature (113)..(113): n is a, c, g, or t
tataaatatatatgggcntaatcatttaaaatttgttgcagcaagaactttccnacctgtaggcaatagattgctatgtttttaacaaattgtggcaaattctaaacagcaantcttttgtacgtaataggacatttcatcctagaaaaataaagtaatgtttttgacattga

SEQ ID NO: 515228 - DNA, 768 bp, Homo sapiens
  misc_feature (5)..(5): n is a, c, g, or t
  misc_feature (84)..(84): n is a, c, g, or t
  misc_feature (96)..(96): n is a, c, g, or t
  misc_feature (210)..(210): n is a, c, g, or t
  misc_feature (444)..(444): n is a, c, g, or t
  misc_feature (490)..(492): n is a, c, g, or t
  misc_feature (496)..(497): n is a, c, g, or t
  misc_feature (500)..(500): n is a, c, g, or t
  misc_feature (503)..(503): n is a, c, g, or t
  misc_feature (510)..(510): n is a, c, g, or t
  misc_feature (512)..(513): n is a, c, g, or t
  misc_feature (519)..(519): n is a, c, g, or t
  misc_feature (526)..(526): n is a, c, g, or t
  misc_feature (549)..(549): n is a, c, g, or t
  misc_feature (551)..(551): n is a, c, g, or t
  misc_feature (627)..(627): n is a, c, g, or t
  misc_feature (631)..(631): n is a, c, g, or t
  misc_feature (649)..(649): n is a, c, g, or t
  misc_feature (654)..(654): n is a, c, g, or t
  misc_feature (679)..(679): n is a, c, g, or t
  misc_feature (690)..(690): n is a, c, g, or t
  misc_feature (740)..(740): n is a, c, g, or t
atacncacggtgtggtgtagagagggagatgagatagacagagagagactcattcacatatagatatagattacatatgagagnatagtggagtgnagagcacgatcgagatgatatctcgctggagtcagaatcaccccattggcagagcggaagaagggtattccatctgctgacagagccagagatgtgactcatgccctccccgangcaagggcagctcctgctttgtccagactcacctgccagagccaggggtccatcgatgaacacagctatttcacaatgggaccgcatgcctgcagagacagctggagctgaggcctgggcacctggagtgcagtcagcaacctaggcagactgggcgtcctgggctgggggatgcaggggtgctgctccatgccggacatggggtggccccagacaagtgttgtaacctttganggggacctgggaggacagagtgggtgggagtagctacgcccccccnnngccnngancantgatganannggggtntccaggnagtcctggcgccaggtgaatgtncntccttccctggcaggacaggcctttgagtaggatggatggccagtccttccagaatgtaccatggactagcatccngggnagggctggcgtgtctccnggggnatcagctccaacttaggtacctggntgaacgggtanagtaagaccccttcgcaggcaggggttcctcccatctcgtctcgcacttntccctcaccccgacctgcagggaatggc

SEQ ID NO: 515229 - DNA, 1740 bp, Homo sapiens
  misc_feature (455)..(455): n is a, c, g, or t
gctggttaaggacggcagagccagtatgagtgccgccgtgcgccataatcctactgatcagcatgatggaagtccacagacctgattgtgacccgtctgcgtcaacgcgcaggctccccgacaggtatctctgcttgtcacgctccaaccattcattgccatactatccttcgctcggcaccgaatgctggagaagttcgtctcgacgtggctgagtcttctaggactaacactattctcgctcgcacaagcctactctttctggtggacaactactgacagccagacgcagtatcggagcaaaaactcttatagaacctagatataggagcatagcctaccaagagagaatgactagggccatacagaagatagtaataccactgaccccacagatgagaagccttatatacaccacccccaggaagggacacccaagacaccaggatgacaanagtacagagattagagtgaaaccctaagaaagaatttggcatgagaagatacggagggaagaccaccaagacattagcattagacttggaggaaaaaatagcataagaacattttatgaaaacacccaaacaaacacaacagaccggaaaatacctaacatggcccttatttctgaaggactacataggcaaagagcagcattcagttataaatcaataaccaaatacacaggcaattggaaaagtcagataaacataccgggggaggattggaagcgacaatatggtgaagaatgagacattgaccacagtggagacaatgagaacacgaaaacaaagacatgcccaatatatatcacccctaatctatgagaaacgaccgtgaaggaaggagcgcaacatcatatgatgcacatagaataaactacataaccatggaagaagcataaatagggaaaagagaatcacaatccattaccaaaatcattataactaacaagaaagaaatttaacatatatgacattgacaatataaaaatgaaacaaatttacccaccattcacccaaaaccttacatatcacattatatagacagagcaatataattaacataatcataacaattacacccaaaatttaacatactaaacaactataaaaggacagataaaatgattaccccccattactatagatacccaattataacccaataacccaataaaaagatatataagggagactacagaataaaaacaaaaaccaagggaacaacacaacgacaaaacaaaacaaaacaaagagagaaagacacagacacaaaaaagagaagaacacaaaaaaagagaacaaaccaacaacaaatacagacgagacagacacaaagataaatatgtaggacaagagagggacacccataaaagagagaaaacagaatatataaaccgatagccgccagacgcgagcacgctagcaaaaagaccacagacgtacacagcgaacaccacacgtacagcacggaggcacattagcacgaagcacaccaacaataatgatggaggcgaagaacagtggaaacacgatccaagtcagagaaaacacacacgagacacaacaacaagacaggcgagtcacgggtacaaaacacacacatacgctgcgaacgaggatcacctagctgcactaagctcacgcacaacaagtgacactcaactaaagaaagacaagcaataacaatcaagccgacaaccacataaaaaacaaaaagaaccggaagagcacaacc

SEQ ID NO: 515230 - DNA, 280 bp, Homo sapiens
gtcgtcgtacgaaccttacttgtcagggtcaggtaatagtagtacacagtgatgtatagtaattggacttgttagaagtagtaggaaggacaggatggaacaaatttagagagcagcactgacatatgtacatgaccaggtgtaaaatagatggccagtgggaagtggctgtataacacaaggtgctcagctccatgctctatgatgacctagagaggtgggatgggaagtttgggaaggaggctcaagatggaggtgatatatgtgtacttatagctga

SEQ ID NO: 515231 - DNA, 607 bp, Homo sapiens
  misc_feature (429)..(429): n is a, c, g, or t
ccatgttggccaggatggtctcgaactcctgacctcaggtgatccgcccaccttggcctcccagagtgctgggattacaggcatgagccaccgctcctggcctaaaatctcttaatttctaaactaattgattgttactctggaatttcttgattcttcgttattttaaatgtgacgggcagtgacttttcttttgtaggtttggataaatacctcggacattattttggttggtctccgagactaccaggtaaaatttacatgtaaatttttcctattttactggcttgaatttgatgagccatttcttaagagccagttttgtttcaggcattgtgctaggtatcccagggatttatgtttaaatcaaaatctgggagccattattctaggggatacagctgaatgagttaagtgcccatcccacanaaggctcatagcctggtagtggagagagttaagcacacaagtaattacaatacacatcacaacataggtatgtgctataaatctaaaggagcacttgggaaagaaagaaagtggtggttgcctttcgtgatggaacccttgactctgtagactcattgtgggtctgtgagatccattg

SEQ ID NO: 515232 - DNA, 203 bp, Homo sapiens
ggcattcagagcgtgtgagatgctggcgtcgcgtgctccactagcgagatcgagctgcgagtctgacgcagtgatcatagagattctcagctcaggcgataggttgatacacatactgaggtacactgctgaggcatacgcctacatcttctgagggcagcgacaatctaggctacgcctgaatcggacgaacagtccgccgc

SEQ ID NO: 515233 - DNA, 679 bp, Homo sapiens
  misc_feature (37)..(37): n is a, c, g, or t
  misc_feature (81)..(81): n is a, c, g, or t
  misc_feature (83)..(83): n is a, c, g, or t
  misc_feature (90)..(90): n is a, c, g, or t
  misc_feature (116)..(116): n is a, c, g, or t
  misc_feature (120)..(120): n is a, c, g, or t
  misc_feature (122)..(122): n is a, c, g, or t
  misc_feature (173)..(174): n is a, c, g, or t
  misc_feature (193)..(193): n is a, c, g, or t
  misc_feature (203)..(203): n is a, c, g, or t
  misc_feature (205)..(205): n is a, c, g, or t
  misc_feature (208)..(209): n is a, c, g, or t
  misc_feature (215)..(215): n is a, c, g, or t
  misc_feature (231)..(231): n is a, c, g, or t
  misc_feature (243)..(243): n is a, c, g, or t
  misc_feature (249)..(249): n is a, c, g, or t
  misc_feature (276)..(276): n is a, c, g, or t
  misc_feature (283)..(283): n is a, c, g, or t
  misc_feature (378)..(378): n is a, c, g, or t
  misc_feature (384)..(384): n is a, c, g, or t
  misc_feature (386)..(386): n is a, c, g, or t
  misc_feature (412)..(412): n is a, c, g, or t
  misc_feature (415)..(415): n is a, c, g, or t
  misc_feature (417)..(417): n is a, c, g, or t
  misc_feature (432)..(432): n is a, c, g, or t
  misc_feature (438)..(438): n is a, c, g, or t
  misc_feature (451)..(451): n is a, c, g, or t
  misc_feature (493)..(493): n is a, c, g, or t
  misc_feature (517)..(517): n is a, c, g, or t
  misc_feature (533)..(533): n is a, c, g, or t
  misc_feature (547)..(547): n is a, c, g, or t
  misc_feature (571)..(571): n is a, c, g, or t
  misc_feature (575)..(575): n is a, c, g, or t
  misc_feature (578)..(578): n is a, c, g, or t
  misc_feature (596)..(596): n is a, c, g, or t
  misc_feature (619)..(619): n is a, c, g, or t
  misc_feature (660)..(660): n is a, c, g, or t
  misc_feature (671)..(671): n is a, c, g, or t
tattatttcttttcttttcttacacttttattttaantctttctccttcatctctctttccatttatcttcttactcttcnanctcctcntttattttctcctttcttaatttttntcanancttttctactattttcatctttttcattattcttcattcttccatcctaanntttctccttccaataatcntcttctttantntcnnatttcntttcctccctccaacnctttctccattntctctntcatttatctttacatcctttctattnctctcanatcttcttttacatttcttcttccttctctttcacctttttctttattaactcttataacttttttaaaacttcttttccttcttttttttattncttttnantatttttcattttttttaattttttnttncncatcttctcctccanaaattnctctatcttcatnttttttttttttttttctcttttatatatcattatttttatnttctattttttttctaatttcttnatcactttcttttatntttttttttttacnttttttatttttaaatttattttntttnttnttattactattaatatcntgttttattatttttatttatcnattctctccccttcctcactctcctttacaaacatctttanctttttctccnccattttt

SEQ ID NO: 515234 - DNA, 874 bp, Homo sapiens
aagacagtacaaagagaacaattttacagctgggccgccaggggtgacatcacatatcagttaggacatcacatgtcaggtaggaatcaccatgattcctgcctgagtctcagaccagcaagttgatcattaagggtttcaaaaggggagggggtgtaagaacagggagtaggtacaaagatcacatgcttcaaaaggcaaaaagcacaattactagtaagggtctaacacagatcacatgcttctgagggaacaggacaaagggcaaaagcagaactactgataagggtccaacaaagatcacaaggcaaagagcaaaagcagaactactgataagggtctgtgttcagtggtgcacatattgtcttgataaacaatcttaaacagcagaaaacagagtttgagagcagagaaccagtgtgaccacaaatttaccagggcagagtttcccaaccctagtaagcctgaggggtactgcaggagaccagggggtatctcagtccttatctcaaccacataagacagacattcccaaagcagccgattattgacgctccccccaggaaatgcattcctttcccagggtattaatattaatattccttgcctaggcaaaagaatgtaggcgagtaactctccctatttgcacatccgtttataggctctctgcgagaagaaaaatatgggtctttttggcccagcccggagggaggcagaaccttaatggttgatttccctggtgccgtaaaaaaggcgggattctggccttcccagggggagcggatctccaattggtcgaaccccccgggtttacaccctttggagcggcacaacaggatcacacggggccgcagggagcatcccgtttgaggac

SEQ ID NO: 515235 - DNA, 959 bp, Homo sapiens
atcttcaaggctcagcagtaaagcagttctcggtatacgtgtaagcataaacatttcatttctcaccacacatggctcatttgaattcactttaatccattaagcaacataaaagtacatgccctttaatccatacacaagcacaaactctacattatttcaagcctcatccgtgtaatatcgaccatcttgcacatgctcagctgctcaattccattcacagcaagatcaacaggcaatcatatagcattttctgtctctaacatatattccagagttaaaatgttctttaatgtacttcagaagtacttatgcagatcttaaatctgttattcaaaatatatgcttttaaagatgtattgtgcttcccatgcaggcttgacatattctattgtcaacagcaaacagcaatgggtaatgtgaacattctttaccagccgactgtacaacaatcaatttaacccatggcacaacaccttgtagagtccgtatactgttctgccatgggccaaacaggactctggcgtacctgcactggaaggctatcccgttctctcttgtcctgaacgtggctactaccagaacccacacatttaatgcttacgacacgttgctctgactccaaccatttcgagcacggatggccttagcacacaactctgaacttcctggcgcctataacccatcctggcaccttccgtcggttacaagcggcacacgcgatcattcactggcaattgctaatcaacgcggcttatcgccaaattacgagttgcccgagttgggcccatttggaacctacaagtggcacaccttaagagaacacatgggctagtctcacaccggatgcgcagacttgtgaacaacgtctaacagccacactagtacccaccaacactcaacggtctccactcttcttatcttggctctcctacgcgatcacatgcccaatagcgctg

SEQ ID NO: 515236 - DNA, 108 bp, Homo sapiens
ggacaggcccggactcagtgctagcactcactgacctcctgctctaagccacaggggtgggcggtggcaggaagaaagaatgtcatgctatctcttgctgctcctccg

SEQ ID NO: 515237 - DNA, 252 bp, Homo sapiens
aggatcggttagggacctggaggcagagaagcacggtgaccttatgcctctgtgccctgttccctgtctcacccttgtaccacgggggccttggggtccggcggggccacgggcgccaacagggccgacaggaccggcggaaccagcaggaccagtctcaccacgatcaccactcttgcaagcagggccaacgggcccaggggcaccacgaagcaccaggagcaccagggggtccagcgggcccgggcctca

SEQ ID NO: 515238 - DNA, 373 bp, Homo sapiens
caacttatcagtctgaccgacgccgcagcgtgtgatggcgagcgagattgtcacgtgcatcactacgcaaggccttcaagccggcgcaaggtcgccacgccaacctgcgttgaaggaccgtgcgacgctgcaggcgcagatcctcaaggttgaagcactgatcgccgaacaataagcctggctacggcgggaaccattggggttctgcgtctctctgattgcaggatgccaaagcctgactaggctctgacatgactcataccaatcagagcgaaacgccatgggtatcatcggaaccatctttatcggcttgatcgtcggcctgctggcgcgcttcctcaagcctggcgacgacagcatgggcaaatctacc

SEQ ID NO: 515239 - DNA, 136 bp, Homo sapiens
gaatttgtgtaaccctgttgtattgttgggaaagtatttttatttaaattttattttcttatccagggtattataaaaattaacttttgtaactgtcgcttgggaataactcaaataaatttcaagaagcctttca

SEQ ID NO: 515240 - DNA, 675 bp, Homo sapiens
  misc_feature (132)..(132): n is a, c, g, or t
  misc_feature (550)..(550): n is a, c, g, or t
  misc_feature (566)..(567): n is a, c, g, or t
  misc_feature (581)..(581): n is a, c, g, or t
  misc_feature (592)..(592): n is a, c, g, or t
  misc_feature (594)..(594): n is a, c, g, or t
ggcaggcttggtgcgccctctcgcgccgacgctctgcgggttcctcccttcttccgagcctctcctctggccgccgcgcgggagagaggccgagatggcagatgagattgccaaggctcaggtcgctcggcntgtgtggcgacacgatcttggggaagatcatccgcaaggaaataccagccaaaatcattttggaggatgaccgggtgccttgtttcccatgacatttcccctcaagcaccaaacacatttttctgtgtgataccccaagaaaatatatatcccagattttctgtggcagaagatgatgatgacagtcttctgggacactttaatgatgtgtgggcaagaaatgtgctgctgatctgggcctgaataagggtatcgaactggtggtcgacctgagggtccacatggtggacagtctgtctatcacgtcatctccatgttcttggaggtcggcaaatgcttgggcctcctgttaagcgcacgttgggggataatttctcttcttgaggcatgatacgtaggcaattcccagtattgttangtaacacacttatttnngcctgtgtatggcngagattccagnanataattttaaaacccggtatacttaataaacgacctttgtcgcctgccaaacaaacaacaactcacaacgtcaaccaaaca

SEQ ID NO: 515241 - DNA, 102 bp, Homo sapiens
tcccatcatattgactatggtatgtactgactgtgtatcaatattcataccattgtaaaggtgaacaatcataagtacagaccactgtaagtaagggactgt

SEQ ID NO: 515242 - DNA, 436 bp, Homo sapiens
aacacaagatctcctgggtgtccgagtgcgccctgatgctggcgcagggcacggtgggcgcctacctgaataaatatattccagctaagtggacgtggatggttttctgcataaactcttattgttccttgactgatgtcataacactggagatgcatgctccttagatgaatatctaggatcctggaattcacaagtgaatgcattttgtgtgccatttccctagaactgtaaatgactcaccccaaggagctgctgtctagatgagaaacaaaacctcacactattgctgctgctgcttcatcatggggaaatgacttctgggcttaggttattaagtctctttctaccactttactacaggaagacatgtccttggcacatcagacagaacactgaagttatcttgcaaattactttaatggaattaaaaaaa

SEQ ID NO: 515243 - DNA, 220 bp, Homo sapiens
gcccttccataaaaggctgaggaaagccaagtgagaagattccattaatttgggcagagttatttaacatctgaacctgtttttctgttcattgttcattacttaccttgtccaaaaaggtcataaagggtagggctttttatgttccacctttgccctatatttctccccaacaaatatttgcccctgaggacctcaataaaggtttggtcaagtgaaa

SEQ ID NO: 515244 - DNA, 236 bp, Homo sapiens
gaatctacagtccaggactctttcaattacccgtattgtccggtcaaaaagatgagaaattcctctgaatgaaggatctgctgtttctctcttcctctgtctactctcttggagaggcttccttcatcttcctgtcttatgtcttgattatccagttctgaggtcctggcacagctttatattccatcatttcctcatcttcctcatcctcttcagactgatgcgtggccagaagg

SEQ ID NO: 515245 - DNA, 405 bp, Homo sapiens
ttggactcacagaatggttatgatagcactcagcattacggaagtaatgttccaaatgcacaatggatgaaccaacaggcatatgcatatcctgctactgagctgcacctatgattggtatccaatgccaacaggatattcccaataagactttagaagatatgtaaatgtctgttttcataattgctctttatattggtgtatctgaaagatagtattaagaaacatggaattgcagaaatgactgcaggagcagaatatggtgcactttcgtattaagttggaattctctacattctgaacaattttaggtttttgactaaaaatgaggcaggtttcacaaagtaatgtacagtgattgaaatcataatgaagcaagatggctccataaaaatattgaagatg

SEQ ID NO: 515246 - DNA, 618 bp, Homo sapiens
acataacaaaaatatataaaaaattactcaaatgacaaagacccaaacgtaagcgctaaaactataaaatcttaggggaaaaatttcatgactttcgattggtaatatttgcagatgaggcacagattttaaaaaaagaagataaattggacttcatcaaaatgaaaacctctgtgcatcaaaagacactatcaacagagtataaagacaaccacagagagaaaatatatctgtaagtcaaatatctgacaaggaattaatatctagagtgtataaaggactcctaaaactcaacaacacagacaaaaacctaattttattttatttttagagactgggccactctgtctcacaaaaagaaaaaaaaaaaaaagatattggtccacggattattcatagccccattatattcacaaaagcaaaatggtggaaccaccccaatggcccatcaaaagataaatggataaacaaaatgtgttatatattgtataatgaaatattaactcagccttaaaaaggaataaaatcctgatacatactaccaagatggatgattcctgaagattttatgctaagtaaaataggccatacacaaaggatcaatttttatttgatccc

SEQ ID NO: 515247 - DNA, 945 bp, Homo sapiens
  misc_feature (376)..(376): n is a, c, g, or t
  misc_feature (382)..(382): n is a, c, g, or t
  misc_feature (385)..(385): n is a, c, g, or t
  misc_feature (916)..(916): n is a, c, g, or t
tcctggtaatcccagcgctttctccattgctgtgggctctgcgtatctgttgaaggtcattgactttcgaactaaagtccatggaataactagacgtatgaactccgatactgtcactagaaaatcacatgtaaaaacctatgaacggtgggtttgagagtgctggcgtgtcgtagttagatcgctcgaggtttacttctgtgtagggattagcaggttctcgtacgaacaagttgatgatgattacctcaagagcacgtgtcgtgcaggcattgacagttgaagactcaaaggataagagagggaaatagtgccaccctttcagacgacccgtcggcgatagaattcgatgaagccgaagtagccacatctcttntcggancangacaaggacaaacaaaaaaagagcacagcaaaagcgcacagacataaaaaattatcttgtattgtgtgtgggaaggccgaagttccacttctaacggtatcaggatggcaatatttaacggacagacacgaattctcaataataagttagggagagcaccgcagtgcgttctggttctccccagccccaagcacaggcatataagggagacgtttacacgacgttttagttcttcccagaccgagcgaaataagcgcagagttttccagctacttacagatgctccgatccgggcgggcactgctccgcgatagagacgattcgccgctctcagtttgtggtaccgacagccgagaattatgtacgactagccagtgtgcggcctagtaccgttgctgcatcaagttagcagcccaacagcccagttgggaagccttatatactaggagagagcggtcagcgtacagctgggctcactacacatttagacagcccggcgggcgagggttgggtcccccccccttaggcagngaaggccaccattactatttacccaaaat

SEQ ID NO: 515248 - DNA, 791 bp, Homo sapiens
aactaaaataaccccaccctactaaagcccattaaacgcctggcagccggaagcctattcgcaggatagtctcactaaataacaacagtatcccccggactacccagcataacaaagcaagctcacgtaggtaagaacatacacatgaactgcaaacaccgtcgacaagtcatggacaagcacacaggacagctagtacagtgagacaaaaatgaagacacgaaactctaccatcagagcatacacatcacccccaaaacaaaatcccggaacacaagccacaaaacgcagcccaaagcgaaccacaacaaaacaaacaaaacaaacaaacgaagcaaagcaaaacaacacaaccaagggacacaaacaacaaccgacagcacgacacaaccagaacagcaacagccgaaacaacacacggcaaaccacacaccacgactaccgaagagcccaaagaaaaagaacacaacaaacaacaaaaaaccagcgacacagacagacaacagaaacaagaaaacagacaaaaatccagaaaaaacaaaaacacaaaccagcaacacccaaacggaaaccaaggaaaatcaacggaagagacaagagagcagataaaaaaaatataatgaactagaagaaaaaagaaactaactattacaaaaaaaaaagaaaaacacattaaagatagaatacaaattaaaaacaaacaaaaaggaaaagtaagtgaaagaaacaaaaaacaaaaataaaaagaaaaataaagcaagaaaaatatgaaaatcggaaagaatatagag

SEQ ID NO: 515249 - DNA, 412 bp, Homo sapiens
gcgtggtgtgtcatgcagagtatctgtcaggtctgcttgatccagagcgtgaatttaggtcctgagtatcttagttaattgtctgtctctatgattagtctaatatggtcagtggggtgtgaaagtctcccactattatgatgtgtgagtctaagtctctttgtaggtctttaagaacttgctttatgaatctaggtgctcctgtattggttggatatgtacttaggatagttagctcttctcgtagaactgaaccttttaccattacgtgagtgtcgtgggtcttgtttagatcttggtagtttgcaagtctgtttggtcagaaactaggatggcgactcctgcttttttctgttttccatggcttggtaagttttccaccatccctttattttgagcctatgtgtgtctt

SEQ ID NO: 515250 - DNA, 433 bp, Homo sapiens
tttagtgatgaaagtgatggcccctaagatatagagagaactgctaaggtgtacagagaagatggttaggtctacggaggctccaggatgggagtagttaccctgctaagggagggtagactagttcaaactgttcctgctccggcctccactatagcagatgcgagcaggagtaggagcgcgggaggtaagagtcagcaagcttatgttgtttcatgcggggacaagccatatcgggggcaccgcattcattcaggggcaactcagtcagttgccaacagcctccgattcatgcatgggtcattcactatgcaagaagcattcttcacaaatgcatgggctgtgcacgcatacacgttgtcagatgtggtcgttcaccctgcacagcattgcttggtggggggcatcctctcacagtcgcactgccaggcat

SEQ ID NO: 515251 - DNA, 887 bp, Homo sapiens
  misc_feature (1)..(1): n is a, c, g, or t
ntggctccgctcgggagtaccccagagttctcttgcgcggggggttttcacacagcccctgcccctgtgggggtgatgccgctcccctctctggaatgtgtgcaagcgcgtgtccccccctctgctgcggtgcttagttggagctcctccaccgtccgcctctcttgttttggcctgccggccgaagtcttcgcacctctcgtctgcgtggccgcgaccttgattaccgtctcgcgaggttgtgcccgcaccgtctcctctctgccatcgtgcgtgtgtggtcgcacccccgctcgtctcttgttacgtgctaggccggcgcccgctctctctccgcgttgtgtatgttgtctgtccgccccctaagaaacatcgaagtttgcgctgccgccccctctcctcgaaatgtactgctttcctcacgatctgctcgtctctgtttggctaccacgaggagctccactacgagcaagctattcttttattactcccattgccctgccaacatcaattggcggagcggaaaaacaaacactctccttcatcttccgctgtcaagacctactcctgctattaataattcgctccccgccgattataaataccagtcaatgagtgggaggttcttgtcaaggtgcccgcccgcaccgagccctgcggccatctgcgcaggacacccgccacccccccaccccggaccgtagggagagcccccccccctgctgtggggagcccccccttccaactggcgggagacaacaaccagccggcggggacacacaccagcgttgtctgacgaccctctcgctcgcagaaacacatgatagtggagcagccacgccccccggtgaaaacaacagataaaggacaaccccacaaacaaaaca

SEQ ID NO: 515252 - DNA, 102 bp, Homo sapiens
tcctcccccccccccttttttccctgcccagccctgtgttggggccccccaattggaatgttggcccaatttttccaataaacccttgtggtttgcggccca

SEQ ID NO: 515253 - DNA, 200 bp, Homo sapiens
gctagctaggcggctggggagcgttttccgtggcggggaaccgaaggtttgaatttccccttccctgggctcatagggaaggaggaatgtaaaggaagctgttaaaggcagaggaggattattgattattaaatccaagttttgaaaaaaattggatgaggcccctcaagagccctacgcgttgggaggggggctttaaa

SEQ ID NO: 515254 - DNA, 113 bp, Homo sapiens
  misc_feature (36)..(36): n is a, c, g, or t
gaagacatggcgccctaacacttcgagacctgctgntaaattaaaagctatttttcattaaaccaccatttcctccacctattggagtcaaatatgaaagctgtcgatgaagc

SEQ ID NO: 515255 - DNA, 1707 bp, Homo sapiens
  misc_feature (596)..(596): n is a, c, g, or t
  misc_feature (647)..(647): n is a, c, g, or t
  misc_feature (1707)..(1707): n is a, c, g, or t
agcgggccggcgcctgcgccgcgagatccgccccggcctccccgagagcgagccccgggccgccgcgaccaccaggccgcgctagccgccggaccaagccgccaccggaggcgcctgtagctgagacgcagcacgtgacggcaggagtgcatgcagtgaggcgggtcgaggccaccatccgaccaccaccgacgcagcccgtccccgcagggcatcctgacaggaaggcgggccagcacagccgcgttctccaatgggacctccgcagcttgaaacgaagcccgtggggagagccagagtcgtgattgcagcgcgcctatgagcctgcgcgggcgctctagagtgtcgcacagtcagcctcgacaggtacagccaagcgtaaagcacacgcgactgagagcgacacgacagagcactgcactgtgctgggccaatgaggtgcattcagacggaggctgttccgctctttcactctaatgctccagcggccctgtcacttagtcgggaggttatgcaatgcccgtggagtggaccgccaaggtactgtcagactaacctcgagaagagaggtccccagtcggagagcaactcgagtncctgaggacttgaccttgtcacaaccctgttttacttgggagtactagggnttttcctagtgcgcctttgaggtgactaccgactactgtttattgatagcattcgccacctgacctggcaccgccatgaacttgtctcctgggactttgtgccgaggaactgtgcgcccccatttggaacacccatgtcacttgctctcccttggaacaaacgtaccttaattgccggctccgcggcgagactgcggagaaacaacggtagagacggtacatatacataggattggagacagatttggcgtatttcgccccacaatgtaagccccgaggagggtaggaaccacgggagttagccacctattggccccagagaccaaatcgggtgccccctaggcgttcacttccccaatagggcgttgcttcgccatttggcggtggtccccgagagacaagatgaaccgtcccttttagtgtacaagcccacacgtggggccccgtgtattactttccgttaaaacagccaggcaacacggcggatttgtctcccagtgctgtaggaacagctccacacatacactctacgcagtggagtcccatccgtagatgtgactattcccgttttagtaaaggacacgaagaaccaccagctactatcaaagggaccaagcgcgcactaacatgactaattaacgacacatttgggcggccaaccccacagtgcgacgtcgagacacgaaaattatttgcggtacccgccacgattcataacacacacttcgagccaacctaccataacatactagttccacaccacaaaccaaaaaccgaaaccctacagcaagacacacctagaccaccacatagagctaatcaatatacatatcattacgtcgaacaacacccacacagcaatcacaagtagacacaccatctcacgtacattaatactacacattcactttctctattagccacatattctaatcgcacaatcaacgagtcctcacaattaacaacaacgtaccgcaagaacatagcgctaacaaaaaacacaaccatacaaactaactcatcacactcactctacgtacgctacaacgatacactccan

SEQ ID NO: 515256 - DNA, 465 bp, Homo sapiens
tgtggctgtagtgtgttttcggtgtgtgtggatatcaggtgtgtgtgtgtgcatggtgcatgtgtgtgtaggtgtgcagcgtgtgtcaatgcggttgtgttgtgtgcgtggatgtgcagtgtgtgtgtatgccctgacttggcagcagacggggcagtggcatctcttgcagtggggcataggccacagttgcccccataggccttcagcctctccgtctcatctgtctccaagcatgattacaaacccacaggtgtccagcagcttctgctcccattgtctgagggacatggccagatctcgagggctcagcaggagaatgtctgaggtccaaggtgtgcagacggaccaggtggaggcacagcatttctccagccaatctcgggccactcagttcccggctggacacgcacagtgcccctcaggccagtgtcccagccaggcctgcccccccttctcctgagg

SEQ ID NO: 515257 - DNA, 133 bp, Homo sapiens
  misc_feature (80)..(80): n is a, c, g, or t
  misc_feature (107)..(107): n is a, c, g, or t
ggtgctgcagccatgtctctagtgtatccctgaaaaggttccagcatattttgcgagtactcaacaccatcatcgatcgngcggcggaatatagccttttttcatgngctggcattaacgggctgtctgggcc

SEQ ID NO: 515258 - DNA, 181 bp, Homo sapiens
atataagataactgtataaaccggcgtacatgtatcctactaattaatctacatattgatgttatatctatagttcaggtcttctgtgtatatcttcttaagagtataaatgcgtatgatgtatatatgtatatatattaatattcttccatctatattcacttaagtgggtagtcacaga

SEQ ID NO: 515259 - DNA, 142 bp, Homo sapiens
tgtaaggagacagcgctcatcgagtccattgagggcacaggcaagccccgcctgaagccccccttccccgcagacgtggggatcagtggggtagacgagcggtccatgacgatcaccgcagctgtgcccaggcctgtctgtg

SEQ ID NO: 515260 - DNA, 384 bp, Homo sapiens
  misc_feature (225)..(225): n is a, c, g, or t
  misc_feature (240)..(240): n is a, c, g, or t
  misc_feature (259)..(259): n is a, c, g, or t
ctgtctatttctccttcggccgcgccggccaactgttgcacacatgctggtgtcggtgccgcgctatttacccccaagtcgttcccgcagcctatggaccaggccgccttgggtatatctgctcaaggtaaccacacccctctttaaaaattccgccgaaaatgagaagacgctttacccgactctttgggccgttatctcacggcgaactttctgaccaagtanacaactacccagagngcctaggagaagtgctgtntagagagcagttcgacttcatcgctgagccaccttgggaacctacctgatgataggggggttccatctcccaacttgtccatctctccccgttctacttccagggagggcttcacttcaaaaatc

SEQ ID NO: 515261 - DNA, 473 bp, Homo sapiens
acatacaaccagagtacaaccgacatacagagctgaccctgccaccgcgtatgtatcatctctcatggaaccataaaaacgaatgattcagtcttgatctaagtacgacttttaagcacacaagaaataatttaatcatgaagtatcagcttgattatgaatatattctataatctgtatcagttggtaaattaactgtgttacccaaaaaggctgaccagctctaactagtatgaacaggatattgaattcattaatgaatatataactattttgagcatacaaacaatctctggttttacacccactacatttcagaatcctgtaaactgtgaggcatacaatatgtttaatgtggcagaaaatcatatgacatgattattttattctgttcagtccttttcccattaagcatgcaaacaccgtcataaccatctttggtttcacttctacgaggtcatcaggtaatgcat

SEQ ID NO: 515262 - DNA, 117 bp, Homo sapiens
aaccccccccactgcccccccccctcttttttttaagaatggcctggtcatgggtttttcagcccccttgttggccattttatttttttacttccctttttttttttaagaaaggga

SEQ ID NO: 515263 - DNA, 280 bp, Homo sapiens
tgttttaccttctaccaggaagatgtgcatctccttctgccgggccaggatggtgttcttcatttccatgctttacttatggaattgctgagctgtttcaccttttgctactagttatactcgttcttgttttaactctagaactccatttaagtaacatctagtaaactacttactatacttaagctgctttgtaaggcaataataggaataaacaatatgctaaaagtaaccaggccataggaaattagcttactacctatcttcagcaaacttaggt

SEQ ID NO: 515264 - DNA, 566 bp, Homo sapiens
  misc_feature (1)..(1): n is a, c, g, or t
naatgattgtaatgacctttgtgtttaagtgtgattgtgttgtcagtgctttttgaatttatgtgtaatgtgacaggtttgtgtgatatggcaaataatattttgtgcagattttatttggtacatcagagggtgtggtaaaatctacctttaaatttaaaggaattttgtgtacacaaatgccacaaaacataagataagggacttattcagatttaatttaaaacaggagtaaaaagctgacattgtgtcctaaatgctaagtaggaaacttgtgacttgcggtgtttatgtgttgtttattacaaaagcactttatgtttttaatctcttaacctagctcttacttggttttaacttgatggtgaacgaggttatcatcagaactgttacactaaaggatacaagtgaaagataatgttttcaaatgtattaacattgaatgggagttaccagacagcttagtctgtttttgtatgtaggactaaagcggtgccacacaccacctgtaaatactgtaaattatttattgaagaaaaaaaataaagtgtcatgttgaattgtta

SEQ ID NO: 515265 - DNA, 129 bp, Homo sapiens
ccacgggcttacatctcattactattctgcctagcaaactcaaactacgaacgcactcacagtgggttcgatcaataccgggctgacctagctcgatttcgtactcattgttgtacctgtctgctgtgt

SEQ ID NO: 515266 - DNA, 836 bp, Homo sapiens
ggctggtgatgatcccttcaatgggtcaggctgaactcatggaggcagccgtacgtcatgaatgcttgtgatcggccgtacgtctctctactcttaactgtcagtgactgtcacccgtatgtggtcaagaatgcgacatggaacaatgcgatcattggaaggctcccatgaagagtcccgcgaaaataatttgtgtaacgggttggtggacactcaagaagagacggtacaacacgtagtactattccaaccttttggaacccgagattgagcaggtgaaaatcggagtcggagtaaatttgaagggctaacgctaggggtaagactcatctttaacgtagatcagtgtgctaagaaccataggggagcgacttagttgttgaccgcaaagcggactagaaaggttctgggcaactaagtgggattgtggcagaagccatggatggcgccccccattggttaagtgtcacggcacgatgtgacccgctccacaaaagggtacactcgggtcagggacattcgaagcgtaaacttctattgacacaacgtcgttggtgggttacaattacctaagaaggtttgtttcccccattaggagggggagggtttcgagatacatttaagatatgccaacaccaaggttagaggatcgctatacaggggtggttagcacccgattggtagaggtatctagtgggggcactatgattgcgggataaggtaaaagttaggagaagcgaagccaattttttagagataacagcctttgagtgaggaacgaggacagagattggcagcagaaagagtcacagacaagacattgaacaggcacgggg

SEQ ID NO: 515267 - DNA, 228 bp, Homo sapiens
  misc_feature (68)..(68): n is a, c, g, or t
ctagaggatccccatgcgcgacgcttccatcaaagaacatcttcatgaagattatctcatccatcagngcatcaaccttggcctccagctccaccttgttcatgtaggcagcatctacatccttcttcagcatcacaaactcattctcagcagtggtacgctgttgatttcatcctcatacttgttcttgaagtcttccaccaggtcctgcatgttcctcagctctga

SEQ ID NO: 515268 - DNA, 126 bp, Homo sapiens
cgcaagttacgcctgaacaaccgcctgcgcggcctgatcgacaacgccctggccagccaccagttgctcagcgacaacagcgacacccacctgaacaccacccagcaggccctggaaatccaggcc

SEQ ID NO: 515269 - DNA, 461 bp, Homo sapiens
  misc_feature (37)..(37): n is a, c, g, or t
  misc_feature (80)..(80): n is a, c, g, or t
  misc_feature (93)..(93): n is a, c, g, or t
atagaccaccgataagattagtttctttttagaaaanagcgtgaccttcttataactcagagcagctttggtttctgganaataccatctcanattctgcagagtcatcagataaggcagttggttaaacaaacaaacaaattgggcgtgagcaataattatacaagggcggtgtagtaacagccaatgagatccttttatgaagtcattattcagtatggccaaacgccatgttgggtcagcaaatgttagtccaaatgttgctgttttgttcttaaattactgccgtgtaataaagtgggacacaatattgagtttttcagaagactaatttttaaaaaatgtgattactttctattaatgggatttaaaggcttttcttttatgaaatgattgtaagggtagtaactaatgcatcagtgaacaacaaaaagactagttctagatcgcgagcggccgct

SEQ ID NO: 515270 - DNA, 211 bp, Homo sapiens
caaaaatttatccactgcctgtaatatcaatcattgagagctgggtaaacgtccagaaaggctttagcaaatgcattatcaaagatgctataatgttgatttcattaccactgatttatattgacatgactttccccgagtaacttacgaaggagaaaaaaaccaacaacaaaatctacataagacatgtgcattgtcttgctaagaatta

SEQ ID NO: 515271 - DNA, 950 bp, Homo sapiens
gtgtctgaccgccttccctctgggtgaaaaggcgcgacccggtgtgggggtctaggtaattgagctgggcgggaccgccagcccaacatcgttaccttcggtaagagagaggcactggcactcagaaaatgtggtgaagcaggaaagtccaatagggtctggggaatcgcccagattgcgtacaggtgcttaggtcgatattggccttgcgtacgttggcacggaggaggctgttcacttaattacctttcgatgtgtctgcatcgcagactccttcagcaggccttccaagcccagtttggacaagtcagactataacatggtggatatatctagaatgagcataagggagaagcatgctgggaagctctatacccggaatctgtccagggattaataggggtcatcaggagaatgtacacccgcatgtgaagctggtacaacccagagtagaattaattcagtctgtcatggaccacattgctggagatgaggatcacacagagtggagccattcagccttgtcgctgcgtcggtactgaatagggcgactggatgtacagcattcgggaagcgactggtactgaaattagtagatagtctagcgccaaatgatccatgtattgttaatccgaaggtcggagatcgaagactgacaaagcaaagacccgtgctacatgggctacacaagtaactgaggaaactgaagaaccaagcttgatctgttaccattgggatgataacctgaggacccccactggaaatctcccatcttactgaaaaacctggaagtgaggagtgtgcacggatgctgaatgtttgggaatgagaggatgagtgagtgaggctatggtaacacaccacacttggaaatcctaccacagcagcagccgcagggccgccaacagcagcgctgttagtgagctaagtaataactcactgcgtagatc

SEQ ID NO: 515272 - DNA, 242 bp, Homo sapiens
aggcagcagtgcagtggtatggtcgcagtttactgccacctccagctcctgggctcaagtgatcctcccgcctcggtctcccaagcagttaggactataggcacataagaccacgcccagccaatttttaaattttttgtagagatgaggtctcactatgttgcccaggctagtctcgaactcctggcttcaagggatcctcctgtctcagcctcccattatgctaggattacaggtcgacg

SEQ ID NO: 515273 - DNA, 862 bp, Homo sapiens
  misc_feature (376)..(376): n is a, c, g, or t
atggactgtgtcccaccggcgccactacccaggctccctgatgtcagttgaaccctggctatggctgcagctgagatcacaaagaagctcttctgtccattaaacgaatcgggtggtccgtgactggggggctgtggaatacatggccatatctatctcactgactagattgatgggtgagccacccaacagatgggctaccaagttcgcgtctactatatgagccgggacgctgcacgagcaaatgaggtcgcataggaccatcacgacaaaggagcttcctacatattgaccttcaggcttcggtgacagcataccaatagagagggtgtccccatgcgtacagggctgagcacctgggcgagttcaacctggngctccaccatcgtgctcatcttcgagggccccaaggacttgaatttccagtctgagaagcagcgacagaaaaataccggctttggggaagccctgggctcgctctagaggtctctttcctgattatggctgctaagggatcttttccaaacagagtgacgggtcttttcaagagggaggcccatgaggccatccaggtaagggcctgctcagcgtgttgggagtctgaccagggtaggacttgaatgattcgggtaccacgctgttccagaggtgcagcaccagaagtggggagagccccatcatggccctcaaactattccgttccttatgcgctaaccaataacaaagtgccgggtggcaatgatctcacggtccacatttggatcctttttaaccactggtttagacggacacaagcctgattcttgacggaactttcagtggctctcggggcggatactgggggtctctccccccataaact

SEQ ID NO: 515274 - DNA, 338 bp, Homo sapiens
ctcaggaggccatcgcaggcactctgagttattgcctctcacacaaggagggtgccgcctatcataatgttctgtggagactaaatgaaatgacatagataaaagggctaagacacatagtgggggctttccataactgccagcttcactgccactcaacgactccacgctgtcacacgtcacctctacactgcagctggctcccatctcttctctttggctccgccctctccctgagctctggtaccctgtctcccactgtcaactgtacatctcccgccggcatctctaattggacacatgcaaactgaaattaccatctcgccaaaaaaccagtg

SEQ ID NO: 515275 - DNA, 318 bp, Homo sapiens
ctgttatacaggactgctataaaacaatgagttacgacatacctatggaatggctaaaatctaaaaaaactgacaataccaaatgttgtgagcatgcagagtaacaggaactctaattcattgctggtgagcatacaaatgatacagccacttcagaagacagtttggcagtttttcacaaagctaaaacctaacttaaccatatgatccagcaatcacacttccaggtatttatccaattgacttgaaagcacgtcctcatggccgggcacgatggctcacatctgtaatcccagcaatttgggaagacaaggcggg

SEQ ID NO: 515276 - DNA, 135 bp, Homo sapiens
ggttaaacaacgccacttatccacctaaccactatcactaaaaaaactcaacctctatatacaaaactccctacaaaactccataattataacattcacaaacacaaaactaaacataatttatacattttttaa

SEQ ID NO: 515277 - DNA, 882 bp, Homo sapiens
ccgtctcgtaagttccgtggaatatctggtcgcattctggcctgcacccggaccgtgatgccattcgctccccgtttaccccgactggccgaaacatttggctccagtccggaaacgattcacgtgcgattagagaaaatggaacagcggggatctgttaccgggcgcgtatttgatgtcagcccgaacagctcgttatggacgtagcctgcttagtcggcattatattaaagagcctcaagactacccttccgcgctggcaagctggaaagccttgatgaagtcactgaagcctattacacaaccgccactacagcatctttataaaagtgatgtccgttcgatcgacgctctccagcatgtacttatcacaagatccaaacaattgatgaaattcagtccaccgagacattgatcgtcctgcaaacccgatcatgcgtaccatcaagccctgatcggcttttttaatcccatacttttccacaggtagatcccaacgcgttcacagcgtacatacgccactcgttaataaaggtggcggtttatggcagatatcactcttatcagcggcagcaccctcggcggtgccgaatatgtagcagaacacctggctgaaaagctggaagagcgggttttaccaccgaaacgctgcacggtccgctgttagaagatttacctgcctcagggatctggctggttatcagctccacccacggtgccggagatattccggacacctttctcctttctatgaagcattgcaggaacagacgcccgatctgtctcagtccgctttggcgcaatcggtattgcagtcgtgaatatgacaccttttgtgggctatcgataactcagcattactcgggcggagaaggaagcccc

SEQ ID NO: 515278 - DNA, 81 bp, Homo sapiens
ggatttgctggtgcagtacaactaggcttaatagggagctcgaattcgagggcctacttcacaaagcgccttcccccaaaa

SEQ ID NO: 515279 - DNA, 650 bp, Homo sapiens
ggtagccgttgtgttgggaaagtgagggatttttggcctacgtttctcctgcttacttatactcctccctatataactttgccggtagcaacacagttatgggtctgcaagcaagaagaagcagctgaagcctgtggtgctggtatttgtcatagagatttttgattgatgagaagatccttattcagcaccaaaaagcaaagcattttaaatgccatatatgtcacaagacaattgtatacaggactgccaccagtaccatgtgagcaccatgtgaatgcctccaggcatacctccattaattgccagtgtgttcctcctctgatgccaggaatgccaccagtatatgccatggcatgccccctggatttgcatcatcagagaaaaatacacccagtcattatgcggtgaaacatcatgatgccaattgggtggacatgatgccaccttggaccaggaatatcacctctgatgcctggaatagccaacagtgtattgtcccactaccatgtaccaaagtcctggaattcctcctatgactacaagcacaggatgttcaagcgccaggtatctatatagccaactgcacaaaaagcactgactgcccaagcatccagttataagctcatatccctagtgatgaagatgtg

SEQ ID NO: 515280 - DNA, 523 bp, Homo sapiens
  misc_feature (2)..(2): n is a, c, g, or t
  misc_feature (151)..(151): n is a, c, g, or t
  misc_feature (155)..(155): n is a, c, g, or t
  misc_feature (198)..(198): n is a, c, g, or t
  misc_feature (214)..(214): n is a, c, g, or t
  misc_feature (228)..(228): n is a, c, g, or t
  misc_feature (259)..(259): n is a, c, g, or t
  misc_feature (280)..(280): n is a, c, g, or t
  misc_feature (322)..(322): n is a, c, g, or t
  misc_feature (382)..(382): n is a, c, g, or t
  misc_feature (438)..(438): n is a, c, g, or t
  misc_feature (450)..(450): n is a, c, g, or t
  misc_feature (455)..(455): n is a, c, g, or t
  misc_feature (469)..(469): n is a, c, g, or t
tntccttcggcagcaatatatcatcctcaaaaatatcttgtgttgttaatatgacatcctgctgactactggattttgtctcattcttcttgactttctgatctgtaaagaggtcatcctcatctcccaggagaggaaagggatttgtttncttngctggtttgggtttagcagactgaaagagatcatcatcactgntggcctcgcctagagnaggaaacatggggntctttgctttaccacccactggtgggttggnaggattctctgctatcttggncttgggtttggttctctccacggactgagatccagtgcccgnggaaaaaatgtccccagaatcaaaaaggtcagcctcccctctggaatgaccagagacttnggaaaaggggcttgtgtccactccaggaacagaacacccccccaaggagcagcggnagctgccagggnctccncaggctgtcttctncactgggtgatctgacttgcggccgatggccattggggaatgggcacaaccact

SEQ ID NO: 515281 - DNA, 206 bp, Homo sapiens
agaaagcccctcggtccctctacggaagtagcgacacgcctaccgctcgagggaagagtaactagtaatcatgccagagtctcgtacgtaatacggaattaatcagacgaatcgctccaccaactagcaacggacatgcagcagcacccactgaatccaaaaagagctatcagggctgtcaaattgtgtacccggctcgcgggacg

SEQ ID NO: 515282 - DNA, 1430 bp, Homo sapiens
  misc_feature (120)..(120): n is a, c, g, or t
  misc_feature (312)..(312): n is a, c, g, or t
  misc_feature (397)..(397): n is a, c, g, or t
  misc_feature (419)..(419): n is a, c, g, or t
  misc_feature (438)..(438): n is a, c, g, or t
  misc_feature (488)..(488): n is a, c, g, or t
  misc_feature (589)..(589): n is a, c, g, or t
ggtcctgatcaagcgctagtactgaatctgttgatgctgtgcatgtgcgctctactgcgtttgtgctagcagtagagatcacgagaatactaatcgattggatgtcgacggtatatcgcntgctctatttgacaggctgaaaagtgactcctgacgagtatttcacagatgcatcggagggctactgttagccgactcggtgatgtgtatctgcctattgtctctgtgcggttctccaccaccgtggctgtgcatactaacgagagagcaaggagagataagtcatcatggacatagtccgcgtgcctgggnccaggggaaagaatggcttgcatggacctaagggtgagtgttgcctagcctaggagaagacattctcgttcgctgtccgcaggcnacgggggtgtgaagcgactcgnttctacctaagcttagagnagagcgatactctatgctagatgtcatcagagtcgtgatcgcgaggcctntttgctatctatctggagccgattgtgttactgccgcgattctgacgtctagtgttttgctcatctctaagtctctgggcacacttgcatgtggcagtaanacacactagagagtgtgtgtccctttgaagctagttattttattacccgggtgacacatggacacacgtatttagagctaacagtcctaatgttcgagtcatgggagtagaaccgaaggaattgtcacctagtatcgggcgatacactcacaggcggaggaaaacgtccgtgggccttgatcgccttagtggcggccttttggtggcttataagtgcttggggtgggtaaggcctaatttcaagggaaccgaaatgtaacccaatggaccggaattaccgaatagaaggattccctggtcggtcaacttgtttgggtgcggcagatttgttcccctggggttccctaaaagtctgggtgtgcctcccggaatacggacaaagggttcagtaaaaagggcaaaaaggggcttaatatgagaactgtggtgctacttactatcttgtggtcgtaatttgtcccccccttggtgtactccttccttgttacactcataggaatttatttgggaagttatttaccagggggtctttccctccgcggaatagacatcaccaatatcaacgaggggggggcaacaaaaaatgtcgggtgggcgagaagaccccgcggcatcattaaaccgccggcgaaggcactacgccacagttgtctcgaacgcgacgatacggggccgatcggcgacccaaccgcggccgtataaacgcagaaaatcacgagcagggagcgcgcagcgacaatacgacccaccacactagcgagaagagagcatcaccaaacgagacacgaatcagcaacagaacaccatgccactaatagtgacgccccataccacagacaca

SEQ ID NO: 515283 - DNA, 742 bp, Homo sapiens
tctctctctctctctctctctctctctctctatctctctctgtctctgtatgactgagtctgtaaccgtgctcagctacaggcgccacattctgacacacacaaaggcagtaagagcgacagaaatcgcaatcgagagcgatacctcagctactggcagaggtaccacaaaggaaacgaccaatcagacagcaacacacatgacgtcataatgaatagctcaaaaaacagctcataatagatgcctgtataaagaactatatccccaacatagagcaggcactatcgaggaaataaagcccattcgagaccacagacagactcagagaaaactagcaggtggacccggaacccaatcagactatatgaaagcgcttacaattgatctgccccaatttacaaagaaggcctggcgaaacccctgagctcccaacttaaacgtccagctgcacataactgttttaccaagcaggcacataggcacaatgaccctacccaacagcctgacagacagactcagcaacagaacggccaatggcacaacatcagctataaatcctgctaaaaatatgtccaactcccccgttaacaaccctaagattcaaccaactgtgcctccctgagcgaaatccatcattgaactaaaagaatgttcccaccatatggccagactcggctgtcacatgattcgtaccaagaaacccctcattacagaaccgaagactcgcaatgtcacaggcgct

SEQ ID NO: 515284 - DNA, 143 bp, Homo sapiens
tgcaagaagggttccttcctggacgacttcacagcatccctctccctctaggcacagggcgtcaggtcacaaattagcagagactggcagcaggttcaggctcctttaagtgacctgggccccaagttccctctctgcagttc

SEQ ID NO: 515285 - DNA, 1059 bp, Homo sapiens
  misc_feature (500)..(500): n is a, c, g, or t
ggccgcgttcccccatgctctgggtacccggtgcttgatcgcgatcgccatgatgggccatcgtccagtgctcgtgctcatacagaacacaaagcgtgactttctggaagaaaagttcagaatctgggacacacagtcaactggctgcgcacaggatctattgcacgactactcatccgcaacagtgctttcgggaccctaatgcttctatgtactgacaggactgtgcattaggcagccctaacatggctacggcattgtgactgaacacatatgaatggacgaaaaagtcccataccgttcgcacgatgcatatccagagctcccatcaatccctaggcggcccataagctcccattgcattccggataattatccacgtcgctgcgcactcgctacgtgtaatcgtaaccgtatgggtatgcggacggaattgggagtagcgaccattcagatagattcattcttcgcagggagtataacttgttaagtcctaagtncatgctatggaaacgaccatgtacgcgtggaagccaagtcgaagtcgacggaatagccacatcgcatagacaaggttgggtttggatacacacgtaggcctttagacgctgggggcacagggccatatttttgcggcatttgccatacgagcgttatatcccaggacgacacacatccagaggaaccataagattatcaataggtaacatcgccccggaggtaaggggagggaagtctaaggataatgagcaaaaagttgaggtcacgttgattgcgcttttgaaaaccaatttccagttctaaaacaaaagcagtcgtagttttatactaaagccaaaataaggccccagatgcaaaagtttccgcgggttgggtacctatgcctttctagggacgtatagcgaaaaactttgtaggccccctagatgatgagcgtgggttcccacatggcattggggtcacccgggtatcttggaaagcggcatgacactttgggtccgcggaaataaggaaagatttcgaattattacaagaaattatattgctttggcgaaggag

SEQ ID NO: 515286 - DNA, 472 bp, Homo sapiens
tctagagtgtaaaaataggaccaagtgaggactggtcatgggtatcagtgcctcggagggttaaatcagctctcaacatcacagcacagggcccgtgagtcaccccagggctctggacctgtgtacccaagccgtatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactccactggtgtggaggcagaggggcccttccagggcagggcagccctcggggcagcagcaggggcaagggctctgttttacgcacacgggcacaggcacgcaggtgccggccctgtccgctggctcccaagaggccgatagcccggtagtgaggtcacacac

SEQ ID NO: 515287 - DNA, 876 bp, Homo sapiens
aaagcggcgtcgcgccgggaagttgggatcacgagcagtctaatccaggcctctggctgccgtatttatgaaatgatatttccgggccttccttccttccttccttccttccttccttcctttctttctttctttctttctttctttctttctttctttctgtctttctttctctctttctttctttctttccttccttccttccttccttctttccttcctccctccctccctccctccttccttccttttcctcttgcttcctttctcttcttatgtctctctttctctcttccctctctctccttccttccttccttcttatcagcagggttgtactctgtccaaacaagctggagtgcagatggcatgatcactgtatcattgcggcctccaactcctgagctcaagtgatcctcccgatctcagccttccgagtggctgggactaagggtgcatgcaactacacctggctagcttcaaaaaaaaaaaacgtgttcaccagatgtggttcaatgccatgtgagaaacagggccaggctcctcaccaactgcctggaactcaaagccagtccgtgccatcccgtgacctctgaaagtgctgctcattagcagacccacaggccactgttgcccggcactgagggtatttcttccattcacaccaattcagcagatattttctaccttcctttacaacgcacaagccaatcaaatgtagatcaagtagctcaacaaatcaagttacactcacaaacgtcatctaaggtactttagttaagcacctgtcatgcacgttacaggaatctggttcaatctgactcgtcgtgattctagacgatctagcctcgctatctattcccgttcagtcacagt

SEQ ID NO: 515288 - DNA, 403 bp, Homo sapiens
cgcggggttccctggtcgtatccacctcggcttcttcaaaactagcggtcccaccaccatgccaggaggccattgttagcacattttatatgagctaaaagatatacaccgatggctcagcaacggagccagtggttagcccaagtgcagtccactgacgaagcggccaagccaggttcaccgccagtgtgcttcccccgcacagcacatggccccacgacagtccatcccggaagtctactgccagttcccatgccactgcctctaaactgactacacgggatgctaggattggcttttggaaggtccacgacccccagaggatgcgccttctccatcccctctgtggctacaccaagggaggcagccacactagttgaaatttctaaaaaacactaaaaaa

SEQ ID NO: 515289 - DNA, 459 bp, Homo sapiens
  misc_feature (34)..(34): n is a, c, g, or t
  misc_feature (41)..(41): n is a, c, g, or t
  misc_feature (103)..(103): n is a, c, g, or t
  misc_feature (105)..(105): n is a, c, g, or t
  misc_feature (118)..(118): n is a, c, g, or t
  misc_feature (123)..(123): n is a, c, g, or t
  misc_feature (326)..(326): n is a, c, g, or t
  misc_feature (358)..(358): n is a, c, g, or t
  misc_feature (408)..(408): n is a, c, g, or t
  misc_feature (421)..(421): n is a, c, g, or t
  misc_feature (423)..(423): n is a, c, g, or t
gaattcggcagagcgaaagggcacttggaccctngatgcgncccacaaagttccccgaaatcccggtctccctcaagaggaacaccgaggttttccggcaccncntcctctgagcccnttctnccctcctgatctggacaggagggtcgactcccctgctttgtctggaaggggttcccgaccttccggtcgcacctcaggatgaggccggtctcacgaagacattccagacgtggcctcgtgggtggttccacattccgtagaccccgatttcccggtcccctcttgataagaacccgatgcccggacacctctccgaactccancctgtgaatgaagtcaacacgaaggggcagtnactcgcccgtgcatcgtccggaaaagacccccaggttccaaataccgctngacaagtggcctntntccccggggaacaaccttgaggggtgggcccggtac

SEQ ID NO: 515290 - DNA, 229 bp, Homo sapiens
acatagtaatactatgcatatcatggttgtttctattaggcgagtaaatattctcacttaagcaatatggtaataacaattgtttacttgtatagacatgaatacggcgtagagagcccatgacggaatgactaaatactccaaagtgtttagcattgagaggcttattctcatagataaaatatcattacattcagtataaaaagaccatacaacctcattttgtgat

SEQ ID NO: 515291 - DNA, 190 bp, Homo sapiens
aaaagtgagtatcgatgatctctctcgtcgtgcgacaacttgcccggcgtctctcttgctcacaagcccctctctctcttgctctcgtcgacgtatgctctctcgtctctctctcacaaacactctctctttctttcgtgacagagtctcactctgtcacccaaactggagtgcagtggcacaatctcgg

SEQ ID NO: 515292 - DNA, 101 bp, Homo sapiens
aaatgtggcctcaatgcgacctcccacctcagcctcccgagatagctgggactacatgtgcacgcgccaacgcgcccggccgcttgagtccacattttatg

SEQ ID NO: 515293 - DNA, 966 bp, Homo sapiens
gctcgaatcggaggtctgcagcgctgcttcaggagcatgaggtgctgcaggtgactgcaggtaagctggcaacgggcgaccggctgatacctgaggaaagccggggtccccgggagattgcacgctcccggagctccgtggggttggtctccacccggcgtacagagatcccggagtgtcctagtggtacccacggcagtcggcggcgcgtttgtgcggggccgctttttgggcaatgtcggctttgccaagtgcttcgagactctcgtgatgcaggatcaccaaggattgtgttcgcgagtcaaagattgttgcctaagtcgtctgctgcgtcaaggccgcactcgagaagggaggaatgatgtcgcattggaaagtatccagttcaaccggagccttctgcgcctagcgagccacagtcgataatggaattccacggtccattcattcgaaggaagcatagcgaaccttgcggtggtttcggtaggtagatctgagatgcttcctgatcaggtcgggagggtccttctacgcttgtgagccttgcaccataggcactgactggaagatgcctcttgacctcttgaagaccttgagaggcgcccgaataacctaatccttacgggcaaaagatggtgcttcggtttggccaggttacctttgcacccggatacaccagagagttattccatcggaggaaccttctaagcttggggacaattctttttccctgaaatggactgatcctgaagcgtgaacaactacaggcgaattcaggactcgtggacaaatcaaaaatgttagaacatattgactgtggacaggaggcgaaaaagaagaacccaggttgtaagggacctccatataatgacattaggactcccgaggatgcgtgcagccatcccacgggccccacaataaaggagtggttgtgttggaccatcgcggtgtatcatgttattacct

SEQ ID NO: 515294 - DNA, 437 bp, Homo sapiens
  misc_feature (413)..(413): n is a, c, g, or t
  misc_feature (418)..(418): n is a, c, g, or t
ctcattaggtgattattgaccaaatagttaagattggaaatatttttttttttcaagacaagagtttcactcttattgccgaggctggagtgcaatggcgtgatcctggctcactgcaacctctgcctcccaggttcaaacaattctcctgcctcagcctcttgagtagctgggattacaggcacccaccaccacgcccggctaattttttttttttttttagaagagacagcattttaccatgttggccaggctggtctagaactcctgacctcaagtgatccacccgcctcggcctcccaaagtgctgggattatagggcatgagccaccatgcctgggtcttgggaaattctctgttttttttcacagacaagatctcgctatgttgcccagggtgggtcttaaactccnggggntcaagcaatttttcctgcc

SEQ ID NO: 515295 - DNA, 216 bp, Homo sapiens
  misc_feature (16)..(16): n is a, c, g, or t
tcaccaatgccgtggntgggccgcgctgacaggtcatctttgtccgagaaacccccagggcctcgccgagatgtgggcccgctggtgtggggggcgtgggggggacactgctggtgctgctgcttctggctggggggtccttggccttcatccatgcatgagggtgaggaggaggaggaagagccctggaggagcaggaggaggagccagtgcaca

SEQ ID NO: 515296 - DNA, 136 bp, Homo sapiens
agaggacccggaaggatctgtggcattacgtacattcatactgtgtgcaaccatcaccacatccacctccagaactttttcattttccccagttgaaactctatacccattaaatactaacttctattccatcctt

SEQ ID NO: 515297 - DNA, 120 bp, Homo sapiens
agaatattaattgtactgcagagcagcttgaaaacatggctcattaagtatgcaggatagcagaccattcagggcagggtgctttcccattaggaactgcctaataagactaggaacaat

SEQ ID NO: 515298 - DNA, 880 bp, Homo sapiens
ttcttttccctggatgcgagcaacacgagacagaggagagaatgagagagaggaaggagcgactacgcactgtagaattagggtcgactctctgcacgagtctctccattccgtgttcacgctcttggattcaccattggattactcgcgtggttcaagagtaccagagtgaaacgctgtcttatcatgtcgggacccacacattggccaggacacaagagattctacgcggttctcttccgactccccccatgtcgacgctgtggtgagaaggccgatgtctctcctctttagccggtctcgtgtgcgcctgctagtgatacaccagaactgcgaaaccccatctccattagaaatctgcgggatccccggtcaaatctgctgaaaaaaaatcccgtcacatcggggttcataaatattttctaaaccccccccctgttacttcttatgcaaaaatatgcccgtagttgaatattatgctcatacactattttcctattgactactttgtcagcccctaatacccagctcctcacgaggagattcccccagttgttacaagcccgccacccaggtcgacggcaactactcaccatttccacaacctatatacaaccagtaattatccgtttttctttcaaccacaaccctcactcataaaattcggtgtggctccattctctatatcgaacatttggaatcaacataaccggtctatcagttattttattggataaacaatatagtgtacatagtacaggcatagcccacctttgcacccctatactatagaacgcttttcacaccccttgcagcgacatggatccattggacccggatttaacccccctggggcaccacccaaacccccgcatcatgc

SEQ ID NO: 515299 - DNA, 892 bp, Homo sapiens
ggcctcttcctcttctcctccttcgcactgaccctcttgcttgtggcgctctgggtcgcctggctgtggaatgaccctgttctcaggaagaagtacccgggtgtcatctacgtccctgagccctgggctttctacacccttcacgtcagcagtcgcgcactgacgctcccgtggcaccaggtctctggcgctctgctgcttgtgagggtgggccatggaggcggcttctgaatacaggagtagggggggtgtgggatgtgtaaccagatgaccgattagcatgagtggggtgtgcctcttgtgcgtgcctacgtgtgtgtgtgtgtgtgtgtgtcttgattatatgtgtgcgcagagtgccatcactttttcagactctactatttccgccaagtgtctgtggtgcattcgcattgcatctcacggatcggagtgctgttgcaagagtgtgtctagtcgccaggatccgggcccctgcctcctctgcacctgacaggctccctactccggggctagtctgtcccgtcccgtagatcgttcgtggtagcctgtgcaggatgaccgggttgtgtgggggcatagcgccaggcgggcacctggtgtgtcatcgtggccaccatcgtggggcatgtctcaggccccagcgctgaccttacattgacgtagggtacgtccgcctacctggggttgggggccaatgcttcgtcatttctggcgctgtcattgcgctagatggcctgggcgcaattggctgcacgtggcgttgctccccccttgggccctttgggcgaaagtgttttggccggcctccgctggattggccacccccgcgttgccttgtgtggcctcccctggggcccccccctatgggggccacagtccccccaagggg

SEQ ID NO: 515300 - DNA, 291 bp, Homo sapiens
cggcacgagggctatctccaggtaaacagtataagaatttaattgaattagaggacacgtagctggtatctgctgcttgatgtgtaggggaaaacccacacacatttagtcacagaagttttctgtgttgatgattgttgtgatgtgagatcagagtagaaaacatgttgagtctgttttttccacccataaaactctaaagcaatcaccaagaaaaaaggtgaagaaatatagctaactagacaataaaagagataaaatggaatactaaaacaatcaacataaagacga

SEQ ID NO: 515301 - DNA, 753 bp, Homo sapiens
ggctcgtctgcagagtcatgatctctttccgattggccctcatccagctagcagaatttcttccatcagatcagataacgtctctcgcgcttgtatgcttcatccgggaggcggtaacgcagggagccaataatagttcctcttgccggaactgctttcacattctccactatggcacgcgaaatatatgctctcctgaactatgcagatgaaaagttcctgggtgaaatccacagcagaagcttatgctgaagtaagcaaaggattgcacgcatatttctcattggaggctctatctctgaagaggatgctgggaagttatataaaatctgtgctgtgtttgggtctgaatggaatgttattagtcaaagtatagaaagatccttctggtttgacattgatgttcctggaataaattatcatttcaagaatctataaatcattgatgtccgggtgatagtattctccatatttgatagtccttaatgtagagtgggtctgggcatcatgatacgacatgctggttttgcaagagctgtgaaataaatctacgcacagagaggttgccagctgttcggtatatccaggagcttttaatctgaccactgaacagcccattgggagtacttcatcagaagccgggtgttgataatccagtgttgtgggcacagctctctgccgggatgacaagctccttgttgcctggggccagcacggggtgacctgggggagttctagccacgtgcaaatcag

SEQ ID NO: 515302 - DNA, 288 bp, Homo sapiens
ccctgaacattcgtgtcctctgtctggggttaaacccttcatctcatctcacccagatctttgctacagtctcctgatcagtcttcctacccctagagatgctgctaaagctgaaatacccacacatcacatcatttctttcaaatacattagaaagctcccgcctgcctacatcataaaggcaactgagaccaggactttcaccacatgccatctgccccagcccatcggtccaacctccttcccttgtcccctccctgcaggccacactctggacacgaatgttca

SEQ ID NO: 515303 - DNA, 909 bp, Homo sapiens
  misc_feature (192)..(192): n is a, c, g, or t
  misc_feature (211)..(211): n is a, c, g, or t
  misc_feature (217)..(217): n is a, c, g, or t
  misc_feature (246)..(246): n is a, c, g, or t
  misc_feature (316)..(316): n is a, c, g, or t
  misc_feature (342)..(342): n is a, c, g, or t
  misc_feature (344)..(344): n is a, c, g, or t
  misc_feature (355)..(355): n is a, c, g, or t
  misc_feature (364)..(364): n is a, c, g, or t
  misc_feature (379)..(379): n is a, c, g, or t
  misc_feature (384)..(384): n is a, c, g, or t
  misc_feature (389)..(389): n is a, c, g, or t
  misc_feature (416)..(416): n is a, c, g, or t
  misc_feature (430)..(430): n is a, c, g, or t
  misc_feature (447)..(447): n is a, c, g, or t
  misc_feature (463)..(463): n is a, c, g, or t
  misc_feature (473)..(473): n is a, c, g, or t
  misc_feature (476)..(476): n is a, c, g, or t
  misc_feature (478)..(478): n is a, c, g, or t
  misc_feature (487)..(487): n is a, c, g, or t
  misc_feature (499)..(499): n is a, c, g, or t
  misc_feature (609)..(609): n is a, c, g, or t
aaaaatatacaataatttgtcaatatataatcaaaataaaaaacaaaacatactctctcccccaaaaaaacatctcagtggggaacagatgtatcttttcatctgaaagacaatgctgggggaagagctccactgagatgcgggcagggaggctgggctcgagccagcccctgcgttagcaggagggggagnacagataggtaactctttnacattncctttatgatctggcacttctccccagcnccttccctctgccccccacccctactcctcaacagttctggtttgccctgacttctctacggctctggcntcttcccgaagagatataggagccangnaagcacgcagngggtgaacngcttaatttcactanatgtngatgnacttgtcttccgtcttgtaggtcttcnctatataaccttangccacccataaatgaancattgggaatacctgncatgctgganccngnaatcacagntttcccggctcncctttttgtctaagatctattgagaaagggaaatatgggaaggagaaccatttgatcagaatacaaccaatagtctttaagcattgttaaagtatgaaactgaaatacantcaaaacacttaatccttgaggcttgtgatctgagtaattagcaggtatgatgctgggactggaaaatagaaagtaataactaaagggttaatgtgcaacgttattttttggccttgttcatgattttatgttttcagtgtcctgtgtacatatagaattgttaaagttgtcatttccaatatttatattagaaaaattatttagatactttataattttaaccggcatttttaataatgacacttgcatttattgtattgtaataaatttcacttttaactttaaaagttaaaaaaaaa

SEQ ID NO: 515304 - DNA, 1751 bp, Homo sapiens
gctataacaacagtaccaaggtggctgtgaaaaccctgaagccaggaactatgtcttgtgcacagccttcctggaagaagccaacctccatgacagcaccctgccagccatgcacacatgctctgtgagtgctctcacgctgtgtgtcacccagtggcaggagccccatttacatcatccacctgagtacatggccaaggtgccagttttgcctagtgcatttccatgcacagcagctgcattgcacaggtgtgcacacagttgcttgctatcccacacagcctccatcttgcactctcttcctcgcatccagcatttgccagcatgggcaacataggcccatcaccatccgccagcgtgcacaggacactaccaattacaaccggtgaacctagacgacgccaggcttaacctgtatcctcggatcctcccgacggtcacctcacttgtcgcaacacacttcggcacgactctctctgaggcctattgctacgcacggtacacatctgaacgactacaactgcacgctacccaccatgtcacaagcggtgcacaagggtcgctctacagagctttcgcacgtcactctacacgcttgcagaccgggctcatcccatgacaggccacattccacactttatggaactcgctaatccacctactctcaacgtcctgcacttgtggtcgggtcccttcttagggacacttcccctcccttcatttacccacacaaaactcatgattcgaccccttagttgtcgcgacaccaatatagttcccactaacagcccaagggggcatgcaacaccttacaatgttggcgcggcaaccgactgtaacccggacacccgcacccgtagatctcccagtgggcgcttcccactgagtaatctggtcctcccgatggcttgctaggcaaccatgccgccagtcaactgacagcgtttcattactgtaaacacatctacgttggcaccaaccttgtttgccttgggagcacaagacaatcacccggcccagcaccggtaatcgataacctgccaacccggcattatgcacgcttaaccctcacacaagacagccgttcacttgctaatgtcaacctctctaacctccccagctccacctgtgacaacagtggtcgccaatctaccacccgacacatcctcgtcgcaccttacagacccaccgagggcacagacgaccagagtcaccactattgtgcacacgcgtgctatatgtgacctagaacctctaacatcaacgagacctaaggcaaccatcgattctcatcacctacacacgctgctaatgacactttatcgacacattcacacatttcagagtgagcatccaccctgatcgagctaccccgatgacaactctgccatactacctggtacccaacccacctctggccaagacgcactcatgctagagtggggagcaccctctcctcttagctacgtacagcgagtactaaccatcaagtgtaaactgaaaacgactactcactgccggtcaccttacactagctctgtcctctctagctctcagctacgctactcacgccccctcgctctccgaccttcactgtatatagaaccagcctcatatctactctaggcagtgtcatactaactataactcacgagtcgtaagtataccctgtgtctcctactacaccctagcggtcaaagctttatcaactaaacgtctgctgaaccagtaccacgactgcctaccgacca

SEQ ID NO: 515305 - DNA, 533 bp, Homo sapiens
  misc_feature (283)..(283): n is a, c, g, or t
  misc_feature (335)..(335): n is a, c, g, or t
ggaggatgcagcatcaccatgagagatgaagggagaaaaaagaaccgagagagcaggagaaatcagttatccacctggcacaatactaagcagtctgaacatttaggacctacccatttctgaagacaaacagactaaccaacgaggcaaagaattaaatcctcccaagtctgtcgctgcagctacgcggcaatccaaaagaacaacgcacgtttctgctaacacttcaagttgggaagcaccatgcaaagagactggttaaaattccctaccatgcagtgcngccatcatcagaagcccagcatatcttctgctctaagtagtgatgtgccagntcatgcacagaacagaggaagagaaaaatggaggaaatgagagaaggctggaagtcggcaggaatgtttctgggtcattaacaagtggaagacccccttcagtattcacaccaatcggtcttgatcttacaggacatctttttctcactgagcgtctgttgaaaagactgcagcaaaccaggccatctgaaatcccca

SEQ ID NO: 515306 - DNA, 207 bp, Homo sapiens
agagtcgaggcggaccctggaatatgcatcaatgacagctttatcttgatattcttgatggtgttgcaagctcctgtgtaagcagctgcttcagctcacctttagagagggtgtcaaaatgccccttccgaactgagtatggtggaagatattgacaattccctccagatgctcttcaagtttggtcatcttcccagcccggaccgg

SEQ ID NO: 515307 - DNA, 334 bp, Homo sapiens
  misc_feature (84)..(84): n is a, c, g, or t
  misc_feature (136)..(136): n is a, c, g, or t
gttgtcgctcttcactgaccatcctagaccactgacatggggggccggctgtctttgagggtgcacgctgctgcatgcagtgcngccatcatcagaagcccagcatatcttctgctctaagtagtgatgtgccagntcatgcacagaacagaggaagagaaaaatggaggaaatgagagaaggctggaagtcggcaggaatgtttctgggtcattaacaagtggaagacccccttcagtattcacaccaatcggtcttgatcttacaggacatctttttctcactgagcgtctgttgaaaagactgcagcaaaccaggccatctgaaatcccca

SEQ ID NO: 515308 - DNA, 155 bp, Homo sapiens
agtccaacattccggggatagctacaagtcctcagggatttcatttggcaggcatgtctctgagcttctataccggctcaaggtcagtgtcatcttggtggtttagctcatccaaaggtgtaaccctgggtttcaatggaacctaaacctcattc

SEQ ID NO: 515309 - DNA, 416 bp, Homo sapiens
cccgtatttcgagtgaatgtggctagaaagggttatgagatatattaatttctacacatatttacttgacctttaaactcttcatgtaaaattaaagaaagacatctttattcatgcatccattatcggcgaagcaatgttctaggcattgttaaccagaatctgtgggcggagattttaactaaagtgtgaagctctttgaagagagaactttgtcagcacgcatattgaggcagcttaaatacacaacaaggtcccagatagagcattataaaattatgaaatatttattttcttatttggttcctagtggatactacaattgagcaaaaacacaatgtgagcttcgatactacttattacacttaaatcgtatgtatattgcttcactcgaaacccgttttgcgtattggtcg

SEQ ID NO: 515310 - DNA, 365 bp, Homo sapiens
ctcataccagagtttctcatgtggtaaagtgtggatctgagaaacagagcacatgaaatgcgaagcacgtacttgggtttacatatccagagccactgatgaatctgttttctcatctgtggaagtttcactggtcttggttcatggagaaattaactaagtgtcagctgtcaggcacactggacttaagtgaaggtcattaatagctgtgggacacatatgtgtggatttggattgcgtggttattacttaacaaccggataaacctggacacatggactggaaatgtgagaactacaacttcttcttatttcatttgaacaattggcgggcctttcaccggatttacctgtggtggcttttgg

SEQ ID NO: 515311 - DNA, 230 bp, Homo sapiens
ccccccctttaaaaaaaaacggggggggccccccccttggggggttccccccctttccccgggggggcccaagggggtttggtccccccccggggaaaggggggtttttttttcggggggggggaaccccccccccccttttggtgggggggcccccccctttttttttttttttccccgggggggggggggggttttttttttttttaaagggggggttttttttttta

SEQ ID NO: 515312 - DNA, 317 bp, Homo sapiens
  misc_feature (7)..(7): n is a, c, g, or t
ttggcanagcaaagcccactatcatacttaatacagtaaaaaaaggtggttttgcagtatgtttagtgggcctcaaacattaatatcccaggttcttggggggcaggatttaaattcaatcaatccgtcctagtgtgtcaggtttggccctgtggacacaggtaatagggaccagcctgcctgggtgttaaaagatcagtccacccagagttagacattgtttttgtaaaaacaggcatttattagttagggttttggttttttttttttcctacaggataaaagctttatacagaacaaatggacctttaaaaaca

SEQ ID NO: 515313 - DNA, 1643 bp, Homo sapiens
  misc_feature (1)..(1): n is a, c, g, or t
  misc_feature (283)..(283): n is a, c, g, or t
  misc_feature (755)..(755): n is a, c, g, or t
  misc_feature (1172)..(1172): n is a, c, g, or t
  misc_feature (1210)..(1210): n is a, c, g, or t
  misc_feature (1242)..(1242): n is a, c, g, or t
  misc_feature (1304)..(1304): n is a, c, g, or t
  misc_feature (1306)..(1306): n is a, c, g, or t
  misc_feature (1309)..(1309): n is a, c, g, or t
ncgttgtgtgagtggattgggcggcgctgttaatatggtcgcgtcctctgttgtcgcggggttatccttcccgggtcgctgcccgctggcttttgtggccgtagcacgtgttgccaagacgcggggtggtccctgtcgactgttctccgagtttttggtgcccccccccgtctccctaccctttgggcccgaggttattcttcccccgggccctatactggggtgcggcgcatctgtctcttccttttttgccctgagcggccttatccctccgtggtgctcncacagcgtgtctccggggtttctcttccgcgtgctctttccccgctccacgaggaatggggagaacgccgtacgttctcgccctggaaatttgccataatatgttttcttgggtgttttcataccccccaccccgcgacacacttggagatgtgtgaaccttttatctctgggagggatgttgggaagaagagagaaattttggaagaaaaagttgggagacccaattccagaacacttggtggttcttttcaacccagcagacgagcttgggtgccttgttcctaatacttgcgtgtggggtgacctaagcaccctgggagagtttccaccccccccccccctgtgatacaaaggatatttggatgttaattgccccctggccccggctggtgtgggaaccacacactgggtggaacgcttttggtgtccacccaccgcccccccaacagagttattgtttataaagtggngggagtcccgagaggaccccatggtgagtagccccgccaccttcttctttgggaggggcttttgtagaaagagatcgtcccccgccacttttgggagaatttgggagatggaaaaatttccgccacaattttctcggctcttgggctttggcctcttctttttaaaataactttggaatattatgtcctctatataacacacccgctacaacaccctcgtttatatggccacccacaccaaaaatgttataggggtttatataaaaataaaaaatgggtgtatacacactcgggacacactcgagtttcttttctcgtgtatataaagatgtgtctacgactctctggagagtggcctcggtgtctccccacatcgctttttgagatagttagtttctcgagacccacgcgttttgnctcccccaccacagcgtatagcctctctataggagagngggctcgggccacacactctatagagaggttngcggggagacccaccagagagaatttctctctgtattccccaccactcacaccacttctctngngtnacagagtttggagagacttcttcgcaaattcttcttgccacactcccacaagctctgttaaagaataagttataagcctggcactaaagttaaacttccccactttaccactaactctctcgcttatgagatttgggggaaaatttatgaaactatatattgaccacggattattggaaaatttgttaataatgagatgaaaccactctttgtcactataagatttactaatttactttcttaataccactttgaataaaagtaaaggcctggttgtggtttatttgcgtttatttttgttcccccagtttaattaatcaattaaaccttgtga

SEQ ID NO: 515314 - DNA, 921 bp, Homo sapiens
  misc_feature (918)..(919): n is a, c, g, or t
gatctgaatcagatggacagctcacatggcagtcaagaaggtggagcaaacacaactctggtcctataaggacaccccaagattccagaatgctgatcatctgtgggcatcccatctcggccttgtgttagattcttgcagatgcattgcagacaaagtcgaagacggtgtgggcagaagaataagagctagctgatcaacagcggcaagtggaggctgtggacggccagaagacgccaagttggagctcaacggagaggccagcaaagtctcaggaaatggggcattgggtgaccacaaggagtcgctcaaaagagtccagaccagtttatgacagctgactgagaccaaggacacctgcagaatgtggaccatgagccatggtcggtgtaacaccctgacaccattaatctgcggcaggaacacaaccgttgaagcataacgcattacagggagcgtggaaaattaatagatgcaaatgtggtactgatggtacattgggagtcttttttagcataaaatttcctagctcttgtgtagatgtgttgggactgtacaaagtcggtcccaattggtgaagaaacgcgtgtttctgaaatgacgcgccaattataatcagcaagaattgatcgtccacgtccactaggaggcttccatccctcgggggtgctatggatggtcctagcagaaactacgatttgttcctgattggcaacttacctccccaggtaggcactcccaggtaaaagcctggcctggaggaattgattgacattggactcagccaatcggacgcacgcctgggggggcaatcactcaaacctcaaattcgtgggaccgggcttcaaccctgcgggacagccgcgagaattcacaagagctctgaaaaccgccctgcatccctcatcctactcctgnnct

SEQ ID NO: 515315 - DNA, 273 bp, Homo sapiens
agtcataatcagtgcctacagttttatctcctcctgaaaaaatgataaggtgaaatataagttggggaagaaaataaaacaacagcagccttagttgtctcccccgcaactcctgtcactccagggagaaggtttgatgggagaacccatacctcgagtccttacttggctgtcctccctgaaagactctggcatggccgaatttctacatcccagaatcaccactacgctgtaggggttgtccccttttcatgagtctgtattaactgcttg

SEQ ID NO: 515316 - DNA, 826 bp, Homo sapiens
cacgcgtccggatgaaaatggcagtggtggccgggcgtggtggctctcgcctgtaatctcagcacttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaagggcagggggcaagtaagttatagaagagaaattgctggctagaaggaattaagcgtggtagtaaatggcgtgcttatcctctaagctggaagaggggagacgaaaatccattggtttaaattcacatctcagggagggagaacccggggctggtgtggggtgggtggccaatttcctagaagggaaggtgtgggggtatagaaaacgggaatgaataagcgtggttttcacatagggtctggtaagtatgatgagagggaaacgatgactggggagggcttaaaatgattttgggacaacaaattggtttgaggctcagttgacaacggcaacgatacaactttaacaaaacacattgtgtaaacatacggacgtggcaggtatttggcaccaggggggcggaaggcccattttatcctggagactggatcgtaaagattgggcttgtactcaattataaggctcaaagggggaggcctgtaattgacgtgactattaaggggtgg

SEQ ID NO: 515317 - DNA, 168 bp, Homo sapiens
gcagagccgttatccacaaagctaccttactctctctatacacacattatttcactcacacagccccacacagagcggatcacgatgcataatcttctcctagggagcccatcctatgcacacagcttttgcacagataacctccataacaagcacacccggctccgg

SEQ ID NO: 515318 - DNA, 333 bp, Homo sapiens
aagccaaatatacccacaaaatttaaagtatctatagtttgaaagatgaaaatagaaccgtgtgtgccccaaacctgtagtctcagcactttgggaagctgaggcaggaggattgcttgagctcaggagttcaagaccagcctgggcaacatagtgagaccctgtctctgaaaaaaaaaaatagccaggcttggtggtgcatgtcagtagtcccagctactcagaaggctgaggtggaggatcccttgagctctagaatttgaggctgcagtgagccatgattgcaccactgcactccaccctgggtgacagagcaagacccctgctttttaa

SEQ ID NO: 515319 - DNA, 274 bp, Homo sapiens
aacgggtgatgcggttgaacctgggaggctaagattgcagtgagccgagatcgtgccactgcactccagcctggacgacagagtgagacttcgtctcaaaaaaaaaaccaaaaaaaaaattattttgtagggacgggggtcttgctgtattgtccaggctggtctggaactcctgggctcaagcaatcctcctgcctcagcctcccatattgggattgcaggcgtgagccactatgcctggccacgttgttttctcaaccgcatcacccgttcg

SEQ ID NO: 515320 - DNA, 293 bp, Homo sapiens
cccctttttcccccccaatttttggggggtttttttcaaaaaaaggttggggttttcccccaatttttttttttggggggaaaaaccaaaaaatttttttaaaaggggttaaaaaaaaggggcccccttttttttttttttatttttaccccccccgggcccccaaaaaaacccttttttaaaattttaaaaaaaatttttggtttttttttttttttttttttttgggttttttttaacccccttttaaatttttcgggggttttttggaaaaaaaaaaaaaaaccttttta

SEQ ID NO: 515321 - DNA, 800 bp, Homo sapiens
gagagtagtataagcatttatatatagtctaatttagacttggataattgaatgctacttttatatattaactaaaaatataaattaaaattctcattagatctagtttagtagtgggtgtttgtgtgaggtagtccctgttgggggaaaggaacaaggaacaaccattcataatcccgccagtccctacagaaattagcctcacagctaacttgagaaaacctgagactttggggttagatagtacctttgtcacagcttgctgttctcccttgtctcacatcctttcagttgccctggcttagaaaaatacttgtgtctagcatccataggtgaacactaggtattcgtattgcccctctgtgaaccatggaggaaatggcacgaggcaaactgcaaggggtgataggtagcctacaactaagccctttgtacaccccatgctccatctagcacttcaaaaatcttgtaccactagacccccaaaaaactggcaaggaaccgaaggtggctggggagaattccctcggaacctgtgatggcttaatctgttatttcttttatcttgggctgctttctctaagttggcagtcctgtcccattgtgaagatccatcttgtcgtgagatatgacgccagaacgcacatgtaactacgcttctttgcaattggcctggcgagaagagagaaatcttctcctaagtagcgggggccgtttattagttaatcacacaactcagggcctaccccgtctatgggaaccgttatccgcttacgaaaagcagatccgacattaactac

SEQ ID NO: 515322 - DNA, 848 bp, Homo sapiens
catccggctatgggccctgcagctgatcttcagtgtccacgccagtgctcctagtggccatgcactgtgagctaccggaggacatgagaagaatgaggaacgttcatcaagggggagataataggagtgaatttaaggacatcgacggagatcaaaacccagaaggtccggatcgaatgctcccttgtggtggacctacacaagcagtcatcttcttcctgaggtcatcttcgaacccgtcttcatgtacgtcttctatgtcatgtacgacggtttctccatgcagcggtctggtgaagttgcaacgcctggtccttgatcctcaacacatgtggactagctttgatgctcccagggcgcacggaggaagactgtcttcacatgatgtgtcactgactttgcaaggtgtctggagatttgcaatccatgctgcaatgtcacttgaaattgtgtcagtttgcgtaattcagatacttggttcctggcgaagatcacaagaatagccacgtttaacagcacttgcgccagatcgttgaggattaaggaaataggacagcatgagatgggatgaggcgaacctcgttgctcgagctgtcatggctctagatcgaccagcatttcccaagcgacaagagattctgaccttagaattgcgagccatttgaacacccctgtaggcctcgaggtgaaactctcagatgcccacaatggagctctgctcccctaaagcctcaaaactagaggcctaacttctatgccctgtcttaagtactctttcactgtaagttagtgccactgatgaccccgaggctgttacgcgggttatccgctgtaaaggtactttcata

SEQ ID NO: 515323 - DNA, 198 bp, Homo sapiens
actagaggtcccgtacgggtgtacgtccatatcgcatctggaggttcttccataaggtccagacagtacttcttcacaataggtttttaaaatatgctttttttcccctcagtacttatgattggcttctttcttggtcagtaaatgtacatatacagttttaatcaatgcatggtattctgttattaatcgtggctg

SEQ ID NO: 515324 - DNA, 195 bp, Homo sapiens
accactcctatagatctagtctgggcaacagagtgagactctgtctcaaggaaaaaaaaaaaaaaaaaaaaaactttgcccccccccccccccccccccccccccggggccgggaaaattccataaatttttattggttaaactcttgggcccaggggtagcagggggcctccattcttgcggcccctttttccc

SEQ ID NO: 515325 - DNA, 187 bp, Homo sapiens
  misc_feature (87)..(88): n is a, c, g, or t
  misc_feature (149)..(149): n is a, c, g, or t
  misc_feature (165)..(165): n is a, c, g, or t
cagatatggtgattaatgaatatgtcttccattctttcttcctcagttcatttccttttgcagtctttgacttgaataaattctacnnctttctgggatattttgtaatgtgtgctgtatgtttttttaacagtgctcctgaatctccntttattatgttgttcnttgatcatttgtgacttgtagt

SEQ ID NO: 515326 - DNA, 352 bp, Homo sapiens
ctggcgccagcagtttgagacgagcctggtcaacatagcaagactccatctcttagtaaataaataaaatataaaaacaaaggcggagaggaagtcaaagaaattcagtttccttgctggctttgaagatggaaagggggtatgagctaaggagtgtaggtcacctcttgaagctgagaataatcccaggctgaagccactgaagaaacagggattttagttctgaatgagaagagaagcagatcctccccctctgacccagcccagacgacaccttgacttcagatttataagactctacacaaggggcacagccaagtccatctggacttctgacctgaagaactgtgag

SEQ ID NO: 515327 - DNA, 1194 bp, Homo sapiens
  misc_feature (230)..(230): n is a, c, g, or t
taagtaaaaacggggtttcaccatgctggccaggctggtctcaaattcctgacctcgtgatccgcccgccttcggcctctcccaaagtgtgctgtgggatttacaaaggtgtgagccaccgggcctgtggcctttcctttgcctctttctgtgtgcctccaaactccgtgggaaacgttctgtgaattcaacagggggacattctgtgtgtcaaacaccttccctatagncaaactatacccctgtggggaatgtggccaaacctgtgaccctgtggaagaacgaggtggaggtttatagtttaacgccacagaattggttcccattcggggggcctctcatatagagggcgcctgtggaaagcatattcaaagaacacacaccaacgctcttgtgttagaggaacaaaaagccaactctcggtctccgcgggcgcgccttttcacttactcggagacctctcgcggcgccgtggctgtgctgtgaacacagaagcggtatcccggtgtgagagtttcccaagccccccaaaatttaatctccagagagaaaaagtgggggtgtgagaccccctcttaagtgtgagagaaatatattttatatgggggcgctgtggcgctcccctcgaggtttatttctctcacaatctcgatgtgtccaacgtggggggagacagagagcgtaataaggggggcggggacctataagagagaggcacccccgcgaaaccacgaagggtctgccgcgtctctgtgcaagcccactttgtcgcgaaatagtctaatagcgcgcccccaccaggggagacacggccacaaaccactccagaggggcccaagtgttcttctagggcgtgagaaaccaaaaagagaaaaacccccgagagaaaaaccccgcgggggggcgcacccacctattgggtggcgcacccggggtcacccgcggagggctctctacaggggggcgccaaacgacaaactgcaaaggcgcataaaaaccgtccgtgtgagaccctgtggcgcgccggggttacctcagtacgacacaaaccaattttttcttctttaaccctttctctgagggtggcctcctttttcaaaggggggacaccacatcgggggggagtagaaaacaatattttgacacaacgctcctccaactcgttggagaagccccccagaaaaaatatattcc

SEQ ID NO: 515328 - DNA, 885 bp, Homo sapiens
tggaggcctggggcagcagatgaccgtcccccacaagagcggccatttgttatagtcgctgagcgccctggtagacagtgtcatctatcagcccacaggccgcacgacctcagggtccaccgggtgctgtgctggctctggttggatgaacgtctcctgatgtggacccaccgttgtggtatcatacagagtagtttcacgtgccccaggtcccccgtgtgccgtgctgcacatccctccgtccctccctctccccagcccctggattcgctgatcttcgtgctgtctgcacggttttggcctttcctggatgtcgagtcggaaccgtacagcgtgtagtccttgtgagacgggctgctttcactcagcagcatgcgtctatggtccttatcggtctttgcagggcctggtactattctgtgtctggatggacgccgggtgtgaatccactcacctatgagtgtcttgggtcaacttgtagtggtctctctgggcttctcttagcggataaatgaggactaaaccaatgccagcaactgtccctgaactcggttctgcctctgactttttcctttgattgaaggaaggggtccttggcgctggactccgtgcttgtgtccatcatgtctcctgctaccggtggttccggaagcccgcctgggcctgtgaccaggaggtccggtgttccaggcatgctgccgtctactggtcgagggacccatggaaacggcctggctgggaacggggttccacaaccattgggcgggtctactcattctatcacactgcttcgtcccaggggcacgcatctggcagagcctggagtcatggcggccagaacgcgccgactcggagtgtgcccactgctgcggcggatttacggca

SEQ ID NO: 515329 - DNA, 814 bp, Homo sapiens
  misc_feature (58)..(59): n is a, c, g, or t
  misc_feature (151)..(151): n is a, c, g, or t
  misc_feature (153)..(154): n is a, c, g, or t
  misc_feature (157)..(158): n is a, c, g, or t
  misc_feature (160)..(160): n is a, c, g, or t
  misc_feature (165)..(165): n is a, c, g, or t
tccggaatcctagatctgctcccaccctcatctctctaccctacccctcccatcgggnntgtgctggggcttggggaggggagggggcgccttgttctccctccaggtctgatcataaacaattaccaggaactagcattgtgggacattngnnccnncngctcnggagaggtgccgcccagacttacccatgccagtcccggagcccacagtgctgcccagcgtaccgtccctcaccgtactggggctcttctagggagcacaggagcatcccctgttcctgtttcactctcagcttctcccctcgaagggactctctgggcacctcctccaccgcgagtccagctccctcagtctggcacccactgctacactcagcctcagtgagccacttcagaaccagtccaggtgtcttcccgggccctgccagaccctgtctcacattccctctgctggtctgtgctggtctcagaaggacaccgtgcccgcattccactcagccagggatccagactgcagccccgcgccaaccttaccttcccttccctgtcctgggtcatgtagttgccaccctgtgtgacctttagaacgctgtaaaaatgagcttccaggggcctaggggtaggctgtcggggccagggccgacagaggctaggcgaggaagcccttctggctttatgctggtgcttctggaactttgcgtttccctcacgctctcactttccttctagaaggacgcttcctgactgggaacccagagaatgcatgtctgtaccacttggtggctgctgggtggggcccggaaacacagggc

SEQ ID NO: 515330 - DNA, 878 bp, Homo sapiens
ttgctgtgagtcgaggcggagtacatgtttttttagccattagacaaagaccatgagtatcttaaaagagatgtgacatgattggttaacagaaagataatctgtcagcagtgtacagatgaatagaaagaaagagaagacttgataatagaaggaccaatagaatggtttttcatgaattccaggaaagaaagaataaagatggagttaagacaaagctgtggggcatggaggagtgatctagggtacagttgtctaaggtccaattgagaaaattaaatgatctctgtgtgctgacttcagagaggatgctttcattgcctgttagggtgaagctgatttacatatgtggaaacgtaagtagagaccatttaaggagtaagtgagatagtatgagtgtgagactgttaggcaaagtttcatttaactatggatgagatgaataaacttagaggaacttaacaagttccatttaaaaccgtggaattcgaatggttgtgggacattcacaatggttttgtccagtaggcagggaaatcggtctggtggatcagaagagaactggtccatacagatcggagacgcaccagcggattaggatataattgaagcataggaacagctaaaattgccagggagaatggcaacgggctacaaagagattcccagaagcctttaactgtgggggtcctatcctgactcacccggctttttgagcgctcctggccagtaacaactggcggcgtataaacgcgagaagcacccgggtggcgccacgggaacacaaactcgcgggagcacaggtgggcgcgcgacaaccacgaccaccacaaatggggccacacaagggcgaacagggacagttacacaaacaggcg

SEQ ID NO: 515331 - DNA, 146 bp, Homo sapiens
gctaataaaactcaagttaagccttccataaaaaggctaaaaaacttttataaacaaaaaaaatgtttttaaaaacaccgcggctttttatgtttttttaaagaaaacaaggggggttttgtccttcaaaagaacttcttaaaaaa

SEQ ID NO: 515332 - DNA, 1013 bp, Homo sapiens
  misc_feature (5)..(5): n is a, c, g, or t
  misc_feature (92)..(92): n is a, c, g, or t
  misc_feature (98)..(98): n is a, c, g, or t
  misc_feature (120)..(120): n is a, c, g, or t
  misc_feature (129)..(129): n is a, c, g, or t
  misc_feature (149)..(149): n is a, c, g, or t
  misc_feature (165)..(165): n is a, c, g, or t
  misc_feature (174)..(174): n is a, c, g, or t
  misc_feature (195)..(195): n is a, c, g, or t
  misc_feature (252)..(252): n is a, c, g, or t
  misc_feature (268)..(268): n is a, c, g, or t
  misc_feature (277)..(277): n is a, c, g, or t
  misc_feature (291)..(291): n is a, c, g, or t
  misc_feature (296)..(296): n is a, c, g, or t
  misc_feature (312)..(312): n is a, c, g, or t
  misc_feature (961)..(961): n is a, c, g, or t
tgtcnaggcagggcggaggcttgctgtgctgttgcctctaggtgactttccaagatgcccccctacacaccttttcttggaacgagggctcntctgtngtgtccctcccaccccccatgnatgctgcantgggttctctccctcttctncctgcttgtcctgccncaagaactngagggtctcccccggcctccnactgcccctggctgcaggtcagtgccccaggggcgaggaaatgtggcccaggggacnccaggatcctgggatnccagggccnctgggcctggaccntcagnacaaggcatggaggcncacaggggccccagcagcccaccctttcctctccccactgcctcctctcccttcctacactcccagctcgagccgtccagctgcggtgggatctgagtatatctagggcgggtgggcggatagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctttggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaaggttcccctctggtgtcatntcaggcattttgcaaggaaaagccacttgtaaaaagatggaaaggaccaaaa

SEQ ID NO: 515333 - DNA, 642 bp, Homo sapiens
  misc_feature (470)..(471): n is a, c, g, or t
  misc_feature (492)..(492): n is a, c, g, or t
  misc_feature (509)..(509): n is a, c, g, or t
  misc_feature (561)..(561): n is a, c, g, or t
tccttccttccctcctttcttcctttctttctcttttcttgcttttttatttatagaccgaatgtttgtggcaaccctgtgtcaagcaggtctatttggcaccatttttccaacagcatgtgctcacttcatgtctctgtgtcacattttggtaattcttgaagtatttcaaccttgttcattattacacctgtatggtgacctgtggtcagtgatctttgaagttactctcgtaactgttttgggacaccatgacccacacccttataaaatggtgaaccttattgataaatgttgcgtatgttgtgacttctccaccaactggctggcttcttgactctctctctctctcccggcctttcctattctgtgagacacagtgaggagaataatctctcgtgccgaattcggcacgagcttcgcagtccagcccggcccgggtcatggtggtgggccgagggcttgttcgnncgcgcagcctcggcgcgctgngagcccgctgcgcccgncgaggcctcggtccagccttgttggagttttttgcacacagatttgcggaangaccttgacccgtgacgatggcacccattgaagtagaagtgcttgcttgccctgaccggcaacttcattgtcctggtcatt

SEQ ID NO: 515334 - DNA, 555 bp, Homo sapiens
  misc_feature (433)..(433): n is a, c, g, or t
  misc_feature (458)..(458): n is a, c, g, or t
  misc_feature (485)..(485): n is a, c, g, or t
  misc_feature (502)..(502): n is a, c, g, or t
  misc_feature (523)..(523): n is a, c, g, or t
  misc_feature (549)..(549): n is a, c, g, or t
gacgccctggcagatggtggggtgaagatgggcgtgccgcggcgcctggcggtcagactgggagctcaggcgttgctgggagcagctaagatgctgctggactcagaggaccatccaggccagctcaaggacaacgtctgctcccctggggggccaccatccatgccctgcacttcctggagagtgggggcttccgctctctgctcatcaatgcggttgaggcctcctgtatccgaaccagagaactgcagtccatggctgaccaagaaaaggtgtctcctgctgcccttaagaagacccttctggacagagtgaagctggagtcacccacggtgtccacgctggccccacccagctcagggaaactccttacaagaaaccccgcccagggaagcaagaaggagtgaggaggatctgtagggtgtccctgtcncctgtagtacaaggaggggcagctnaggtctgggggtgaactgttcattgtnaactggtgccacgagtntttctgtccgtggaaaaagtntctgaaaagcggtgatccagaagtanatccct

SEQ ID NO: 515335 - DNA, 986 bp, Homo sapiens
  misc_feature (83)..(83): n is a, c, g, or t
  misc_feature (85)..(85): n is a, c, g, or t
  misc_feature (92)..(92): n is a, c, g, or t
  misc_feature (122)..(122): n is a, c, g, or t
gggggggggagaaaaaaaatgggccatcttaaaaagcgggtaaaaaacctgggttagggtgtgtgttccccttcaaaatgttntntttaacnactgggtcatgtgcctctggtgtaggaagntttttctaccattaagggtgacaccaattaaagtgttgggttttcttaaaacaaaaaaaaaaaaaaaaaaaaaaaatttgtttgggcggcgcattggacctaaaaaaagttttttaaaaacaattgtgtttgggggcggcgggggcccaaagtgtgttttgggtataacagtggggctaaaagggggtggtccaaaggaaaaactccgtgggatacacaaaatggtgttgggttttcaccaaagtataaaaaagccgcgggggaacaccgaagagtttgttggcaaaaacaccaagaaatgggggattcgggagagggacaaacaggggggatcctaacacaaccagggagggtccaaaggaaagcgtggtagatatcacaatttcaccccggctccgtgtgggggagagaacagcagagcaagacatagcccaacgacagaaaagcagatgcagataaagcaaagatacacggcaagatgagattaaaacgatgaacatacttgataggcgcgcaccatcatcaataagctagcacaacaaggcagcaaagttacagaggaggcagagaggcgggcacgacgcggaaacgagaacaatgagagagagagaagagagggagggagcgtaggagagaggagcaacgaggcgagggagagcagagacgagcggaacgagagggaagataggagggagcgagagagagaggagacaggagagagggaggcgaggaggagacaaggcgaccgagcaatgaagaaaccaaagcaagaggcggaacagaacagagagcagaggacacgggaaatgacaacgaaacaggagacggagacagacagagagaaagaggaagagagaagcgaaa

SEQ ID NO: 515336 - DNA, 104 bp, Homo sapiens
acgctctccacccaccccgagagtagattgtatgtgacccgcctacttatttattgcagcgtggagaccacatgcggtgtgtctgttgatcagagcagcgctca

SEQ ID NO: 515337 - DNA, 157 bp, Homo sapiens
aatgtacgttcccatgtgccaaacaaactaaatgaaatctactgcatgtttgcagcatatctgccttttgggaatgtactcaaggtataatcttatggctagtgttctgtgcctgtatttttttaaaatggtccaccagaaaaggactggcagtcta

SEQ ID NO: 515338 - DNA, 95 bp, Homo sapiens
ttgattcttgtaatttttcattcttgtcaaaatgcataccagaagtttgtatcagtattggcatgcttaaaagaatttagactgcatatttgtca

SEQ ID NO: 515339 - DNA, 144 bp, Homo sapiens
gcgggtgcgtctgggggtcgcctgtcccctcctcctcctcgctgctctccgactcggcgctggtgatgtcatcctcttcttcgccgtcctcgctttcctcttcctcttcctcttcctcctcctcctcacatccgtactggcccg

SEQ ID NO: 515340 - DNA, 177 bp, Homo sapiens
  misc_feature (20)..(20): n is a, c, g, or t
  misc_feature (23)..(23): n is a, c, g, or t
  misc_feature (26)..(27): n is a, c, g, or t
  misc_feature (38)..(38): n is a, c, g, or t
ttctcacagtgtgctggtanggncgnnccatgtagttnttatggggaccaaaagacaggatggatgaagtcaggaaaccccccatcggggaaatgaggcagtccaggatggctccagatgtgtgactcaggtgccgctgtgaacaggagggcagctcgccactgagttgggtaccga

SEQ ID NO: 515341 - DNA, 829 bp, Homo sapiens
gagcggccctccccgcaactccatgctctcacaaaatgccttcagatgtgaatggtaggtgggggtcctcgtgcatccgctacatgcaggcaacacagtatgaacggcgccgagatgctctgggacctaaggcactatgctctatggcagggcacctgggagcgcctaacattcaatctcagagtatcgacagaagcagcttgccactcgaactagtgtcccttcgagagctgagcctagtgggatccgaagtgggcagggttacaacgcagtattcttgtggccagtcactcgacagagacatgccaggtacatgaagtcagaatgacaaatgagctcagggaacaaccgaaatgggaagacctagtggctcccagaccgaaatagtgaggtatgcagccgaagcacaacgggtccaactgatgcattcagacagacctccttgcctcagcaactagcaagtatgccagagggcacggcggaacagagattgaccaaaggatcagtagacacaaccttatgcggagatgactggggtccacatgcttaatcctaacgggcaatcactgtgatggggtgcagcacgaccatgcgttcctccctattggaacctcctcgatcatgggttcgcatgcatcgaagctagtactctaggcctaggaagactattatcggggacgcaatacagtcgtggtggacaaggtcctccagaagggatgagcagcgatattaccctgatggaaacttctgagtatggccaacagaatgatggatacccagggagcaactcgcacaacaggatatccaacccagaagcagcagtacccag

SEQ ID NO: 515342 - DNA, 179 bp, Homo sapiens
  misc_feature (119)..(119): n is a, c, g, or t
gcaaggcaattggatcatcacaacaattgggcttaaacagcacttgggttgaaaatgaatatcccctagttatgtgtttttcaaggtatgggtcatttgggtatatcatgagtggtttngcaaactttggtgcctaagttttcaggaaaactttctaatattggctttggtgtttctaa

SEQ ID NO: 515343 - DNA, 251 bp, Homo sapiens
  misc_feature (178)..(178): n is a, c, g, or t
aaccacacacgcaatcacaggtttacaccttatggcctggggcgtttacagctcaagtccaaaggttgcccagactcgttaagcaagtcctcgatacattccacagcctggcgacgcccaccaactctcacggcaactggtttaatggggcacagcgggaccaccgggtgtatctcangaggtgtgttagaaggaccggagtcacagctatccgtactactattgcattctctagacacaggtgatgtcgg

SEQ ID NO: 515344 - DNA, 881 bp, Homo sapiens
cgagggagattcttcaagtcaatcatgatgtaaagagaaacaggtgtattcccttctttcatatgaggaagatcgaggggatcaagatatctcattctgaaaaggcgttccccgagtgcgaccaatctcgtacccgtgtggagtaagcgcgggttatggctgcgcactagttcgtcctatggggacttcattatgaactggaagaagcgggtgcgagaggcctcactgagaatatgtctcatttcatctggatcacataatgcgttgtggggcagtccactactgggcttaggagggtagcgaagcgattggaccgtgtttgggtagtgagggtctaccttcgaagtgttactttgcgcatgggtatactgagagaaatagatctagaggtccgtgtacgatacgagaagagactggcataggtactgtgggtcctgagctttagaataggacgttcttgctttcataagatataggcatatggtactttagatgtatttaaaaactttggagccttatttgaacttggggtttgtgaattactacaacctaaggtttgtgatcgcgcgttgcacgatttgcgtaatcgttgagcccatttctctgaaaatattggagtcttccctatttacttgggcaagtgctatgatctattgcatttgggttgagccgagatttacataaggggggacgtaacattgttcactttagatttaaggtccattatcacaacgggaactttcgacggtttcacctttgaaatcaatttgtttcacggttaatagtgggccttttttgcatggcttggttctgcacaattgtcccaggccttctgtgtaaatctctttgaaagatccaccctttttaagtcgtaaacggaa

SEQ ID NO: 515345 - DNA, 603 bp, Homo sapiens
ggacagagacgctggctaggccgtcatacacagtgttgccagcatgaagctgctcgcggcaactgagctactcctcaccatgtgcagccttgatggagctgacggtcgtagacaggcaaaggagccatgtgtggtgagcctgggtgctgaggcctaccagaccgcgactgactatggcaaggacctgatggagaagggcaagagcccagagcttgaggccagagccaagtatgactgtgttaacttgctgagctatgtcgaggcacttggaacacagcctgccacccagtgaagtggccagaccagcgtattacaacctcagatgtgctctagaacacacacatgacagtcgtagatgctctgtacataccgactctttgctgcatatacgctgaatgaatgcaaatttttttgactgagactcgagtgctcttggatcctggaatctaacaggacatcttattttaacggcacgataacacacgagtttactggggtttagggctgagccgtcaatttcgtgatggcgtcccgtaaagtcgggctacctggtttgcgtgaacttagtgaccaacccctctttcatatgccatgcgtggttcg

SEQ ID NO: 515346 - DNA, 201 bp, Homo sapiens
ggggaaccccaaaaatttccccccccccccccccaccaaaaaaattgtcccctttaaattttttgcccctttgttttttttggggctgggccccgtttcccctttaggggtttaaaagcctttttttggttaaaaagggatgcccccttttccaaaccgcttaatgtttttttttccccaaaaacccccgggttcttttta

SEQ ID NO: 515347 - DNA, 112 bp, Homo sapiens
tgataagaggctttattcattacttaattcctcccaaggtttacccctttccttcttccaagaagaaaaaaaattgcctgatttttcagaatagatttttctgatttgaaaa

SEQ ID NO: 515348 - DNA, 187 bp, Homo sapiens
gcggccgcgtcgaccagcacgtccgcgtcatgatccgaccagtcgacctggcagaggctttccacggaggcctcgaggaacgcgagaacgtcagacagcggagccgtctccgacccctgctccggcgcgtcccacactccctgttccatggctcaaagtatagaacacacgtacgacatcgagcggg

SEQ ID NO: 515349 - DNA, 160 bp, Homo sapiens
gtttgtggagtccccacttatcaagatgcgccacacagttgcagactcactgagtttactgcttggttctggggactgggacaatttccaaaggccatcaacaataataaaagtaagtatctgtgaactaggagaaagaactaaaaaaaagatacaggta

SEQ ID NO: 515350 - DNA, 561 bp, Homo sapiens
  misc_feature (4)..(4): n is a, c, g, or t
  misc_feature (66)..(66): n is a, c, g, or t
  misc_feature (78)..(79): n is a, c, g, or t
  misc_feature (87)..(87): n is a, c, g, or t
  misc_feature (89)..(89): n is a, c, g, or t
  misc_feature (142)..(142): n is a, c, g, or t
  misc_feature (197)..(197): n is a, c, g, or t
  misc_feature (199)..(199): n is a, c, g, or t
  misc_feature (216)..(216): n is a, c, g, or t
  misc_feature (547)..(547): n is a, c, g, or t
tgangggagtgaatgattttgaaccaggctctgcagattttaagaactgttacagctattttaatnttttgagttttnnttattttntntgttggcagttaacaaaagtgagaatttctgaaacaagctaaataggatttanaagcagaacactgttcatataatagaattgctgttttataacttttgctcagttntnactttttatcctaaaanagtttcttatctgataagttttaatgaaaacctctaggaactgtaacagacttttctcaacccagctctagatactaagtatcagaaacaaggcttgtgaagtggatgtgttcacagaaaaatgcagtgtttctactggaggtaagtgtcaagtttcctcttgatgttgtcaaaggaatctgctcccatataatcagcctggccctgttcccatcgttccttccgttcttccgaggatacaaacggctgtgccatagctggggatctccccaagggacagatgtgatatggctcctgagacatcttccacatttacatatgagcaggtgtntttgacaaggccaa

SEQ ID NO: 515351 - DNA, 296 bp, Homo sapiens
aagatacccgcgtgtaacgaaggacacagagtggtccaaatatccacttgtagatcctgcaaaaagagtgtttcaaacgtgaactttgaaaggaaagttcaactcggggatttgaatgcaaacatcacaaagaagattctgagactgcttctgtttagtcagctgaaattatcccgtttccaacgaatccctcacagaggtccaaatatgcacttgcagattctgcagacaagtgtgtttctataactgctacatcgcaaggaatgctcagctctgtgaggaattcactgacaacg

SEQ ID NO: 515352 - DNA, 255 bp, Homo sapiens
  misc_feature (159)..(159): n is a, c, g, or t
atgtgggtagcgttcacacagctgccacatgcactctggagacttccagaaggactgggagcccgaccatgcttgtgacccacagagccaggcctgagaaacaatggaccctgtgaggctatggctagagggcggggacctggttccctggggtctccncctccagaggggcgacgagcaaccctgcttgtgaggcctgggagaggcacaggctgtccagtggctctgacacgcggtcctccttggttgctcatg

SEQ ID NO: 515353 - DNA, 161 bp, Homo sapiens
ttttatggtttctgaagccgctggcggaggaaagggacgcgctcaatctgaagtttggaaagaatccccccaaaaaagccgccagcgaactggcggctttttttgtgccgccggaatcggaaagaccgatcggaatggatcccgttggcgggcaacccagg

SEQ ID NO: 515354 - DNA, 252 bp, Homo sapiens
  misc_feature (101)..(101): n is a, c, g, or t
  misc_feature (219)..(219): n is a, c, g, or t
  misc_feature (225)..(225): n is a, c, g, or t
ttttagtctctactcagtggtgtttcatcatgtttcccaggctggtctcaaactcctgagctcaggcaatctgcccaccttggcctcccaaagtgctgggnttataggcgtgacaccgcacccagcctcagcagtaatagatacatagatatagatatagatagatatgtagatgtatagatatatagataaatagatatatagatatagatatatagntatagntatatagatatagatatatagatatac

SEQ ID NO: 515355 - DNA, 356 bp, Homo sapiens
gagtaagatcgagcgaggagcccaagagcgagcgcgcaggaatgaagctcgagcggcctccggggcgaccccacttcggcgccgccgctgcgcgggaagatcgcgccgggctccccggaggaggagagcccgggccggcgcggagacaacagcggggataaacgtggcaagacaaaccgcgacggaggcgcctggagcggaaaacgcagaggaggaaggaagccatgaagtgaaggcggcggaggccaacaaaaaacaacaaacaacaacctttcccgggaaaggctcccggacgggagggggccccgcggggtcccccaaaggaaccccgggcgccaaaaaaaacccggggggga

SEQ ID NO: 515356 - DNA, 296 bp, Homo sapiens
ttatcgttgaacaaactacaccctattatataagcggactgcaccatcggcgatgtcctgcatccaacatcgacggtcgtaacaccctattgttgatatggactctcgaatatgattgcgctgtttatccctagggtaacttgtaccgtcggtctatttattggatccattgagaatattcatccgctttgactggtgagatgtcttcgcatgtactgctccgacgttgggttctgctcccaggtcgtcccgagcgaaattttttaatgcatgtttggtactttaggccctgtttg

SEQ ID NO: 515357 - DNA, 239 bp, Homo sapiens
gtgaggcttgacgatcacctagcaggttaggagttggagaccagcctggccaacaaaagaatcagccaggcgtaggtggcacgtgcctgtaatcctggctacttgggaggctgaggcaggagaattgcttaaactcaggaggtagaggttgcatgagttgagattgtgccacgtgcatctccaagcctggagcggtagagtgagactccatctcaaaaaccccaaaacctggcattatc

SEQ ID NO: 515358 - DNA, 226 bp, Homo sapiens
ggcttctgcttgagtcagtcctcacggtgacgcttttccccagcttttccgactactcatggatgtctttttaagaatgccctcctttctcattctgttgcccaggccggagtgtagtggcacaattttggctcactgcagtctcttgcctcccaggttcaagtgattctcctgcctcagcctcccaagtagctgggtttacaggtaatcaagtgaaaaaatgagc

SEQ ID NO: 515359 - DNA, 358 bp, Homo sapiens
aaattttttttgcccccggggtgtggggtgccccccccatttttttttgggggggttcttttaaaaaattccccccccctccaaattttagggggggagggttttctctaaaaaaaaaaaaattttttccggggggggggggcccaaaaatttttcccccctgggggggaaatttttatttttaaggggtttttccccggggggaaagggggcccggcaaaaaaagggggttttttttaccccccccccccaatttccccggggttttttttttggccgtttttttttccccccccccctttttttttccccttttggggggggacccccccccccctaaaatttttttttgggtcca

SEQ ID NO: 515360 - DNA, 768 bp, Homo sapiens
gcatgacaggtgtgagccaccgagcgcacctttgttattcttagtgctttctgagatatagtctcactctgtcacccaggctagagcacagtggttcaatctcacgctcactaccaaccagcgccgcccgggttcaggcaagttctcctgccctgtctcgcgagatagcatgggattacaggtgcctaccaccatagccggttaattcttagtatgtatggtagaaatccgggttatcaccatgttgggcaggcatgagttcttgagcccacgttgaccctcaggtgatctgcccgtcttggcgtcccaaggagtgctgggattacaggagtgggcttgaatcctctgctttaacctttacaggaaaagtaactctgaagtgaccagcgcgccttgggtattctgtctactgtagcctcgggcctcttctgtctgtgaagacccgacactctgacctcgccctcgggtcatgagagcgtacgtctgtgtgatgggaaggaggtgttgcccgatttctagagtaggcaaggtaaatacacaactacagatcttgaaagtagagacacattcgaatgaacatctcagcggtaagacaatttttctgccggctgacgagcagaaaaaaaggtttgccacacccttttggtggccacggctgccatcggtgtgatggacctctcgcaccaggggtgcaaaagagaaccgggaacaaaccgggggggttttcaccaaaaaaaaccccgggggaaagggcgtctttgaaaaccg

SEQ ID NO: 515361 - DNA, 400 bp, Homo sapiens
tctgggctcagtgatctccaaaatgagtgaaatgatcaaaggttacctctccccctttttccttctaaagaagtatgtatttgttttgtttgaggtggagtctcgctctgtcgtcaggctggagtgcagtggcacgatctcagctcactgcaacctccgcctcccaggttcaagtgattctcctgcttcagcctcccgagtagctgggattataggtgcatgccaccacgccaggctaatttttgtattttcagtagagacggggtttcatcatattggtcaggctggtctcgaactcctgacctcaaatgatccactcgcctcggccgtccgaagtgctgggattacaggtgtgagccaactgtacctggctatgaaactcttaaaagaaaacagagga

SEQ ID NO: 515362 - DNA, 536 bp, Homo sapiens
ctgggctcggaattgcctttctctattctctttctcgagacggagtttctcccgtgctgtgacccaggctggtgtacagttggcgcgatctcggctcactgcaagcctccagcgtcccgggttcaagcgagttcgtccgtgcctcagcctcccaagtagctgggactacaggcgcccgccaccacgcccagctaatttaatggtatttttagtagagacggggtttcaccacgttgcccaggcatggtctcgagctcttgatctcaggtgatccgcccgcctcggcctaccaaagtgctgggattacaggcgtgagccaccgcacccggcccggaattgccgcctttagaaccctcacccacccgctgctgagtcttcctgggccccgacaccggaccataagcacaccagaacagagaccatgataaggaacagaccacagcaataaccacacactatacaaaactgataacaacaccgagaacaccggaaagcaacaaatagaaaccagaacacagaaagccaaggagaaaaaa

SEQ ID NO: 515363 - DNA, 1361 bp, Homo sapiens
tctgggcctgcagtttcattggcaaaacccccgaggcaggacacaaagcacagttgtgctggaagtgtgttggggaaaaccgggacagctcagctccgtgccagcagccgcaaaaagccgaggcgtgccaggcccatttaatgtgttcccttcagtgtctctaaattttctcgatcaccacagcctcaaaaattatatatgtgtggtcatggcaaacccctcaagtcctcctcttggcgcggtgttcttggtattcctttctccaaaaccttcaagcgcgggggcccttgggcctcaagccccccgggtcccaggcggtaatggatccttcttctccacaagcaacgcgtggagtgagaggggaactcactccgcggcgccatgcgggcgccacgagggcccgggagaccccactacagaagcgccactcagcgtgagcaactcaagggtctccagaggggacaccgcgagaggtgcgtgggcccaagaggcccgtggagggggggtattatcacaaaccctcttcttccgtgtgaaaattccaacattcagaagggggacacagagatcatccatcactcacggaggggggcatcaacacttgtggcaattgggggcacaaagaaacctcctgggatcgcgcctttgaagggcacccctcacatcgcggggactgggccgaagagagccagaggatcaacgtgtgtccccagggagagctggagacgcgacacaagtgccccaaaagaaagagcccttgcgcccccccatatgacaacctcttcccgacaagacaaaactgagcagagggcaaggggcccgtggaaaaagggcctacagaaatcccaaaaggcgtgggcaagccaaacagcggctttccaaccgccgggaaaaaggcgtcctgagaggggcccgggcacataagagtcacacgggggcgtagcgcggccccccccagggatcgggcccacaagcggccgcaagctggggatcccacgcgggaattaatcccacaaggggggaccaccgcccacgactgtggccagtacgacacccgcacagcggggaaaccccggaagggggcccccagcgtgccgtcccgtgcgggggacacatcatggcgttcccagggacgccacacaccagaagccgacaagtggtccagcacgaaagcacacaacatggggagcactggtcgccacaaggcggcggcgtgccacccacacatgcaagaggcgagaccggcaggacaccaccaaaaccgacataaacaagggggccctgagcaacgcggagaggctcaaacacgccaatcgggaccgccagcgacaggagaggcgcagccccgcgccagctaggga

SEQ ID NO: 515364 - DNA, 156 bp, Homo sapiens
gacccatgtagggaacagatgtgtccctcagtacactaatcccactacgctcccctgaaattattctaagataaactgaagtggctatcaaatctagaggacatcaagcatagtatgaaagcaaaagagtgtcgatattgcaagctggtggattat

SEQ ID NO: 515365 - DNA, 705 bp, Homo sapiens
  misc_feature (97)..(97): n is a, c, g, or t
agctttcaccaaccaagaggcccaacagcttcttctaggtgtaggctcctcgatccgggtgtgccccagaagtaaacgttcaggaagcgccgccaantacacaagcatactgaagaagagacatgaaagaaagagtgtttgtcaccgtgcgacccgctgcagagacaagcgtttgaagaaccgcatccctaggggcaatgcgggcgtgccagttacgggtctggggcacacgtgggagtgaaaggcgtgccgcctcagagaaaaacctgtggatctatgcaagtagaggggggcttgctgcagcagttgaaatacatgcccgggtggagataccccgcgcagtttttgggaaggcgccaactgcgaaggggcgggatccacgcgggagagaacaaggagggcccatgatcaggccgtgagcccaaccaaggggagcaagagcctcgtacattaactcacccgttcaccggggaacttcagctgtgccggtggtgggtggacaacctgtatagtctcaagttaaatttgggagtgctaaaagcatgtagaactaactttgaaactctaggagggatgggggtggctatgtggaaccaagagattctgaaccacttgtacttccagactgggatgagagaaagaaaggaattctggtttggggacaaaaaaatagtgaattagaagggtcccaggggtagttggcta

SEQ ID NO: 515366 - DNA, 722 bp, Homo sapiens
atctatggaaagttgctagcaaagtgcctgaatgaaatcctcttccttaataacagtaattattatggctattgttattatggtatttctaactcattcatcaggcaccattcttattttcttattttccttttctttctccaggcagatgactgattttccaaatgcataatgttcagatctttaaataaacaacacatttttctccaagggtcaatctctctcagtatttgctgacctattccactctttatagcaatgaagagttgggcttaggagataaaactcaagtgggtctttagttgtttgacattgaaggcctactttgtaatcttctttttaaagacatgggaccatcatttccagaggtttcattcaattctttggcaaatgtttagtagcatcgtggttatgagcaatttacataatctctttgagcctcagtttttatatctgtaaaataagggtagtgatgtcttattctgtgcatataaccaggaataaatgagatacctttgtgaaaattattaaataagcagaatgtgagataccattgtgctttggtgcattcatactggcataacaaaatagcttagatggggtaatttaaaacaatagaaatttattgtcacaaattctggaggctggcaagtccaagatctaggtaccagcaattttactgattggtgagaagccctttcctcatagatggtgcgtctatg

SEQ ID NO: 515367 - DNA, 122 bp, Homo sapiens
ccgcgtacagttgcggatagcagttgagtacgcgggatgatgcgggtcttcttgttgtcgcgggcgcgttgcccgcagtccaggatctcggggtcaggtactccagcaccgtgccagataca

SEQ ID NO: 515368 - DNA, 262 bp, Homo sapiens
acaccagcctgggcaacagagggagaccccatctctgcaaaaaatttaaaaaattagctaggcatggtggtgtacacctgtagtcccagctacttggaaggccaaggtgggagggtcacttgaacctgtgaggtccaggttcaagtaacccatgtcatgccctgcattccaggcttgggcaccagatcaatgtcctgtctaaaaaaaaaaccaaacaaaaacaaaaaaccagctccctccaattattttaaaagaaataaat

SEQ ID NO: 515369 - DNA, 1038 bp, Homo sapiens
  misc_feature (33)..(33): n is a, c, g, or t
  misc_feature (87)..(87): n is a, c, g, or t
  misc_feature (190)..(190): n is a, c, g, or t
  misc_feature (224)..(224): n is a, c, g, or t
  misc_feature (281)..(281): n is a, c, g, or t
  misc_feature (293)..(293): n is a, c, g, or t
  misc_feature (301)..(301): n is a, c, g, or t
  misc_feature (350)..(350): n is a, c, g, or t
  misc_feature (355)..(355): n is a, c, g, or t
  misc_feature (406)..(406): n is a, c, g, or t
  misc_feature (485)..(485): n is a, c, g, or t
  misc_feature (531)..(531): n is a, c, g, or t
  misc_feature (545)..(545): n is a, c, g, or t
  misc_feature (591)..(591): n is a, c, g, or t
  misc_feature (623)..(623): n is a, c, g, or t
  misc_feature (643)..(643): n is a, c, g, or t
  misc_feature (655)..(655): n is a, c, g, or t
  misc_feature (664)..(664): n is a, c, g, or t
  misc_feature (676)..(676): n is a, c, g, or t
  misc_feature (729)..(729): n is a, c, g, or t
  misc_feature (736)..(736): n is a, c, g, or t
  misc_feature (754)..(754): n is a, c, g, or t
  misc_feature (769)..(769): n is a, c, g, or t
  misc_feature (790)..(790): n is a, c, g, or t
  misc_feature (796)..(796): n is a, c, g, or t
  misc_feature (799)..(799): n is a, c, g, or t
  misc_feature (801)..(801): n is a, c, g, or t
  misc_feature (876)..(876): n is a, c, g, or t
  misc_feature (905)..(905): n is a, c, g, or t
  misc_feature (929)..(929): n is a, c, g, or t
  misc_feature (932)..(932): n is a, c, g, or t
  misc_feature (950)..(950): n is a, c, g, or t
  misc_feature (1027)..(1027): n is a, c, g, or t
acctccctcccttcccttcctttccccttccanttttttccatactgttccccctcccgccccaccccaggctctcgcctagccctnccctctggggtcactgcgtgggttaggcccccaaaaaagcctaggaaaggagattggagagggctggctgagggtgggtggggcgtctcttcacatttttctnttctctaagcctggggtggaggagagaggcaggnaccaggagcagggagaggtagagagctacggccccaccggcccaccctccccaagtnactttcacagtnttccccanccctggctgccccctgcggtccccaccccagccctgcccctaggttgtnctgtnaggtcctcagcaatgtatgaacctggtaacccagttaagagttcaggcttntttgccatgggcccaccacccacggctgaggaggtggcccctcttagttccccccactattttcaaggctggggttctnagaggacatgggtgggtaggagaggaccagggagagggggcttctnaagccttgtgtaanagttctgggcctggccccacttagagggaccctgctggaatttgcnggggcgccaggttggcttagcccccgacagangctcaggaggagaagcagancccacagcactncatgcaganctctaggcagtncgcggactcgcagcaggaatccaggatgccgcagtacaggtcgcagggcaggncgcagtnggcacaatcgccagagcnacagcagcagcggcngaggcacgagttccccgagcngcaggngcnanaggtggcgcagttcaggacgatgttgcacagcgtcaggtactcgcagaacaggcaggacaggatgcagtggacanagcagttttcctgtgcctgggaggggganctgggaggtggtggatttgctgcngcncttactcttcttgctgcnctggctggagaaaaaagggtgtgtttgcaactcccggtgggcctgggggcaccaagggcacaattcccgcccgtttngggccgccaac

SEQ ID NO: 515370 - DNA, 872 bp, Homo sapiens
tgctgacgccaatgtgctaacatgccttggtcaagggatggaaatgtcaccccgtaagtatggcaatggcagtgaacccacgctgcttgaaggctcgtggactgcatcctaccaccaattcgtcaagttgacaagccctttgtggctgcttctccaggatgtctacaaaatggggggtatggatacctgtcctgttgcccgaggtgacgactgtgtcctacaaaccggggtatggtggtcaccttttgctccagtcaacgtttacaacgggacgtaaacaactctggtcggaaatgcaccatgaagctttagacgtgagggctcttcctggggggccaatgtgggctacaagtgtcaagggaatgtgtctgcaagggattgtccggcggtggccaactgtgggctgggtgaccagcaaaaattgacgccacccattggaaggcgacgtgggttcactggctcaaggttgattaatccttgaaacaaatccaagggcaaaaattaaggcgcggatatggccccttgtattgggattggccaacacgggtccacatttggcagtgccacgcttgggtgagcgtggaagggacaacgcattgaaccgcgcgtctggtaacgaaagctggaaggagtggcctaaatacttgaggcggggtgatggtgccattggtggaattgctcctgggaagccccagtgtgttgagagctccagactatcaccttgggtgccttgctgcggaattgagacaaccgtggggggtgtcaccaagcggtgcagcagggtgctgctgcgaggtacagttgtccaaactgaagctaggattaactaaattggacccttacggtgacaccaacgtgtgctggcagtaggg

SEQ ID NO: 515371 - DNA, 861 bp, Homo sapiens
  misc_feature (9)..(14): n is a, c, g, or t
tccactctnnnnnncctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgttgtggctcgatattataagaccaagcgagtcctccctcccaagttggaaatatgaatcatctacaggctctgccctggtcgcgataagatttgtctgtgtactcaagcaataaaatgattgtttacctaaaaggaacattgtcaaggaaacttgacggtaagccaattaggaacagaactgacctgcgatattaggactgtactattccctttttgaactggtctcatccgctcttccttgaggatgaatccaggtcatttccatacgcggcaatgttccagtttctaagacattgccagagctctatgaggttagtgaacaactattcagcctgaggtactgaggtcggatggtgacggagaccaccggatcaatactgagacgcacaggcttctgagccaggaatctcactgaaggccaaggtaacggaacacgaaatcaccaatga

SEQ ID NO: 515372 - DNA, 870 bp, Homo sapiens
  misc_feature (138)..(138): n is a, c, g, or t
  misc_feature (142)..(142): n is a, c, g, or t
  misc_feature (792)..(792): n is a, c, g, or t
cactacctgagaagaaaaggaataactagataacattgacaaacatctgctagtttgtgtatgctcagattcactcagcacgcttcgtaaaatatcacagtaacgtcacaactggtgaacgtccgtctattagaaacnagtnggtcaacaatcaaagcttcgttccatttcgctgtatcaagagcgtatctgtccaaggacagtccgaggctgtgtcgagcctcccgtcttcggtccaaataatcaaaagcattggatagatttgtttccatctgataacgatactggtgctgtgtatgcatggggatactcccgtacttgatgcgctgtctagctaggcaggacaagcttccatgcgcattatcacgcgttagcactgctgcatcttagccaggatagggttaatgtgtactgtacgctggtgaatgtattgccaggccatctcgcgaatgtgagatcgcacgaactctttgtattgccctgttgaaataacgagacagcacaagagaataaaacaagtcatatcgttattaaaaagataccggacccccagggaataatggtggttagggccaggttctggcgccttgcgcagtggcagttggtataacctgtgtattcaaaggatgttcacgaggggaagtaattattttgagtgtggaaagcaggaatctaggcagaagaagataagtgttctaatgggttagagggaaagatttacgtctatgaagtggggcgagcacataaatgtgaaatctgtactacagagcattgaaaatgctgtaactactnttgcagatcatcctaatctctcgttaatttaaactctgggtcgtggaaattggtccctttaagaattgggtgccattg

SEQ ID NO: 515373 - DNA, 354 bp, Homo sapiens
  misc_feature (9)..(14): n is a, c, g, or t
tccactctnnnnnncctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaggactgccctcacttccaaggcttacattaataagaacgaggtcgtcggaagacttgagggcaagaggaatggcgaatctcg

SEQ ID NO: 515374 - DNA, 368 bp, Homo sapiens
agttcaggagactctcagaggtagaatcagaaattctggtctgcttagcattatttgtcatctctttagtgggcatattgtttagatttactgattctaacctctgggtagctccatttggtacgtttgttttgttgttccggccaaaaaataatgtgcgtgttgcctggtgatagcatgaacttttattgcagttacaagttgtctacatgaagtgtggaggtgtgtgaactgtgtgaataagcagagtggctggttggacagagtgatgtccccatggcctaagcggacacagatctcggccccgtgggtcttcccatcactgccctcgctacgactgaaaagaagcttcccggcaggcgtgtgtt

SEQ ID NO: 515375 - DNA, 386 bp, Homo sapiens
ggcacgagtgggatgacagcgggaacaaagcggcgtggaaaagaaacagcgtgattcaagatgctgcggcgaccagaagcgttggggactgatgggtctctctgctccagttcaaatcctcctgaaacccttttcattgtcctgattcagtgggtttttaaaaatctcccctctgttttgccaacctaattttcaagtagcaatttatcttatgaccttgacaaagttgtgtgactttacatttaagataataattagaacagctccctttagagatcacagtttgctactgcctgtctcttaaagactgctcaagtctgtttctgattcatcatttagaattttgtttcaaatgtttctttttggggtctgttaccttctggggg

SEQ ID NO: 515376 - DNA, 891 bp, Homo sapiens
  misc_feature (230)..(230): n is a, c, g, or t
tgacaagccagagagattcgacagtcagccttgtgtcctgggatgggagagcttcgcctcagggaaacattactgggaggtggaggtggaaaacgtgatggtgtggactgtgggggtctgcagacacagtgtctgagaggaaaggggaggtcctgctgattcctcagaatggcttctggagccctggagatgtttggaaaccaatacgcgggccctgtcctacccactgnagaggattctccctcttgaaggagtccctttgtccgggcagggcggtcttccttggactatgaaggctggagatgtctccttctacaacatgagggagcagatcgcacatctacacatgtccgccgttcagcctttagctgtgcctgtgtaggcccttcttcaggttagggtctgatgacagacccatcttcatctgccctggactcacaggagccagtggggtcatggtgcctgaagagggtcctgaaatcttcacagaggtggggacccagccatagcctatagaatcaattaccttggactcactagcgcatgcagataagcgcctgggccatctcagtagacagccgaacaagcccgcctaatgaaagtcacgccctcctcccctcgtggtctacggtaagagaacgatcttccagttgccgtttttcacgacccactccagccctctggccacagttttgctccctcctcactaatctgtgcgctttagatagcttcctttgggcgtggtacccatgggatgaggacccacgcaatggggaactagtggttgcatagcctccccagttcaacagacacgtgagaaaagaccgtttgggcgccaacctacggttacaatccggataacccctttaggccattgtccttgggccaatg

SEQ ID NO: 515377 - DNA, 872 bp, Homo sapiens
tgggttagagcacgggatacttaatgggatggtccatgaacaaggttgcggttccctaggcccctcccctcttacaaggggtctacatggaaatcggtgaggagggaaaatccagtgtggtgggggactgattgtggcagggactccccagcagtgagggtctctctcttcctcttgtgctcttgctgggggctggtggcccagggtcttaactccttggaggccatgtggcccatgaggtccaccaccctgttgctagtagccaaattcgttgtcatataaccaggaaatgacgcttgacaaaggtggtctgttgagggcaatgccaagccccagcgtcgatggtggaggagtggtttgtcgcttgtagaagtcagagtgagaccacctgggtgctcagtgtaccccatggatgcccttgagggggccctccgactgctggattccaccaccttcttgatgtcactcatattgggcaggttttctaacacggaaggtcaggtccaccattgacactttggcattggggacacgaaaggccatgcagttgagtctacccgacagttacagggaatgcaccttgccccaataggcacttttgagcgcccagatcgaggtcgcagggattgactgatccttgaacaaagccccgcgtgcaatcaaggcccaaaagttttcccggaggggccccatccccaagtcatcctggggtggcacgtgaatgcgatgggccggtggactaatgaatcctccacaaaaccaatgttagtcatgcattagcctgtgccacgtgggtacaacatctgtgtgcaagagcctttacggagaacattgacgcctaaagcaaatatatcagggtccagcatgacaca

SEQ ID NO: 515378 - DNA, 1321 bp, Homo sapiens
gagctggtggtgctgctggagctgcagtgagctgcctgcctgcctggatccaatggggtgcagcactgcttccctgggagctgcccccacctcctctccggggcctgcctgcaggctcggtgagctggttttatacccgtcccgtgcctggcatgtgctaggtgctgctgcatgtggtgctgctgagccccccgcccgtgctgctgcatggctatgacaccagtgtggcaccgtgtgcttgtcccctgtcatacccatgcatacctgggaatggctcactggcgtgttgggacgtcgattggcttgcgtgtccgaccggtgtgtgccaactaataaccggccctgttacgagataccattgcaatgaacgcagcccgaatggaacaaggagaagctctgaagggctgccaacttcccaatcaagtcttccggtggcttgcccgttgcacaacgaaggacatactggtgggccccggttggttccaggggcccagagaaaagaacagacaagcttcccagaaggaacatgggttgacaaaggcccaaagcagcccaggcgtaacccgaggacacgagaaacagtcagctggccaacccgtcgcaacgagaaggtgggacggaaaaccccttagaccacggacaacgcttcacggccatcggatacaagaggtaggccagcacccacaacacacagttgagatgaccccaacaagaatttgaccgtgggcccacccgagagagcgacacccgccagagacgctgggggcagcccgaaaagaccaccaggcgcacgttggcgaagaccacgcgcgccatggaagccccaaagcgcccaaagggacgaaccctaccggagagaggaatgtacccccaccgaaggggacaagatccaggcgggcggatggcccgatcaccgcgtaccccacctatcagaaaggaggtcagaaacgcggaaaaatgacgtagagcccgcaacggtaaccgagcacacgccgatagggcgcacccgtggtacaagacacgccgataccactaggcaagtgcggggggaaccgggagcgccgccagagataaaggcaccggtggaagggtcacagagtacctggggtgtcgaccaaacatgatggctcatggtgttcaccacagacgcacgagagggagttggactcgccatatggacatgatcaaccagcgcggatatgccaaccatttcgggcgtgagtttgtaccacagttactaagccagttcacctgtgaggcgccgcaggccacctgcagaagtctatcgactttacacccaccgggcccgctttcggacacg

SEQ ID NO: 515379 - DNA, 807 bp, Homo sapiens
ggccatatgccaaaacctgtactaaatgcctaattggtatggaagagtgcatatttaatctcttttctatactgctcctttctgatgcttatcctttcatctgtgtgagtgtaagcccctctactaacaagatcctcccagctttctctctacatgtcgaaaggataacatttctcatgaacccactgcccctcatgcatttacctcacgtggttagcagatcacacgtaacataggatcagaatatgctgcgtctcccctgacacacacttcctctcctcgaatcgagcaagtctccattcagattcagcaaagatcctgtcctcctcttctgcgtcctcacccatacctagaggccacaaggacatggtcttccactgacctgactcaatgcttaactcaagccacagtcaggcacctcagtttcatggaagcctaaacaaagcgtggcactagacactaccacactagacacagcagtagtcatagtctcacaggttaggagctactggaccaaccatcctgtctctccgctctcagtcccctcaacctcagtcctagtccggagctaaccgtggaagcagcccaaacagtagcctggcatcgttcgcattcaccaccagggggtgaactcgcccatcaggctgcgacatcagacaaaaagctcgacacacccggagtcggtatgtctcgtccaccaccgacctggcgctcaacactccaggccgcctgtccgacaagcacatcaaaggggctggccaacatcaaaccaccacacgacgatacacgacaggcaccagcagcccg

SEQ ID NO: 515380 - DNA, 589 bp, Homo sapiens
  misc_feature (56)..(56): n is a, c, g, or t
  misc_feature (58)..(58): n is a, c, g, or t
  misc_feature (73)..(73): n is a, c, g, or t
  misc_feature (75)..(75): n is a, c, g, or t
  misc_feature (79)..(79): n is a, c, g, or t
  misc_feature (84)..(84): n is a, c, g, or t
  misc_feature (87)..(87): n is a, c, g, or t
  misc_feature (97)..(97): n is a, c, g, or t
  misc_feature (99)..(99): n is a, c, g, or t
  misc_feature (101)..(102): n is a, c, g, or t
  misc_feature (112)..(112): n is a, c, g, or t
  misc_feature (118)..(118): n is a, c, g, or t
  misc_feature (140)..(140): n is a, c, g, or t
  misc_feature (142)..(142): n is a, c, g, or t
  misc_feature (169)..(170): n is a, c, g, or t
  misc_feature (184)..(184): n is a, c, g, or t
  misc_feature (187)..(187): n is a, c, g, or t
  misc_feature (190)..(190): n is a, c, g, or t
  misc_feature (195)..(195): n is a, c, g, or t
  misc_feature (200)..(200): n is a, c, g, or t
  misc_feature (223)..(223): n is a, c, g, or t
  misc_feature (227)..(227): n is a, c, g, or t
  misc_feature (231)..(231): n is a, c, g, or t
  misc_feature (278)..(278): n is a, c, g, or t
  misc_feature (293)..(293): n is a, c, g, or t
  misc_feature (305)..(305): n is a, c, g, or t
  misc_feature (329)..(329): n is a, c, g, or t
  misc_feature (353)..(353): n is a, c, g, or t
  misc_feature (389)..(389): n is a, c, g, or t
  misc_feature (476)..(476): n is a, c, g, or t
  misc_feature (497)..(497): n is a, c, g, or t
  misc_feature (535)..(535): n is a, c, g, or t
ttcaaggaccaccttagggttacctctgtggctgtaaaaggttgtcaagtgtcctncnggttgtgcgagccangnaacnatggnaanacttcattgncntnntgcttacccngagtcnaagaccccgttacccgccaccntntcaaaatcgggaaacacattccggccnnaggtccacctgttnccnccnccgtngaagnagttggccttgaacaagttggtnacgntaangtgcttggcacgcggtttaagccccaagaacgtgttggttcgttggntgcaggggtcacagnagttgccccgcnaaaagtacttgatttgggcatccnggcaggagcccagccagggcaccnccacttttgttgtgaccagaatattgggggtggcanccaaggattgaaaaaagggggaccctttttcttgaatggtgggccaaaaggccctgccgttggctttcacaaaaaagaccatggacngtttggggggtaaacccaccnatgtcaatgtgtttttaatgggggaggtggagggcacntgttattgagccgcccgcttgtccccacccttgaataaattccatgttccccca

SEQ ID NO: 515381 - DNA, 1049 bp, Homo sapiens
  misc_feature (213)..(213): n is a, c, g, or t
  misc_feature (867)..(867): n is a, c, g, or t
  misc_feature (869)..(869): n is a, c, g, or t
  misc_feature (871)..(871): n is a, c, g, or t
  misc_feature (884)..(884): n is a, c, g, or t
  misc_feature (903)..(904): n is a, c, g, or t
  misc_feature (907)..(907): n is a, c, g, or t
  misc_feature (938)..(938): n is a, c, g, or t
  misc_feature (949)..(949): n is a, c, g, or t
  misc_feature (952)..(952): n is a, c, g, or t
  misc_feature (959)..(959): n is a, c, g, or t
  misc_feature (1004)..(1004): n is a, c, g, or t
  misc_feature (1027)..(1027): n is a, c, g, or t
  misc_feature (1048)..(1048): n is a, c, g, or t
agcgggagttgtaggcctccggcgtcagcccgcgggctgccgcccgcactctccaagagactgctggcgccggcgcccgcccgcgcggaccgacgcgggggcgcgcttcgcgctgactcagcggcggcggcggctgcggcggcggcggcggcgttagccggccctcgcgctctttcccttcctggggcgccgaccccgcccgcttgcttgctngcttgcttgcctgcctgcctgcctgcccggcgccacgcaagagaaggtgccaggggacgcagagcgactagaggcgcgcggtcccggccagcaccgtctctggcgttgtagctgcggccgtggcggaggactacggcgacaaggacgagggccgctctcccagctctctgcgtgccgcgccgctccgctccgctggctgaccatctggagtgcaggctgggaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgccaagtcttcgccttgctntngntacagagtatctnactaagtggcccaagtttnnttngacattctctcagtagtggacctaaatccanggggagtaganctntacctgngaatctcatggctattgattaaaatttggtggatcgtgatgtggngcattcatcagaggaggctcganggacactttataaaagaaccnt

SEQ ID NO: 515382 - DNA, 1146 bp, Homo sapiens
gtgcaaatatccacgaagaggaagtttgtcgactgatggcatctccaaagctgtcctgattgagttgcttactacgggaggctggtctgagagatggcctcactctggaagcttcgagggtgcggagttacacctaaaccatggactagtaagatcatctatcttacgtccgagccagaaacacaagaagtgtgctccggtgtagacgggccgggcgggatacgggaactgactggtgtagctgcacaaagatggtttggcttctccagtacgggcagatggtataagctgtgtattgctgacatgagggctggccgcttagaaggatctaggtgtcgccatgttgtccatggcatgacgctcatcctagcggttagcataactccgtaagaagggcttcgccttgtgtcggaagagtgcctagcatattgcgttgtggcgtgcagagttctatctctcggaaggaggttgtgcggcactagagagcctagcggagtggtggttggtgctacttgagtgatacacttcccgcaaggacagatggagcttaaaagtccccattgacaggggaagagtggagcctctgtggcctcgtatggaattcacaaacaatgccggagaacgagaccccttttgggtagtaaaccataaccattaaggcgctacgaaaccaacgttgcattggtagaccgacacgggcaagtagttcgagggcgtaccaagtacccagggggtagttgggcttagtgcgtcaattgctacatggcgttggaacacgaaatgcaatggcctgtgtcccccattgcgaggaaggcctcgaaatccgtagagttaaaagggaattctgtgagagccacgttaaaaggacaatggctctcaattggggcgcattggaagggcaccagagcaggtttggcacggcgaaatttggggagttgggggaataatcaccgcgagagacgtaactgtatggaattaaccgttgggtgtctccaaaaccttaagacttcgccgcaagtttcattccaaggagaagacccatgaaaacaggcgggcgttggggagaaaaaaggcccaaagaaaagggctccggacgccattggccccaattgggtgccacgccaagggcccaaagtattcatcccc

SEQ ID NO: 515383 - DNA, 331 bp, Homo sapiens
  misc_feature (194)..(194): n is a, c, g, or t
cgtgctcaactgtaatcccagcacttggggaggctgaggcaggagaatcgcttgaacccgggaggcggaggttgcagcgaactgagatcggtccactgcactccagcctgtgaacagagcgagactccgtctaaaaacaaagcaaaaaaagcttctggactcattaaatataggcttgccatttcccctccccngcgaaaccactgttctactttctgtatggatttggctaatcgaggtacttcatatgagtggattcatatagccttcgtcttttgttcctggcctatttcacgtaacgtcatgtcctcaaggttcatcggtgttgtag

SEQ ID NO: 515384 - DNA, 1121 bp, Homo sapiens
  misc_feature (939)..(939): n is a, c, g, or t
  misc_feature (941)..(941): n is a, c, g, or t
  misc_feature (943)..(943): n is a, c, g, or t
  misc_feature (956)..(956): n is a, c, g, or t
  misc_feature (975)..(976): n is a, c, g, or t
  misc_feature (979)..(979): n is a, c, g, or t
  misc_feature (1010)..(1010): n is a, c, g, or t
  misc_feature (1021)..(1021): n is a, c, g, or t
  misc_feature (1024)..(1024): n is a, c, g, or t
  misc_feature (1031)..(1031): n is a, c, g, or t
  misc_feature (1076)..(1076): n is a, c, g, or t
  misc_feature (1099)..(1099): n is a, c, g, or t
  misc_feature (1120)..(1120): n is a, c, g, or t
gtagagagatatatttataccatacatgacaaagaatttgtatccagagtattttaggaactataaaagctgaacaataagaaaataccatgattaaaaatgggcaaaagacataaacagatacttcaccaaagttcaacatcatttgccattagagaaatgcatattaaaaccacaatgagttagccatcatagaagtacaagtcaaaaccagaatgaggtaccaccttatactcactaggatagttataacttcaaaaagatagataataacaaagttggagaggatacaaagacactggaaccctcactcactgctggtgggaatgtaaaatagtgcagccactttggaaaacagtctgacagttactcaaaaggctaaatatagagttattacattatcctgcaattctactccgaggtatatacccaaaacaataaaaacatatgttgacataaaatcttgtatctgaatgtccacagaacactattcatgtaggggtttcctttcaactttgtttatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgccaagtcttcgccttgctntngntacagagtatctnactaagtggcccaagtttnnttngacattctctcagtagtggacctaaatccanggggagtaganctntacctgngaatctcatggctattgattaaaatttggtggatcgtgatgtggngcattcatcagaggaggctcganggacactttataaaagaaccnt

SEQ ID NO: 515385 - DNA, 162 bp, Homo sapiens
  misc_feature (152)..(152): n is a, c, g, or t
caaagctggtaccgtcagaaatgtactggatcaggagggtacaggcttagacactgaggttgaggaaggccacttacctgtccagactgttcttatctaccccccaacacccaaccacccacctatcatccacccacccataccccccacangagagagcgt

SEQ ID NO: 515386 - DNA, 280 bp, Homo sapiens
cacgttggctgacgtggtcggacgcggcggcagcgtcgcggcttgagccgggacgaggcgttgcgcttggcgctcgaggacgtggcggattgcacgggcctgtcgtgctgccagttctgggacggcaccggcgtcgtcaagcgttgggcggagacccagcacagccagggtggcttggtggtacagccgccggcgctctggcaaatcgaaaaggatgactggacggtcccttatggccgcatctacttggccgggggagcacacgcgctacccgcacggt

SEQ ID NO: 515387 - DNA, 1257 bp, Homo sapiens
  misc_feature (1257)..(1257): n is a, c, g, or t
cgtcgcatgagcgcccccaagaacgcccgcacgctggtgtcggccgagtggatgcacgcgctcgtggacaacgatggtcctctacgaccccgactgcgaccccgagggccgcatatgcgagaggcgctgccatgttgtcaatccaggagcgtcggctgtgctcggtagcgtgcaagctcgtgtagaggcgatagcgccgcacgagacaagggcgacctgagcctacgctgcgatgacgctggttgcagcagcgccactcagcatcctacatttgagcctgcggccacacgagcgccatccgaccctggcgacctttcaaaccaactacagaccccttgggacgcccgatggctagaagagcggagctcattaccgacagagccgcttaattcgtgctggcgaccccgagagattcgatggacggccggtggcacatacgtagcagttccaaccagtccagtaatcgagtcatgctgtgcagtaacagcgtgtctcaccacaggccgccggttgacgtggaatctcggcgcatagccgcctaactaactatcgcagagaggacatcaaggggcgagtctactaataccagggccgcgggcgcgacctggacttagcgcgtagcgctggagaacccctgcaggtggcacgcagcacgcgacatctattaacacataggcacgagatttccgcccgaaagttctaccatgaagcgccttgaccgacggcgtcatacggcggaacatacgtggtcggacgtagagtggccctacgtcgaccgagacttggaccgtcctaggagatccacaaacaggacacaagtccgcggaacggtcacaagaaagggctggaactccagggaacaggggcgcacctgacgcaccgggaacaccgagcttcgacagtaccccggggggtcacagggaaagcggaggaggacaccagaactacggaacggacccagagagaaaagagaagcaaccaccaccgaaacacacagagaggggaaaagaagacacaaaacaaaacgggagggacgcagcgcaaagagggacgaaccaggctaaaacagtaggcccagggccgaaagcccgaagtgataccgagcgaagagaagccccagcggcgacagcgacaaatgagggcacagagaggacaatccacaacaaaaaaaaacggacaccaacggccccgagcgaggaaagcagacgcacaaaagacacgcaagaggagcgcgaagcaccacgtcttcaccctaan

SEQ ID NO: 515388 - DNA, 1266 bp, Homo sapiens
ttggtgccgtcgtttgatgttgtttggtgtggtgcttcgttgttctctgttttgggtgctgcgtctttgtgttgttttacggttttcctttttgtttattttgtttcttcgggtggtgttgtttgtttgtgtgtgttttttgtgtccgcctacgctcgttgatggggtttttacttgttggtttagtggtggtttttttttgtctgggggggggctttgttttttttgtcggattgtgtgtggttttttttttttttttgtttttcctttcgcttttgtgtttgtgtgtttgttgttctgtctttttttctggtttttgttagctctccttgcgggtggtttttatatgctagctgttgtgttttgtgttctttttcgtggtgaggtgtctttctctttctggctctttttcttctgctgttgtttttggttgtggttttttttttgttctcgttctcgggagagtgttgtgtcgtctttctctctcccctctcctgcgctcgggggccccgtttctctcttctgtgttgtgggctccttctgtttgttctctcttgtgtgtttctgccttcgtgttccgcatagtgtttggtttttttggggggggtgtgtctttcttttgctggttttttgtttccccaccctcgcgtttttcttcttctcacaccgttgttcggcggaggatctctcggggcgtgctgttttggtttgtggtgttggctctctcttcttttttctttttccacccgcgcgcgtgctttgtgttttgttgttgttcccaccctcttggttttattaatatatgtttgttcttctgctttggtgggttgtttggttggttggtgtcgtccccctccccccggcggtgcttttcctctccccccctctgggtgtgtcctttttcctccccacccctctctcgtgtgacaccctctttgtctttatagcgctcccgctcgctctctcctcgtgcccccgccccctctctgtgtgagtgtgagtcgtttttcttctccctctttctctccctctcgcgcgcgggtttcttgtcccccctctctctctctcatcaccccccccccttttctctcgctcctccgtgcgcgcccgcgcgcggctcccctctggggggccccacacgaggggtttttttataaaataaaataaaaggaggaatgaggagggtgtaataataaataatatataaaaaaaaaataaaataaaatataaaaataaatataaataaaataattaattaaaatatac

SEQ ID NO: 515389 - DNA, 900 bp, Homo sapiens
  misc_feature (33)..(33): n is a, c, g, or t
  misc_feature (310)..(310): n is a, c, g, or t
  misc_feature (317)..(317): n is a, c, g, or t
  misc_feature (338)..(338): n is a, c, g, or t
  misc_feature (344)..(344): n is a, c, g, or t
  misc_feature (361)..(362): n is a, c, g, or t
  misc_feature (364)..(364): n is a, c, g, or t
  misc_feature (382)..(382): n is a, c, g, or t
  misc_feature (425)..(425): n is a, c, g, or t
  misc_feature (467)..(467): n is a, c, g, or t
  misc_feature (562)..(562): n is a, c, g, or t
  misc_feature (564)..(564): n is a, c, g, or t
  misc_feature (585)..(585): n is a, c, g, or t
  misc_feature (587)..(588): n is a, c, g, or t
  misc_feature (591)..(591): n is a, c, g, or t
  misc_feature (593)..(593): n is a, c, g, or t
  misc_feature (598)..(598): n is a, c, g, or t
  misc_feature (607)..(607): n is a, c, g, or t
  misc_feature (609)..(610): n is a, c, g, or t
  misc_feature (616)..(616): n is a, c, g, or t
  misc_feature (618)..(618): n is a, c, g, or t
  misc_feature (621)..(621): n is a, c, g, or t
  misc_feature (623)..(623): n is a, c, g, or t
  misc_feature (629)..(629): n is a, c, g, or t
  misc_feature (634)..(634): n is a, c, g, or t
  misc_feature (638)..(638): n is a, c, g, or t
  misc_feature (665)..(665): n is a, c, g, or t
  misc_feature (673)..(673): n is a, c, g, or t
  misc_feature (754)..(754): n is a, c, g, or t
  misc_feature (762)..(762): n is a, c, g, or t
ccttatagcggctaagtgtattaagttgaatgnaacgatggtaatattaatttgtttgaactgaggcccactactgattctttgacaaattgaattcttatatttaaataattttatgggaatgttccatcataatttctaaatcatttatatatcaaggtagccttaatttgtatatgtttcagtacaatgagattttattgcctctgggatgctgtttagtttgtattttgttgaacgtttttatcctaggaagagaaacccatgacttgtgtacctagatcatctgccacattaaaaagccgctctnccagcanaagagctataaatgaatgccnccttgncgggaaacaatctaggnncnagctgtatgagctatgtntattatggtgctaatgttcagtagccacacttgactaatgccnccattctctgtgatgctgtggctagcagcagagctcgccagnccatgcctggacaaactgccagggctgggcccgaccagctagctcctttggggttgagtccgtatctttttgatggggaagtataaagcaagtancntgatttctaaacccagcaatntnngantngaccnttatgagtnannactttngnagntnttaaangcctnggcngtcatgatttcaaaccaattaggagcnccaagctnccttcccaggtaactgttgggagcaatggcatcactgtatgcccttgtaatggctggaagggacatgatcttgtaagtagnaaagctgnaactaaaaattgtattgtttgcttattagccatgtatctcttaaaattttgttatgtttacaacgatgtaccttattggctcccagttattagcttcatgtttaaccatagtgccttagtaaaaaaattttgcccctt

SEQ ID NO: 515390 - DNA, 396 bp, Homo sapiens
tcgagtactggccttaagttatctgcctgccttggctctcaaagtgctgggattataggcgtgacgcacggccagccacagttgctcccttctttaattgaacttctgtggcacttgtatagacagtgtctatgggaactctcaaatgtgtcaccacaaaatctatatttgaaagatttccagactattgttctagagctaagttttaattatacacatctatctgtatcgttaaaataaaaagtttaaacaacttaaatttaaccagagtttaattgagcgaagaacaattttgtgaattggggttgctcccaaggcagagtaataagctcagagagactccagtgcagcccacatggtggccgcatttctggacagaaccgggaaagtgatgta

SEQ ID NO: 515391 - DNA, 776 bp, Homo sapiens
tcgacccacgcgtccgacaaggaggccttgcggaaggaggatgatccgctggggagaggagaaacgccaggctgacccaggcttctttggcaggaagatgtggagggcatctcccagcccatctggctggtgagtgacacagggagagtgtgtgacatcgcacgtgggtttcgtgggacggcgcgtagtggggccggtgacggccatgagctggtccggcggttgtaacggtagggagctaggaagcgcgacaggcaagcggaggcttgggggtgttcgacgccatggggtggactgaatgcgtgaggtcagaagtgtggccatggacatatttcggggactttgacgtgggtctatgcggtaaacctagtggagttgaacagcggcctggaggagcatgttggagaaccctgaatagaagtgaattggcggctcccgagaccgtttagtatcagtatggttccgtaaggaggtgaagccatggggcgcgtgctgagggtgggggtggggctgtaggtcgtgtcaacacctgggggtgtcccccgcagatcccgggcacggaagtgagggatacagacacgggggggtctaaagattgctggaagggggttcagggcgatattgggcaacgcaaggaaatgctcctggagacctcagttgtccaaccagtggggcaacgaccaggcatgcgctttgcaggaggagactcccaacggggccaagggaggcggtctggggtgagctcgaaacggcaaaacccttggatatcccccagg

SEQ ID NO: 515392 - DNA, 137 bp, Homo sapiens
acgtgattgctccacctgttcttggatcgatgtaggtccggaacgccaccgtctgccccaagcaaatataggatgacctctgaacgggcaccctccccttcctctagactgggccaggatccttcacagtctctgct

SEQ ID NO: 515393 - DNA, 655 bp, Homo sapiens
ctctctctctctctctctctctctctctctctctctctctctctctctctctatctcactctcaaagagccgaataagcaaccaggagaacacacggaaaaacacccgtaaccatgcaggtactataatcgagaaatacaacacacaaaagcgctcataaaaaagtacatgtgcgtaaacctatgagccctaaccactcattgaggtggcacagagacagactgtatatgccaatggctgtgtaacagtgactgaatgcagacacaatagcaaatacattggtgatctaatgcagacttaaaaacacagaagcacatatgctaagtacgactctcagaaccaaaagcacaaatgataggtgccagcaccatgatggaaacacatatagaggactccagataatcagcgtgaaactgaaggcaagtgatctcgatataaaatttaacagatgatggaaatgaagaggcgcagagacttacccaatgtcacagacatccagcgctagagctgcccgacacgatgtagaaaccaaacactacaagcatacaggtggaaatgcgaattaccatgggagtattggggcctaaactcaatgccaggatatgaaatttggacctatcggcggacagaccggatgcgactatgacatcacatc

SEQ ID NO: 515394 - DNA, 376 bp, Homo sapiens
  misc_feature (4)..(4): n is a, c, g, or t
  misc_feature (84)..(84): n is a, c, g, or t
  misc_feature (122)..(122): n is a, c, g, or t
  misc_feature (159)..(159): n is a, c, g, or t
  misc_feature (184)..(184): n is a, c, g, or t
  misc_feature (221)..(221): n is a, c, g, or t
  misc_feature (224)..(224): n is a, c, g, or t
  misc_feature (234)..(234): n is a, c, g, or t
  misc_feature (255)..(255): n is a, c, g, or t
  misc_feature (269)..(269): n is a, c, g, or t
  misc_feature (271)..(271): n is a, c, g, or t
  misc_feature (275)..(276): n is a, c, g, or t
  misc_feature (304)..(304): n is a, c, g, or t
  misc_feature (375)..(375): n is a, c, g, or t
tctncttctaggtgtttgcacccaactcatggtgctgggcaattgagaggagaagcattacaaagggaggctgaaggctcatcnctcagggaaccggagccccccagcctgtggggcttgtntcagccctgaacagagggcagaagttcaaggggactnaagatgcaggtagttcccaagtganctaggagtccccagagctggggggttttgcctttatnggncaaggtggtngacaggaggattcaaccccancatggaggggggantnggcnntctccccaatttggcccctctaggtcanttccacgttgttagcacggtcaaacactcgggagccacgggcactacccccaagctggaaacggctctcana

SEQ ID NO: 515395 - DNA, 987 bp, Homo sapiens
ggattcccgtcgtaacttacagggaaattttgcacaactgtccggagccccttgatgtccatgcaaatgaaggaggaggatgtccttaatgttgccttgtcagccaggaacccacttaggtggcaccgagatcttgactttccagatggaacagtatcgatctataaacaaggaacacatgtgatggcatctatatcataaactctcaagaggacctgggaagacaagcgtatctggctggcagcgtcgtgcagagttgttggcattgaaaacccatgacatgattgtcagtgttagttagtccttccaggaatactggccagagggcatgtgcgtgaagtttgctgtgtgcgcactggtagccagtccaattgatggcgcgcttcgaagtcctggaacctttcgacctaagcgcagatccaggcagccttcgcgggtaggccacggacttctatgtggttactgaccccaggaatgaacaccagacctctcaccggaggtcatcttatgttaacctacctaccatgtgcgactgatgtaaatacaggattctccttctgcgctatgtggacattgccatcccatgtcaacaaacaagggagctcactcagtgggtttgatgtggtggatgctggtcggggaagtgctgggcatgcggtgtaccattttccgtggaaaccatgggaagtcatgccggatctgtaagtcgtaggagatctgaagagattgagggaagagcaggtgtgttgaaaggcgtgacaaggggattcggtgactggcggtccggtctgaattactggtatagctaagttgggatgttgaaggtttcaggtcctctgggtatagaaactaatgaaatgaggcagtgcggaaaggttgtgtcctgttggtttgttggtaactggtggttaggtgtagctaaggaagggtgaaaaactttaaaaacggtttgggaggggaggagagtacatataaaggttggttagg

SEQ ID NO: 515396 - DNA, 196 bp, Homo sapiens
  misc_feature (128)..(129): n is a, c, g, or t
cccgcatcggcgtaggcgtctgggcgacgtcgggcaggttcagcaccgtgatgtagcgtgcgccgtggccaatcagtgaccggacgttttcagccagttccgtgccggcttgtgcatggcttgaacgnnctgggcgttggtgatggcggtgctgttgaccgcgttcaaattgggatgcgggttacgccgatgcggg

SEQ ID NO: 515397 - DNA, 641 bp, Homo sapiens
ctttaagccgcgtgcccgcctccagctctcgtgggtcggctccatggaggcgccctcacggagaggggcgggcgctctattccagagaccgagtggcagtgctggccactgtgtgcggggctctttccccgtttcgcctctagctacccctcagctccggtagtcgccatgctccggggtcgtcgccgtttgggtgcgggagctgctcgggcccgctctgtcgtctcccgtcgcctgcttccgggtccaggcccctcggtgccgctcgtgctcggctgtcatgaggctgcgtgttgcggcttctggagcgtacctggccgctggaggtgcccgagacggagccgacgctggggcatttgcgctcgcacctgaggcagtcgctgctgtgcacctgggggtacagttctaatacccgatttacaacttacattgaactacaaggatcccctcactggagatgaacgagaccttgcgcttcatatgggattgttcctggggacttgatagtgttctgattcttcaagatgacattccagcgcctaatataccttgatccacagattcagagcattcttcagtccagaataatgagcaaccctcttatggccagcagctccaatcagactagcatacaggatgaa

SEQ ID NO: 515398 - DNA, 110 bp, Homo sapiens
cgtttgggatgcaacgatgaggctgctgtaatttgtggtatttgctctatttgctttcactcaaacagaggaagagaaccaatgcttttgactttccaaatcacttgctg

SEQ ID NO: 515399 - DNA, 976 bp, Homo sapiens
  misc_feature (1)..(1): n is a, c, g, or t
ncatcgagaagtaatgctgctatagaaaattgattagaattgtctggatgctagattgtcttggggacagatgtagcaggggtcatgctcatgggacagccgtctggcaccccggtgtttttcccccagttgggggtctcccagagagcgccggacattttgtgggagcctcccccaactctttctcgatcattaagaatgttctgcttggcccgaaaaatccagggttcgtccctattcgcgggggcaaaactgggggcccagccgaacaacaaagtcggttcaaatagcacgccctgttttgcttgtgcatgccgacgcaagggtggacaaacgcgaattcgccttgcatggacacattcggtcaatcgtggtttgcgtgtagaccttgacccgtctgagggataactcccttggcgtcctcccccaatgcgtcgtgtcaccgagagccccggcctccggcgtttctttttcaggcgcgctccccccccacaaatatcggtgcgtgcacatgtgccccggacgctgcgcccgttcatttagttacatttgtattgtgaccatggtacaactgcgagtaaaaggccaacaggggtcggacctaatttgcaatagtacgtggggccgcccctgctcaccacgaaggtagtattctagcacgcgatggcgccgtggcatcgctcttgccacatatgttgacattcaacatcgcctcggtccagcgaatgaggaaagcatcgcttcatccttgggtgcaaggcaaaaactattgggtatggacaaaagatggggtggtgcacgcccctggcaatacttctaggcagaaaaccacacacatgcgcaccataatgtgatcctccagccatgataaggccctgtcaaaacaagggtgccccttattttttatgccccaaaggtttaaatacggggaaaccccaattttttcaaaacccaaaaaaaagtttaaagccaaatc

SEQ ID NO: 515400 - DNA, 1765 bp, Homo sapiens
  misc_feature (2)..(3): n is a, c, g, or t
  misc_feature (1000)..(1000): n is a, c, g, or t
  misc_feature (1368)..(1368): n is a, c, g, or t
cnnttgtgtggattgatgctgatcattagctagtatgattgtctttcctcttttttatgttctgtctattatcctcttcttctgttttgctttggtttcctctcctcgctcttttgttatttgattgctctgtgtcgttctctaaatatttcttttgctcttttcttatgataccagatgtggtttggtttgcgctcgcatatgatttgctttctgctttcgtggggctgccctttattggtttttctctgtctgtttgtgattttctgtttccatggtgcgctgtgttccttttatgtatccccgtggttgcgtcgttttttgttgacgtcgcttgtgtttttcgttctttgtcccccccccgtttattattttgtctcgtgtgtgtcttatgtcgccccccctttgtttattatttttgtggtcactttttgtggtgttgttttcaccgtttaccttggggggggaccccccagaagatctgtggggcttacccccttttctcccttgttgagatctgttcttctcgtggtgctttccccactagtaatttttttcgccccgccatcttttttttgggataactttgtatttaatcccctttttcctccgttgggtccagagttagttgcccttaaacggaggtgtttgtggtcccccccatccttgttaatcgtttgtgccttcccccaaccgtggggtgtgttcataataaatagttgttaccatgttgagtattgttctcttgccccttttatttgcccatacttttctacccttttcctccggaattttgtttttacgcgccccacaagggtatgtaaataataaataaagggtaatatatgttattatatataataatcgcgcaatgttgataaaattttttgcgaagagagccgtttacctgtccgcgcccccccgcagagtgtgctacccacaaataataggaagattgttttctttgtcaagagagcttccacagatggcacccacgttnttataaaagaggatttttggtgtgctccctatgctcagatggtacatttcgtgagatggtgtttttttagatgttatacgcccatataaacatgatatattttgtctacccccacaagaggtgatagagggtttcagaaataaagagcgaaaatttgtgacaatacatagtatacattgtaccaccacatgtatggtgtggcgctatctctttgggcgagaaatatattaagcggccgcttttttttggagagcggcgcggttatatgtgagatatattaaaaacatgtgtgtgtctcgcgttaataaatatcctgtatatcgccgctattttataaactccacgggctccgttgtttttctctcttngagaaaatggcctctataaatatacccacgtgagtgttctgtgaaaaaattctcgagtcacgaccacacgtgtgacactgcgtgtccatatgaactctcgataattgtgtcctctggtgtcttccacgtgagccaccacggcgcacactctcttggagcactgtcccacacgtgttgcgctcggagtaaaagttgcctccactcttgccaaccacgtgatacactaacttgtctttgccacgtgtgcactgtatagtgaaggcgttaacctcgtgaaaccacgtgattctgagtggcccaccctccataaataaaattgcacgcactttctattgtttaataaatttgtaagccccccatttgtattatttgtctccaataaatacttagtcatcca

SEQ ID NO: 515401 - DNA, 106 bp, Homo sapiens
taactatacacgagtatctatacacctgatacactataccacctacaccctatacactctgatacacctgcgccaaaagcataagcaacatctcgccagctcaaag

SEQ ID NO: 515402 - DNA, 924 bp, Homo sapiens
gctcgcgatccccgtaacagtaacctaaagtttacattgacttgttctccttgtatgatgatgagagccggttcgatgaagatgtgcatagaatccatccatcacagaatctttgatctgacgatttagctgactgttctctagatatgtaatccaaattgctgataggctatgtcgagtgagtgttctactacgaggcagtcattgccagactggaacacttgtattgaacagatccgtattgagcttgtcataataagtgtatcgatatatacttggcaaatgttacattgaaatattacttaattactttttaaaggaataatttgaaggttttcccaggatttttttaagaatctccttttatttaccaattgtttaaagataaagcattctggtaattttttaaacaccctaatattattttaaacctcagcaatatttgatttctgcttaaattttcttcataagccacagaattttatgctactcatgacaaaaagtgtgagtaaaaaactaggagactgagtttgtatgatttatataatctttttactttgtagttatgcttcccatctcagactcttaaaaaagacttaatttcactttcagggcttcctttagggatcttactctgaaaaaaagttctctgtgggtatacggaccgggttcgagggggaatagtcagtctgatcccgattcattgctggttgtgctgatggagcatgaatgagctattgactttttgagactgcattgaacctgtcctgggtttaaaagatgccggccattcaaacagattttccctaaggtcccttcggataatcccccaataagaggttccggggacactttggcacaccctgcgaaggggggacatgcaacctactcttgtaccacacactttgctttggtagacatcag

SEQ ID NO: 515403 - DNA, 797 bp, Homo sapiens
tcggggggaggctccaatggtctgcctggggggttagcgctctgtagtgtttgagggatggtctgtagggaaagtttgattctgtgcagaaagcggtctatcgcccgtggtggacaattgttccgtgacagaaggtgtcatgcggctttgagatggacgcaagggtgaacaaacagtgttgtttggaatcgtctctcgcgggcgcccccccccgcggagtgtttgttagaggccccccccccgccccttttgtgacagagttatgtagcaatgtcctcggccggcgcctctgtgaagtgtttctgctccccctcttgccccacgcgctgttccacacgataaagttatgcgcgtcgatgtctggaatattctcgcgacaagaggttgttcccccacaattattctcggaaaaagagggcgctatatatggcgcaaaaaggttgtattcagagaagcgagccttacatgggggccccatccctgtatagcagtgtgcccctcccttccatggctccaccccctcggaatgatattcacgcccctcattgtacagcgcccgccagtgagctaatgtcttgtgggggttttttgcgacccccgcaaggtgccaaaaattttgttcatgtgaacctgttacaccgtatcgtcgaaacacctgtgaagaatctttctttgctctccttttaggttagattacccgccctctatatatcgcctactctttagaccctcttgatatacaaattattcccaatcacccttgtcgtataaaatgaactaaacaaataacaaaacaa

SEQ ID NO: 515404 - DNA, 533 bp, Homo sapiens
  misc_feature (2)..(2): n is a, c, g, or t
  misc_feature (64)..(64): n is a, c, g, or t
  misc_feature (121)..(121): n is a, c, g, or t
  misc_feature (187)..(187): n is a, c, g, or t
  misc_feature (236)..(236): n is a, c, g, or t
  misc_feature (239)..(239): n is a, c, g, or t
  misc_feature (265)..(265): n is a, c, g, or t
  misc_feature (279)..(279): n is a, c, g, or t
  misc_feature (284)..(287): n is a, c, g, or t
  misc_feature (290)..(290): n is a, c, g, or t
  misc_feature (292)..(292): n is a, c, g, or t
  misc_feature (294)..(295): n is a, c, g, or t
  misc_feature (324)..(324): n is a, c, g, or t
  misc_feature (329)..(329): n is a, c, g, or t
  misc_feature (333)..(334): n is a, c, g, or t
  misc_feature (342)..(342): n is a, c, g, or t
  misc_feature (375)..(375): n is a, c, g, or t
  misc_feature (443)..(443): n is a, c, g, or t
  misc_feature (494)..(494): n is a, c, g, or t
tnaaggttgttgaatttgaatctcatgaaaaaaaggcatctcttcattatatgttgattttggnaaaaagtaaagaccagcatacaatagatatacatgataatgtagtttaaagtaagangtgctttgcttttggtaataaggtagagtgaaacttactatgtaaatctatgttggttatttaggncatgtttcttgtctttttagaagtcttcaggcttaatattttaaaagtngcnctttttatttgatacttctacttttngctggaataggggnatagnnnngantntnnctgcttaggctaatacactcatacaatanatggntaanntgaaatanaaaggtaagatatcttagggatagtggcatttncgattgtgagttgttttaaacgcgcgccaaaactactaagtatttgttttagcaaaaactcaaggcgnaaaccaatcttgggaaatgatcgccaacctgttttataagagttatttaanagtctaatctctttgctagagaatgccattttaagctta

SEQ ID NO: 515405 - DNA, 196 bp, Homo sapiens
gatcccttactcgtgttgcaccttacaaggcatgtcacagggcaacatcttttacttgtcttcagttttttgttagtttgtttttgctctgtttttttaatgactgtggaacattcttaatctctgccacacaaattgcattttactctgctcatctttgtatttgtgtgtgtgtgcacatgtgcaacacgaataa

SEQ ID NO: 515406 - DNA, 177 bp, Homo sapiens
tcagggcaccagtgaaatcctgagtgatgtgcagcggatcaagacgggagacgaagtgggagccagcgaagccacgctgctgaacatgctgaacatctccccgcttctcctgtgggcgggtcatccagcaggtgttcgacgatggcagcatctacaaccctgaagatagttggctgg

SEQ ID NO: 515407 - DNA, 154 bp, Homo sapiens
tccggatgcgagaactcgacacaaggggtcaaaaacaagtaagatcctaacaaaaagaaaggagaaaaggaagaaaaagagaaaaagaaccaaaaaggtcctagccaatcccctgttcaagctatgcgagaagctctggttaagcttacacaga

SEQ ID NO: 515408 - DNA, 241 bp, Homo sapiens
tcgtggaggccgtgttcggaccctgctgtcctggttactgttgcccgggtgtcttttttttgagtactgctctctgagttttgcatcactcaagttgccctcatctgctggagatcgatcaggaacgcacaagacgttctcctctgcccttaaggagcttcccgcagccgcctggcccaccctgggcacgttctccgaggcatgtgtctcccttttgccctccttacagggattacgaggg

SEQ ID NO: 515409 - DNA, 182 bp, Homo sapiens
catgatgtgattgttaatatatgatgcagtcacatcggcttcctgctctgtggggctcgtccttcctagtctacggttccgtgaggatgccttcggaggactgggttattttggcattggctctcattatggtccttttgggaatgatgtggtttttcccagaagaacaatcacatcatggg

SEQ ID NO: 515410 - DNA, 155 bp, Homo sapiens
ggcacatctgacccagagggtgacggcgcgtaggatgaagctcgtgagatttttgatgaaattgagtcatgaaactgtaaccattgaattgaagaacggaacacaggtccatggaacaatcacagtgtgtggactgtcacgcatgacatacacgg

SEQ ID NO: 515411 - DNA, 404 bp, Homo sapiens
actatctcgatatccctataaggtttagtatctagtcgtatcttctgtataatcacgtctgtaactcaccattacttagttcaattatccttgcttaaaagcgtttaaggtaaagtagacggtcttcatccagggacatccacttctgtatgcgatggccaaagctattggcctctctctgaacacgtaatgagttgctctaggtctgctgagagctcaaggctcaaaaggtccccagtactggaatcgcttctatgaccagataaatcagtaacaatgaatctgtccctttcaacatagtgtgctgatgatgtggcctcgttgccatatgaactccaccttgaatcaacagcattgacataagggacatactctgatacactgatgggacgaagatgcggcgt

SEQ ID NO: 515412 - DNA, 172 bp, Homo sapiens
ttagataggtttttggtggaatacgtgcaattttcgacacgatatcttcaatattttccacggtaatcaaggtgtcatcttgttcagctttcagacgacgttgtgcccctgcttcatcaatgacatcaatggctttatctggcaagaaacgatcattaatgaactttgcaga

SEQ ID NO: 515413 - DNA, 100 bp, Homo sapiens
tgagtaggggaagggagctacgtatgggtgtagaataggaatgtatgtgcctgcgttcaggcgttctgactggttgccttcaaaatcgggtgcatgcata

SEQ ID NO: 515414 - DNA, 148 bp, Homo sapiens
gaaaaattaaaaaaaaaaaaatttttttggtcgggtggccttttttaattgggggtgggaagggggtgaggggccccgctaaaaattcaaagggagccaaaatggggggtgggggggggggggttttaaaaaaagggcccttttttta

SEQ ID NO: 515415 - DNA, 191 bp, Homo sapiens
ttctttttggaacccccttttcccccatttgggtaatccaggaaaattgttatcccttccccttatattgaagttgagaaatgtgccaaaggcctttaaaggatgggcctttcttttctttttctttttctttttttctttttaaaaaggagtccccctctccagggtggagggcagggggccaatttcca

SEQ ID NO: 515416 - DNA, 154 bp, Homo sapiens
ccgtcgctacactctcttgacaggagacggagttacaatcggagcacagctattattatacacagacaactagagacaaacatcagactggaattctaatataggaatattgatgaatcatgagtaaggggacttattccacctattagaactg

SEQ ID NO: 515417 - DNA, 407 bp, Homo sapiens
ttaccgcgggaaaacagccgggggacattttgcctttagcatccttaaaaacgctctgccatgggaggaccaatttcaaacggttttcaataaccttgaacacgccccagagctatcttccaaatttgacctgtctgggcctaccaacaccagctacgcagggcctatagccctcgactcaccaaatcgggccattataacaggcgggtaaagcccatacttcttccgaaaggttgctagctctccatcattaaagggtttctgtaaaactcgagataaaattgcccccaatcacaacagtggttcctacataacaaccaggggttcttttgcaccaaaaaagaagcgtcagccctctcgggtcggaaacaaacttccgcggtaattccaaatctaacaaagcaccc

SEQ ID NO: 515418 - DNA, 121 bp, Homo sapiens
gtagagcagaggccattgtgagagcaggccagtgtgggggctgagcctcccactgcatgaagatggcataaacctctgggggtggtgctggtggcctgggctgtgtgcctctgctctccat

SEQ ID NO: 515419 - DNA, 138 bp, Homo sapiens
ctgacaaccgcgccgatctcctcttgggctcttccttggcggcttcggcggagctgacctgcggatacggagacgcacgaatagatgcgggccgcagtcccaggactcgtcgcccgcccggccccgagaacaatgccc

SEQ ID NO: 515420 - DNA, 131 bp, Homo sapiens
  misc_feature (15)..(15): n is a, c, g, or t
  misc_feature (38)..(38): n is a, c, g, or t
tgttcagcctggttngtgtacatagcaagtaaagcttngttaaattctatagctagtagttgtttctaggaaagcttaaactctactccttccgcattggttaatttcacttttcttctggagtcaaagac

SEQ ID NO: 515421 - DNA, 161 bp, Homo sapiens
  misc_feature (72)..(72): n is a, c, g, or t
  misc_feature (81)..(81): n is a, c, g, or t
  misc_feature (87)..(87): n is a, c, g, or t
  misc_feature (154)..(154): n is a, c, g, or t
caaaccggagcccatcctagcgtggctccggcctccctgagacgttatttaaaactcagccttctcctcctncccctcctnccttcngccttggacttacccagcgtgcccgaatcccaccacccaagtgtcagctctctgtggtgccttgttnctgcagt

SEQ ID NO: 515422 - DNA, 145 bp, Homo sapiens
tgtgtagtctgatctaccgatcttagaggtgggaggattgtttgagcccaactgtttaaagagaccagccctggccaacatagcaatgaccagtctactacaaaaaaaaatttaaattaaccaggcatggtggtgtgcaccctgt

SEQ ID NO: 515423 - DNA, 388 bp, Homo sapiens
  misc_feature (10)..(10): n is a, c, g, or t
  misc_feature (43)..(43): n is a, c, g, or t
  misc_feature (115)..(115): n is a, c, g, or t
  misc_feature (160)..(160): n is a, c, g, or t
  misc_feature (330)..(330): n is a, c, g, or t
  misc_feature (338)..(338): n is a, c, g, or t
cctgcttcantataacacagaagacgcctatactgtgcagcanttgactgacagcactcagattaaaatggacattttggcacaagtcctacagatttaactgaagtcgaaattnctggtcttagaagatgaaaatgccaatgttgatgaggtggaattnaagccagacaccttaataaagttatatcttggttataaaaataagaaattgagggttaatatcaatgtaccaatgaaaactgaacagaagcaggaacaagaaactacacacaaaaatatagaggaagaccgcaaactactgattcaggcggccatcgtgagatcatgaanatgagganggtcctgaaacaccagcagttcttggtgaagtcctcctcagctctcctcc

SEQ ID NO: 515424 - DNA, 259 bp, Homo sapiens
ctccatctctcggtcacgcattctcctctgcctcccaaagtgctagggattacaggcgtgagccaccacgccaggcccaatgtgtaggcgggtatccctcacccttctccccaagtccccatagttcattgtatcattcttatgcctttgcctttgtgtcctcatagattagctaccacttataagtggaaacatacgatacttgtgtttccagtcctgagttacttcacttagaagaatggtctccaattccatctac

SEQ ID NO: 515425 - DNA, 967 bp, Homo sapiens
  misc_feature (190)..(190): n is a, c, g, or t
gttaaaggagtggcgacgtccgggcttcggagcgggcagctgttcgttgtgccagcgtaatacatagaatgagaatgatatattgggtgatgtttgatactaggcacgacagattgtttatggaatgaagtgtccccctagttgctcacaaccagttagcatcacagggagaggcaagacacaatgactngagtgccaatagtctccagtgggtcgatcgttatgtgaggcggcaaagacaagggtcacggaccgcgtggtgatacgtcgtttacgacagaccgctcataataatgacacgaaaaagggacatcaatcttgggaggagagggaataccactttgatgagacggtactgtgagacgaaaatcctcaatgagagtatcatccactggacactacaaaagtgattcttggtgccggcagtctaagaatgacaggagagagacagggctagacatttgaaatcaggcttgatcgtcgacctacatagagctactaggtgagtatctaatcggccactggctgatgttattgcacagacagagatgtctcatgacttttttatgtgtatcatccttaacgtagatctcatacgaccgagaattcagatcatgaatgtcctgaccgaatataggttgggcggccccgatttaggactaagacgggttgtggctaaatgaatatgttcagccttgacttcctagtaactccccttcgtcatggtatccttggtgcccctttacagatttgcttcgacttcgttcggactgtgcagcttgcccgaaggtgggggggcaactaaaactacgcatgggtccattcacacggaggacgctgtgaaagtaaacgggaagggcggggacccaagaccggtggggagaccgccccaggagggaggacacgagaaaggcgaacacaaacggacagagaacggaggggggaaaaaccaacctggcgccttgca

SEQ ID NO: 515426 - DNA, 909 bp, Homo sapiens
taaagcaggcttgtactgcctcctggagtttcctggtgattgactgtcgtgctctccctgtggccctgagtctgatgccgctgacgggccgagtgtggctggacggttctgtgtgctgaactgtggacctgtcctttctcgctcctgccctgcggtggtgtcccctcgtctctcctctcccctgccctgcctggcggttgcgtgtgggaatggctgtggggtgctggacccctgtgccctgacctcgcctgtccctgccctgcctgccttcttgcttctgctgggtgcgtggcctggctggggtcctcgtgacttgctggcagacagccgctctgctgtctgcctccgaggtggttttgtcgactttgctggggctgtgcccccccttactctgctggagcagtgattgttgggtgtgtttgccctggtacgcctggcactggtgcccccaggtacagttgcgttagcgccctccttcagcgggggagcgggagttattggcgagctgaggccctggtcagtgcttccctggcccttttgtggggcccccttaatagactggagttcgctatcccatagaggatgagcgctcattcacagagggggtattaggtacccccttcaaagtgagttttgccccccaggaagttgccccctgaaaaacctaggagatggagatatgttggtacggttaccgccctagtctcccacgctgtgtggctgtgcccccgagctcttctcattcacgggtgtgtcaggcctatgtactgctgactgagagttggttaccctcggcatggtccagtgtttacggtggttcccctttgagagtgggcgacggccatccagggtacggagctattggttgagcgggtttccacgagaggtggcaggaggctttaggaaggg

SEQ ID NO: 515427 - DNA, 278 bp, Homo sapiens
gtctcccacctttgagccggacaaaaccagagtcacctaagactcttaggaaaggtcttttgcaggtcagcgctttggaggctgaggttggaggattgcttgagtccaggagttcaagaccagcctgggtaacatggggtggaacaagcctgtagtcccagatactcaggaggctgaggcagaagaatcttgaacccgggaggctgaggttgcagtgagccaagatcacaccactgcactccagcctgggtgacagtgcaagattccatctcaataac

SEQ ID NO: 515428 - DNA, 1580 bp, Homo sapiens
  misc_feature (804)..(804): n is a, c, g, or t
atagcagcaggatgctgcaggctgtccagcagccctgctctgtggtggaatgcttctgtgtgtgacattcaatggcttaccgtgggcgtcgtgccatacatgcttgtgctgtccctgtcttgtctgtgagactgactgtgatgtatggctggactgttgcttgctgtgcacatcatgacgtgcttgtgtgccgctgacttcactgacctatacccacaagacagatgcctgcaatgcttgctacaatgatgaattgtgtggtacgtatgtgatgcacttgtggtgatgtgacgtctcttgcgtggatgctagggcttatcccttggtctctacagccagacgtcttgcctggtcacaatgaatggaccacatattccatatgagcaccacgtcactcaacgccaaattgtacactccacgtcatgtagacggaaacttgcaaagttacacactctgccattggatgcacacataccccttacatcacgttcatcattgccatgtgtgacacttgcactggacgcttgccttgggcccattggaacgcctagcgagatgttgtgacctaacacatgacgacacgacctctccatcatacaaatacctggcccagtctctcgccaactaacaacctagctcagcaaataggccattgaacccacctacctgcaaacgcaaactggacacaccacataccccagcgttccttggctcggtacccacacttctgtgacatcgctaactacgtttgacaacccttgaccctgacttatatcccattcgactatgcgctcggcaccagcntgatcctcttgtgacgccccatcggcagagtgagccccccactatcagacacgacatcccctctccacagtcctcgccatactgaggcacgccaaaagcgacgcccagactgcgcccaccacacgcaccaagcacacatatggcccactgcaataccgaagcgccaccaagatctcaccacaacacattcgcactcacaggcaactcatacacccacaggactgacgcacagttgcagcccgacgccaccaacctgcgtgcaccactacgaccagacctacaaacccccgagcgcgaacacaccacacagtgaggcccccacccaaaaccccagacagcacatggccctctcacacacccccgggccaacacacgactcccacacgcacggcaccgccaccaccacacccccgcgcaacgccccacgcccacaccccgacaccccacaccaaccccacaccacaccccccaacggcccacccaccaacccctctccaccgtccacgccgagcggcagccgacggccgcacggacaagctaccataccgtgaaccccgctcgaccacgcccacaccaccgccgccaacacacgccgcctcccgctactcatcgacaacacccccgccgcacgcgtccatcaccgcccaccctccgaccacacacacacgacgcaccacgaccacacccagcctccaccccctccagacccacaccaccccccgcccgaacaacgcaacccgaagaccaccaccacaccaaacccccccacaacggcc

SEQ ID NO: 515429 - DNA, 410 bp, Homo sapiens
  misc_feature (129)..(129): n is a, c, g, or t
  misc_feature (139)..(139): n is a, c, g, or t
  misc_feature (177)..(177): n is a, c, g, or t
  misc_feature (251)..(251): n is a, c, g, or t
  misc_feature (257)..(257): n is a, c, g, or t
  misc_feature (275)..(275): n is a, c, g, or t
  misc_feature (289)..(289): n is a, c, g, or t
caaagccaaagtgctctggtctaatagtatctattatgtctgttcgaacctagcaaaaaggtccagtgatggagtcgccccccatcttgagatagcagtgtcctgatgaggtatatttcccgtccaagnctctgtgaantttagagtcagtttgttggggtcaaagacaccatctcnaccccacccaaataaaaatgcactcatctctgtagaacatctgctgtcaaaggccagcctgtcgttaggccatnggcttntgcttgacaaaccagtancaactgtgggatgncgatggtgggatgtgtcgcaagcaattcactagacaatcttcacatgaatgtcggtagccagggtctctcccgagggatggctttagtcttgatgaatgtgaaccatgtcggaattgtagg

SEQ ID NO: 515430 - DNA, 209 bp, Homo sapiens
tacagcacgctggagtgcatggtgcagtggctcactgcagctccgactctcggatcaagtgattctccagtcttagccttccaagtagctgggattacaggtgcatgccatcacgcctggctaattttgtagttttagtagagatggggttcatcatattggtcaggctggtctcagactcctgagcttaggtgatctgcccgccttgg

SEQ ID NO: 515431 - DNA, 411 bp, Homo sapiens
  misc_feature (130)..(130): n is a, c, g, or t
  misc_feature (140)..(140): n is a, c, g, or t
  misc_feature (178)..(178): n is a, c, g, or t
  misc_feature (252)..(252): n is a, c, g, or t
  misc_feature (258)..(258): n is a, c, g, or t
  misc_feature (276)..(276): n is a, c, g, or t
  misc_feature (290)..(290): n is a, c, g, or t
agatgagtattttattcgtgttctgtctccgaaacacctagcacagaaggtcacagtgatgcggagtcgccgcccctatctttgaagatagccagtgtccctggacgaggtgatgatctcccgtccaagnctctgtgaantttagagtcagtttgttggggtcaaagacaccatctcnaccccacccaaataaaaatgcactcatctctgtagaacatctgctgtcaaaggccagcctgtcgttaggccatnggcttntgcttgacaaaccagtancaactgtgggatgncgatggtgggatgtgtcgcaagcaattcactagacaatcttcacatgaatgtcggtagccagggtctctcccgagggatggctttagtcttgatgaatgtgaaccatgtcggaattgtagg

SEQ ID NO: 515432 - DNA, 133 bp, Homo sapiens
cagagatgtgtttaagtgctgtggtcagaagcggagggaggggggggtttggtggaaattattagtgtatgaagtctgtgtggaaagatgctgtgcagacgtgcagttgttattattatgtcctacaagcata

SEQ ID NO: 515433 - DNA, 278 bp, Homo sapiens
gtcgttaattacaatgtcgtcatcaccctaaaaaaaaatcctgtgcccattaagccgatatttccccttcccccagcccctgacaacaaccagtctggtttctggctctatgaatttgcttaactctggctatttcctatcaatgggatcgtaaaatctatgaccttttgtgcctggcttctttcacttcgggtgaggcttttggagttcctcctcgttgtagcatgtcagtacctcattccttttcatgtctgaagaatattccattgtatggagag

SEQ ID NO: 515434 - DNA, 341 bp, Homo sapiens
ttcaacccgagtagggtggaaggtgttgcttaaaaagaacaaacaggccaggcgcagtggctcacacctgtaatcccagcactttgggaggccgaggcgggtggatcacgaggtcaggagttcaagaccagcctggttaacatggtgaaaccccatctctactaaaaatacaaaaattagccgggcttggtggtggtcgtctctaatcccgctcctcggaaggctgaggcagataattgctcgaacctgggaggcggaggttgcagtgagccagtgcactccagcctgggcaacagagcgagactccgtctcatagaaacagaaaaaaggactgtcaaccc

SEQ ID NO: 515435 - DNA, 324 bp, Homo sapiens
  misc_feature (101)..(102): n is a, c, g, or t
  misc_feature (105)..(105): n is a, c, g, or t
  misc_feature (283)..(283): n is a, c, g, or t
  misc_feature (310)..(310): n is a, c, g, or t
ggaatataactgcgtttaaaagagggctgtaactgcaaggaacaacgattgagtgttcaagactgcctttattagctttacttacaagataatacattggnnctncttttattgtgcatagaaaggtgaaccaatgtattatcttgtaagtaaagataatacattggttcacctttctatgcacaataaaagaagaattgggtctcaattttagaagttaagcttttttcagtacctcttaatgaaatatttttaggcttttgcatacttaatttgagagggncatctcccttatccggatagctggggnggattcttatccct

SEQ ID NO: 515436 - DNA, 189 bp, Homo sapiens
gctactaatctgaaaaagctacttagaaattatcaaaaatttcataaaattccaaatagagatgtggtaaactatattaaccatttccagggataaggcggattgatcagcatactcatagggtgggaacctgtaggacagagtcccgggggaagagaaacaatgctgtttaatctgaaagctcaaggg

SEQ ID NO: 515437 - DNA, 408 bp, Homo sapiens
tgtgtgtgtgtgtgtgtgtgtgtgtgtgtatgtgtgtgtgtgtgtgtttcccttgtttttgttgttatgaaattacagactttctgtgttgtcttggatgtagttatcctcgttggtatggacttttcttctagtattttcggtagggctggtttgtttggctttagatttgtcctgaaatatcttgtttacttcatctatagtgattaaaacttttgctttctataaaagtctaggttggcacctgtggttttatagaggttataagatgtctgtccagacctttctagcttttgtagcccctttggtaattcaggtataattctttgtatgttacttgtccttttctcctttctccttttaatatttgttttttttttgtttgtttgtttgtttttgtgtcgacgc

SEQ ID NO: 515438 - DNA, 270 bp, Homo sapiens
cgcgttggggatcagatcgggcgattgcaccagttggcgccgatgctcatcatgcgtcgccaaaaaatgcgcgaaaaaggccatgctcgagcgcacggtgtcgaggccgccgaacaccaaggtctggatcagcgcgcctgcattgtcatcggtaatgggctggccgtcgatctccgccgccaggatggtgctgacgaggtcgctacgctccggcgtcgcgcggcatttggccatgtcggcccgcacataggcgatcattctctcgcgagc

SEQ ID NO: 515439 - DNA, 620 bp, Homo sapiens
gtccaatccaataatccattccttttggaattaatgttaggaggttaaatcaatctgaaaggaattcttaacatttggaatgagtagggtaatccttttttcctaattagaggatggtttaaataaagcctttaattatccggttcattttccccctggaattcaaaaggccactttttaaatttttaaccaaactctaatattaccataaccatggaatggactacggccttggttttttaattggccaatttttaaaccataatcaaaaccttaatccatgtaccctaacaggaggtttggatagtcggtggattcctccctttggtaaatttaacctgcaaattaaatttaaggattaatcctttgacttttccaattccttcttcgttttggccgttaattttccttgaaagttttaatggcccggttggcttggattttggatttttgtcgttagttgtttctttttttttttggagacagagcctaacttttgtgccaacacggaagtccaaggccccgatacaagttaattggcacctccaccttccagggttaagccgattcttttggccttagcctcatgatggttgcgtttttaggccttggtccctgcg

SEQ ID NO: 515440 - DNA, 227 bp, Homo sapiens
gaattctctaacctgccttctgcccttaggctccggtagattgcaaacgacctgctttctttctgatcccgggctgcgttcggacccctgtcgtatagaaaatcccaagtaaggtacctgccgtcggcagatctgagctttcttcttggacacctaatacccacagttctccagacccctgtcggatagtaaatcccaaggtagggacctcttgcttggaggtcttt

SEQ ID NO: 515441 - DNA, 794 bp, Homo sapiens
aaaacttatttatagaagacttcagaaataataacaacactaggaaaacatgattttgtgactggactcgttgtatgtgcctcagacgctataatccgaagcagctttgggaggaccgaggacgtgacggcatcgcccgagattgagagttcgatgaccagcctgaccaacgtggagaaaccctgtctctactaaacaaacaatgaaacatagagcacacataatacataaagactagccggtgcgtggtggcgcatgcctgtaatcccagctactcgggaggctgaggcaggacgaatcgcttgatacctgggacgtatggaggttgtggttgagccaatcgatcgctaccattgcgctccaggctgggcgaacaatgagcagaagactcctcatctctagaaacgtaagaaaggagacagattttactctgtcatccaggccgatgtatagttgaccgtaatcataatgcatgctttggattcatgggctcaattgatgctcctgcctcggtccccctaacgtgctgggaattataggcttgtgccatctcactgagctaattttatgctttatatgagtctgcattggtgaagcgtgtttcacaatataataatactgtggtaacatcctgatgaatatatttcatgtacattctagttacacagcagtaatagattcctagtggtatattgccaggtcaaaggggtgtgtgcatttctaactttaatagagcctgtgttacttgccctccaatacattcctagtctttaactctagggcatccttaaaat

SEQ ID NO: 515442 - DNA, 777 bp, Homo sapiens
ggatggcggcgccctgtgagggacaagcgtttgccgtaggggttgaaacgaatggggtgcagtagttcgctccccagtaagggaccccgccagaaaatccggcagcatgatagatgaggggatcgccccggaagagggaggcgtggtacgctgaaggacacgtgtgccacgatcccagtcagtttaatggatcactccccaagcggaacaagctgtcgattggaatctatgaatggcaaagaagcctgcttatagacgagagtggaacacatttacttcttggtaaatgggcgggtcaagtcctttgagctgtctccaacgtcgtctgtgcaaaatatggctggggtcacaacgtggcagtgtgatatgctcaagtgctctaggctgtcaagcttttctctgtgccagtttagcagccaggctgtttgagctatgtgacagactataagcaacgagtgtgctgagctgaacgaacagcctcgtgtactgccagtgacgaagttctgttgtctggccagagcagaccatccgccatgaccggtttgggatgtagctcccgtggcatgagcgctgcatattcttgtaaatgaattccgagatcgcaggtcagaggcttggtcactatggacctccggcttccttcccgtaaggcggaggacttgaacaactagtgtgcttgagcagaagacaagatcagtcttatcctacacgttgcttgaatcatgaacttgatcaccgaacctgatgagaggaagagtagaagtcacatgaggctca

SEQ ID NO: 515443 - DNA, 327 bp, Homo sapiens
tgactataaacactagactcactgaccgctggagctaccagactacatatctcacacggtcatcatcctacatccggagagagcagatgtctagaacaacctcataagtcgatgctcataactgtagctgccacaagctggagtccatagacaacttctaggtggaggcgagagccaggcatggcaacaaaattccaagttcagggtctccaatgcagcttcctcagcaagccagaggaagggcttttcaaagtagtagtaacttttggcagaaatgtcgtagtactgaagattcttctttcggtggacgacaatggatatcgcctt

SEQ ID NO: 515444 - DNA, 387 bp, Homo sapiens
ttttttttgaaaagtggagtcttgcctgtcgcccaggctggagtgcaatggcgcaatgttggctcactacaacctccatctcccgggttgaagcgactcccccgcctcagcctcccgagcagctgggaccacaagcgcccgccaccatacccggccaacccttgcattttcagtagagatggggcttccccatcccggccacgggtactcaaactcctaaccccatgatccacccgcctcggccctccaaagtgccgggatcacaggcgcgacgaccgcgcacggcctacttctaaatttttgaagaaacaaattgaaaaagattatacaaataaatggaaagatgtctcatgttcacgaactgaaagaatattgttaaaatgtcca

SEQ ID NO: 515445 - DNA, 336 bp, Homo sapiens
ctaacgaccaagagggttttcgactgctagagccgagcgaagaattggcctaaattcaagggaccttgttcctcaaagctcctcctcggcagtgatcctaacagttaggttgacaaatggttaaagggggaaaaggccaagttcctcccagataaaccccgtaaaggataccaaaaggaccaggtgagactccgagagccccggtcatcctcctaaaccagagcagcagcagcagagatgataaccatggttccagatggggaaaatgaggcacgttagtgttccgcgatttttaaggcaaaggtcctaatttgatattagagaatatgggatgga

SEQ ID NO: 515446 - DNA, 344 bp, Homo sapiens
gtcaccatgcccggcctttaaaattttttttttagagacagggtctcaccagcgctgaccaacatggtgaaaccccgtgtctactatacaaagaggcaggagaattgcttgaacccaggagacggaggctgcagtgagctgagatcgcgccattgcactctagcatgagcatcaagagcgatactcggccttaaatcatcacccttgggcccctccccacgctctttacaggtgtccaactatgcttccttccttcatatacttattctataagcgctcttgcatctctcctccctgttcctccctcgtagacacactcttacttcttcacccttggctcccct

SEQ ID NO: 515447 - DNA, 1347 bp, Homo sapiens
gccctcctaagagaaaggagaggcacaaagcggagggcagggaacagaacgacaaagagttaccgtatcaaccgtcagtagtgctgttcttcatattaacagcctttttagtataacaagtttttgtgtcccctctcctactagggcgcatgtttttcctcacacaatgggttctcctcttttatatgagttgtgtctccgccatttctctctgctcctctatatgtttgtggtgctcctcctcgtcgcctccagtgtctcaccatggaccactgctcttgggggcacacccacttgtgcatatagtgggggtgccacattttatgtcgtggaatagcttcccccccgccggggtgttgggaattgtatcggtggtgtttagaccgtcgtcccgccggggaattccctcggtagtccccgcggcccaattgtggggtccaggtgcctgttctataggccttattttccctttattgtcgcccacagtctcttgggggccccatttgggcacattgtgtgccccaggcccatagtacccctctgttgaaacccaagttttgggatcccccctccccgggttggccaattgggaaatgggctcccatcttgccagtacgcccaggtaatattcgttggcacctgttgggcgggcccccctagcgaaccacccagtgggtacacaagggggtccagaagtatacccccggccgctttggtgttcccggtctcattgctgtatgggaggaatctcccaaatattgggtccataattgcgcggaagacccttggccccttggggccctctccaccggtccatgatgggctcttcttccgtggcgtgcgccccccctgagggccccctggtgagaataccttctttttctccgaatgggagtctccgcgctataaagagaaatattctctccggtatatgggttcttcttccgatcgcccatggacacagcaccctcacgcacgcccgtgaccacgagtattttcacagtgagaagctgagccacaagtccaaagtggccccgggagagtgtttggtgctgtgcacggacccaaagggtccaatcccccaaatttgtcccctacctgagttgctggcactcccacacactcactgccacggacacttggtgctccacgaggcttgagaccccagttccgaggccctgagatgtaacttctggggaggcttatagtttgaagaaagagaaacctcctcacgcccacggtggaaaggtggcgtccctagacctccctttgtatgagaaacggcttttttgtaaaagggatcccgcccccctcctcggtttttttttccattaaagtttagaaaga

SEQ ID NO: 515448 - DNA, 439 bp, Homo sapiens
atacagggaatagagggaaaataaataccatacaatacatgtgaaagtgcctggaatgtggcatgaacatatggtaactatatatagattataccttactatgttgtatttgttcatatccacaaaaatttcttaggcaaaacaaacatagactttatgagccttaaatggactttgagcaacttagcttattgagagtcgccatgggaatccatggcaaatccacagcaaactggatatttcaggtctcatgtcttagcagcctgactacatccaccttctagttgcagcatctactccctctttaggtgacatttatcacttaaggacaatgatactacgctcatcttcactgaagcacttcctatgtgccagccatattctacatgcttcacatttggttcgttcgactctttcacccacctgctgaggtagcact

SEQ ID NO: 515449 - DNA, 244 bp, Homo sapiens
  misc_feature (4)..(5): n is a, c, g, or t
  misc_feature (65)..(65): n is a, c, g, or t
  misc_feature (67)..(67): n is a, c, g, or t
  misc_feature (128)..(128): n is a, c, g, or t
cccnncaggagccctgctcccttgtggcacaggccaggcgcagatatcgtagtgcatgtcagccnangggagtgcctgtccgtgtgccccatccctccctcggctttactcctgcccagtgactgtgnacactgtccgtgttgccttcttgaacagcgattccccccaaccccttcacaaaggtcttgtacaaccagctgcccattttgtgaaatttttatgtagaataaacatttgtatctgt

SEQ ID NO: 515450 - DNA, 285 bp, Homo sapiens
cccccccgtttttttaaaaaagggggggggccccccctttgggggggggcccaattttttttctaacccccccccccccccggggggggggggggggttttttttaattttttttggggcccgggggggtttttttttcccccccccccccggggcccccccccccctttttttttgagggggggggggttgggggttttcccccccccgggggggggttttttttttttttccccctttttttttttttggggggggaaaaaaaaaaaaaattcccctttttta

SEQ ID NO: 515451 - DNA, 485 bp, Homo sapiens
gcatatataaaaatgggtaagctggtcagttttatgttataaatattttacctcaataaaaacaaattgaacttaaaaattcactgaagaagccaatatggaaaaaggactaaatgttaaaaaaaaaaaaaagccaacttttttttaaaccaagagataagtacttagctgcaagcccagggcctcggtggaggacaaccattatgagtcctagtaaaagacacccagtttaaagaacactgtcaggcaagctaccatgtagtcctccttgactccatgctaagctcttaaagactccccagtaatcacgaggggtcacatttgggtccagcttggcccagtgctgtcatacataatagatgaatgaaaggtcccagaaacctgttctgtgggggaaggttaactttggtcccaggctacgggggtaaatttgcttgacaaattgcagagtctctctgtctctgtagaccaatgccaaagaatgg

SEQ ID NO: 515452 - DNA, 562 bp, Homo sapiens
gatctagaggtccccggcggtgggggaagagggcctcttctcggtggcagacgggccagcttctcatggtaatctctcagggcagatcgcagaaggactcaagttatctcaggactcttacgagtactaatcccattctgatcattggttcttagctcccaaaggcccacctcctaataccatcatatggggaggcaggataccagcatatgtatgggggggtatgcaaacattcagttcataaagtctaacctctgaatacccaaaatgcaggtcgtactaacatgtcaaagggaaaagacaacacaccaaaagagaaagatatcagataggagtattatatccagaacatagaaagaacatttataactcaaaaacacaagccagttaaaaaaggaacatttaagaggggatagacttttctccaaaaaaacactatagaaaaggccaataagcacgtgaagagatgcttaatatgatcatccaggagggaaatcatgaaatcaaagcgagggtggacaggcagtgcacaccctcgaggatggctatactcacacaacaa

SEQ ID NO: 515453 - DNA, 360 bp, Homo sapiens
aacgggaacccattttttgccatgttggccggggtggtttcaaactcctggccccaaatgatccccccccgtcggccccccaaagtattgggattataggtgtgaacccctgtgccgggccagggaacccttttttaaaaaaaggggttggggcccaaccaaacccctttaaattcatttttacaaataatccccaaaagcaactttaggaagcaggccttttcatgcccatagtacgaataaggaaactggggcccaaaaaggttaagtaaaaaacccaaggtcctctaactcctaggggggatattttccttaggtattttaaaagaatttttttttctcccccccgggggctcccca

SEQ ID NO: 515454 - DNA, 832 bp, Homo sapiens
acactgctataaagaaatgcctgaggactgggtaatctttataacagaaacaagaggtttaattggctcatggttccatgggctgtacaggaagtatgactggggaggtctcagggagcttttactcatggcgaaaggcaaagccagagcaggtatcttcacatggggctagtagcaagaggcaaaagagacgaggggaggtgctacacgacttatttattgctaagccaaatctcatgagaagctctatcacgagacagcagtagggggaccagtgctaaatcattcatgagaaactacctgcgatggatccagatcgaatccttgtcaccaggccccatctcccacatcggggattacaattaagcatgagatatggtatggtggatacagaatctaaactgtatcatttactctaataagaagaaagaatagaataaaagaaaagaaaatacactgggagaatggacacttacttgttgttatcaattcatgatctattaagaacgtaggggttttagaacgcaggtaagggcaacacacatgggtgggcagggagtagtgggccaactcgggcccaccactgggattatctccaaagaaattttcatggacctcagccacatttactcattgacaggtggtccttgagtgccttggttgtcccagtgtcagaactgagtacgctgcacggcggaggtagagcctctgggctttaatatcccaaacagaggcggcttataagccacagaaaccttacttttccagtttggaaggctgggaagctccaagatccacgcggcgccctataaggggcagggaaggctggctc

SEQ ID NO: 515455 - DNA, 366 bp, Homo sapiens
tcgatctagaggatcccgagcgggttactttccttatgtttatcagaaacttttctttccctgtcccttaatgtcctatccgcttaaattgattttactcccagtaatttctattcagtgcagaccttcatcctggagagggagagctgcttagttctaagcatttatagaacctagattgctatagcaccctctgatcttgtacttacacactgaagtctacaaggcccctgcttattttggctattttccccagtttgtgttcctttcccttgggagcatccattggcaattttgcattggctctcaagttcaacataaaacctgtggtctctccttggttccctcctgcatacttgccgatac

SEQ ID NO: 515456 - DNA, 104 bp, Homo sapiens
tcaaggaacgccagacgtcttttttaacaaggtcaagatgtatccaataaagtgaaagcttctcgttaattaaacagaactggagaatgaacatgaacacaaag

SEQ ID NO: 515457 - DNA, 177 bp, Homo sapiens
aaatagaaaaataaaacaacatttcaacaaattctgccaatgttgatattaagacctacctcacagtccccacccaacactacaagtgaaagggtaaaaacaaaaaattaacttttagtctgacagccttaaattaactgcgggaaggttcattttgagaaaaacaaaatttgaggt

SEQ ID NO: 515458 - DNA, 840 bp, Homo sapiens
  misc_feature (209)..(209): n is a, c, g, or t
agcggggggctggtccaagaatcagactttgagaaccgactgctttgggccaatctccatgagagaaagtactcaaccgtctgagttgcgaagtgtatttcgaccatttagccagtaacttcaaccttcaattgctcggtcttgagagggcatgactctggcatcctaatatagattagcccctcttccaggcagatcacgacccacanatacagcccgcaagacctcatgtgcaggactacagatgaggacatggagacgtgcagtggcagataggataacagtacgaagaagtctcagaggaccaggatatacccatcaggagctaagcagctgtggcctgccgtagaacggggccggctcaggtgtatggtgggttgagctgcatcttagacttgaaagtgctaacaagctgaagatggctaaacggaagttacgaaatggtatctgtaagtgtcgagaattgacatgatctggctgcatcacatatgtcaggttgttacggtacttgtgataacgatgaacgacgtacagaagacttcacaagaaggtctcgtcccgtagtgaagggtcccttccggcttcactttagagtcgtctgcgacgtgtattaggttcatctcattggggtgtggcaagggaccagagaagccctggtttaaatgatgcaggggtatcctgatggcaaagtgagaatgcttgatagtgtctgaaggaagaaacacgaatgctgatgcatgccagggcagaatcttggacttggaaaatcaatgagagcacaagattgcttttagatggaacctgattcaaatttttaatttgtaaagatccttaggaaga

SEQ ID NO: 515459 - DNA, 180 bp, Homo sapiens
ccaacaccttaaataatgattctgctgcactagttcatttacagtggcgttatgataatgatacctagcttgtcaaatataatacagcatgctgcatcacgttctggtttcatggtaccattgaaactaaaatgtttctttctaatgtgtcactcctgactgccactccttaaactagcg

SEQ ID NO: 515460 - DNA, 363 bp, Homo sapiens
cctgggaagggggccccttctgtttggggccctgttaactgtgatttattgcccttgggcagtaatggggtccgggggccccccccgggcccgatggggcccttaaacgctttgtcatggtttttccgggccctgggttttaaaaggactcctccctgctgggggcctcccggggccccttggaagtttttttttggctattgaaccgggcacggcccccccgaatttcgggcagccctttttcccctcccccccccggggacccttaaaaggtttcgaccaaccaagaggttttttttttaaaaaaatttgtttccccccgaaatgatggaacccaattttttttttaaagggcaagattga

SEQ ID NO: 515461 - DNA, 92 bp, Homo sapiens
acggccgtgtattactgtgcgggagaagtagtaccagctgccgagaccaacaactggttcgacccctggggccagggaaccctggtcaccgt

SEQ ID NO: 515462 - DNA, 150 bp, Homo sapiens
gaggactcattcctatatgggagaggggcaactccccttgagattagcttggacctgtatcaaacggtgtacgcacgaaatatcttcaacgaagcagccgaatatctatcaaaatggaaccaagtagtataaatatacctattcatatta

SEQ ID NO: 515463 - DNA, 990 bp, Homo sapiens
gttgctgcgcgccgggggtcgctcctggtgtgtcttccgctccagcttcgacccacttccccttgtccagtcggggtgggcagctggagaagagctggcggagccatggatggacgaagtggtccgctttgccaagaagatggaccagatggtgcagagagaagaacgcggtggagcattggatttgctaaaggagcttaagaatattcctatgacccctggaattactggcagtccacaagaatcggaatgtcagttaatgctattcgcgagcagagtacagatgaggaagttgacagtcttgggctaaagtctctcagtcaaatccgtgaaaagaattattagatgggccatcaacgtgagaaagaccttgaggaaaagaagaaagaacctgcagattacatctgcagaacgagccctgtaggcaagagaagaaagtacttccagaaggcaactgtaagcaaccagagagaggatgagaccaagatgctcgagatacttatgttccatcctttcctcgggcaccaagcgcttctgattctgtgcggttgaagtgtagggagatgcttgctgccagctcttcgaacaggggatgactactttgcattggagcttgatgaggaagacttaggatcctccacttgggagaagctgtattatccaagaacctagcgagtgcgacctgcgactaccgaaaatagagtacgaagtcggcatatccagatcttaaagatgcagacatcccatgagggaccatgtccctgtgcgagattcccccgggcttattgtgtgaactacggcgggaatgcgcgtgctgcggctgagggacgttcgtaaatgtggccagcacgcacaagctacatggcgcgacaggcggccccccttgtttcctgtgggcatcgatccaaagctgctcccgccccctcttgggtacagaccctgtggttcactgcacgcctcgtgtcgaacgtacccgcagggtctctctcc

SEQ ID NO: 515464 - DNA, 290 bp, Homo sapiens
gtttacccttctcgagcgccttcctcttgtgagtctggtgtttagctcccgagtgatgagttcagcattcgagggtctctctcggtgtctatctttgtccttagccatgtttctccttttgttggatctttcttggtcaagaaatttatcctttgaccctagaatttagggctgcttttcctattctgtcttgatttctttctgaagactgaacacctacctactcgtatatctactatctctatatttatcattattttcatatctttccttccttgcggtaaaagctt

SEQ ID NO: 515465 - DNA, 1279 bp, Homo sapiens
tctgacgtgcccccagcctcccccagctctgcagggaggccctggtgccaggagaccttctcccagtttctccctatgggtgccgtgacctgtagggcagaagacatctgagtgtgtagttaagcacaggcagggacaccaggaccgtggccgtgatagacatttcctctcgcctcccctctggatttctcagagactgttctgcgatgaccagcagcaaggtaccggcgccagctgtgtgacctgggtccctcgatcgcgctggtgtcttgcaagctctgtctctggggagtacccagtggagcagatgacaatcatagcccagtgccaatgcttcttcttgtaactctgtgtcgctgaatagcagattattgtctgaggtcctccctttgaacttcgccaggcacacggactttatgacaatccgacgacagtgtagactgcgccaggatgcctgtgctggccctataagcagggtccgaggctacaggatgaatcgacgattgagttgccatggcttagctaggactgataattgactgctgagatgcatagtgaataaggctaccaagtttgatagacgaggtgctagtttgagccctgtcggacttggtgacccggcgtaccagctgccaacgctgtgtgtcagctccaggacgtggggctgcagaggccccaggcatgtgcagttgcaagagccgtggccgatatggagattcggcttccaaacgtgtaggaacgccagttgggaaacagctggaccagggtgcttggccggcagaccgatatggccgatcaactttgctcccccgtggggagagccagttgctggttttcacctattgggcagaacgatgaagcagcccataaaatgtctggcgcgcccaaggttgcaagggcgcacactctcggaacggagaccaccaagtggtgtggcccccagaactgttatgtgccatagacactgcttgagtgaccacgccctactgagcggcgaaacacagccattgacagacacccaccgggacacaacaacgaagttcccgtcagggaaaccaacaacaagaaatggggaggccccgccgcgtgacacacaccgcgagccgcaaaccccgcgcggtaactttctgaaccacgtggagcacaggacaacgagagcggagtaactgaaagtccctctgccagcgagcgatagtaagcgcaaaaccacagaacagggagtgctcctacgaaacgaaggccaccccccgagcgtgcgcagtgattgagaccgctacaa

SEQ ID NO: 515466 - DNA, 473 bp, Homo sapiens
ggggtcaactgtgttggccgcaaagtccttatcaactgacctctggatccacccaactgggcgtcccactgcgcgtgccttacatgatgaagtcaccgcacccggccacggtctttgcactcagagtcacattgtacgtcaactgctgtgagctcttctgatgcgtatatcctatctgggagcggggtatgttgactatggcacccatttaccgactgaggaaatggaggccctgacgcatcacgaggcctgcacaacccctcaagtggactggctatgaacctatactaaccacgcgatgctggtccaaccctctgcatgtaaaggagatgaaaggtaggctatcggctaaagagtacacagtttatagccataagggaaatgtagtctggataggacaggcaatatagactcgctacatctctactgaaggtgtgaagaagccctaacctggttgaggcactgattacccg

SEQ ID NO: 515467 - DNA, 321 bp, Homo sapiens
  misc_feature (30)..(30): n is a, c, g, or t
  misc_feature (44)..(46): n is a, c, g, or t
  misc_feature (73)..(73): n is a, c, g, or t
  misc_feature (140)..(141): n is a, c, g, or t
  misc_feature (198)..(198): n is a, c, g, or t
  misc_feature (309)..(309): n is a, c, g, or t
ttaaaatcatacaggaagctgatcaaatanaaaatgttgtgtannnttctttgagttgtatttgtataaatcngttattaatatgcatcccaaaattgtatcatattgcgaaaatgttgatagatcttgttatatgttannggtaataattgttatcctgttaaattattgtataccacagaaataatgaaatttctntgtcaattgcatcagtaatcatggctcttctaagtcttttgtcattcacagatgattattgttttacttggattcttttcaaaagtggtttgtaattggctacagcctaanatctgcttgttc

SEQ ID NO: 515468 - DNA, 1017 bp, Homo sapiens
  misc_feature (9)..(9): n is a, c, g, or t
  misc_feature (18)..(18): n is a, c, g, or t
  misc_feature (22)..(22): n is a, c, g, or t
  misc_feature (25)..(25): n is a, c, g, or t
  misc_feature (27)..(28): n is a, c, g, or t
  misc_feature (84)..(84): n is a, c, g, or t
  misc_feature (87)..(87): n is a, c, g, or t
  misc_feature (90)..(90): n is a, c, g, or t
  misc_feature (113)..(113): n is a, c, g, or t
  misc_feature (120)..(120): n is a, c, g, or t
  misc_feature (135)..(136): n is a, c, g, or t
  misc_feature (140)..(140): n is a, c, g, or t
  misc_feature (156)..(156): n is a, c, g, or t
  misc_feature (166)..(166): n is a, c, g, or t
  misc_feature (169)..(169): n is a, c, g, or t
  misc_feature (175)..(175): n is a, c, g, or t
  misc_feature (212)..(213): n is a, c, g, or t
  misc_feature (268)..(268): n is a, c, g, or t
  misc_feature (289)..(289): n is a, c, g, or t
  misc_feature (302)..(302): n is a, c, g, or t
  misc_feature (321)..(321): n is a, c, g, or t
  misc_feature (324)..(324): n is a, c, g, or t
  misc_feature (330)..(331): n is a, c, g, or t
  misc_feature (337)..(338): n is a, c, g, or t
  misc_feature (340)..(340): n is a, c, g, or t
  misc_feature (343)..(343): n is a, c, g, or t
  misc_feature (346)..(347): n is a, c, g, or t
  misc_feature (350)..(350): n is a, c, g, or t
  misc_feature (355)..(355): n is a, c, g, or t
  misc_feature (358)..(358): n is a, c, g, or t
  misc_feature (365)..(365): n is a, c, g, or t
  misc_feature (371)..(371): n is a, c, g, or t
  misc_feature (374)..(374): n is a, c, g, or t
  misc_feature (378)..(378): n is a, c, g, or t
  misc_feature (382)..(382): n is a, c, g, or t
  misc_feature (390)..(391): n is a, c, g, or t
  misc_feature (422)..(423): n is a, c, g, or t
  misc_feature (463)..(464): n is a, c, g, or t
  misc_feature (469)..(470): n is a, c, g, or t
  misc_feature (476)..(476): n is a, c, g, or t
  misc_feature (484)..(484): n is a, c, g, or t
  misc_feature (486)..(486): n is a, c, g, or t
  misc_feature (490)..(490): n is a, c, g, or t
  misc_feature (495)..(496): n is a, c, g, or t
  misc_feature (498)..(498): n is a, c, g, or t
  misc_feature (500)..(500): n is a, c, g, or t
  misc_feature (504)..(504): n is a, c, g, or t
  misc_feature (508)..(508): n is a, c, g, or t
  misc_feature (510)..(510): n is a, c, g, or t
  misc_feature (522)..(522): n is a, c, g, or t
  misc_feature (525)..(525): n is a, c, g, or t
  misc_feature (528)..(529): n is a, c, g, or t
  misc_feature (532)..(532): n is a, c, g, or t
  misc_feature (540)..(541): n is a, c, g, or t
  misc_feature (544)..(544): n is a, c, g, or t
  misc_feature (546)..(546): n is a, c, g, or t
  misc_feature (549)..(549): n is a, c, g, or t
  misc_feature (561)..(561): n is a, c, g, or t
  misc_feature (565)..(565): n is a, c, g, or t
  misc_feature (567)..(567): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (579)..(579): n is a, c, g, or t
  misc_feature (585)..(586): n is a, c, g, or t
  misc_feature (593)..(593): n is a, c, g, or t
  misc_feature (603)..(603): n is a, c, g, or t
  misc_feature (615)..(615): n is a, c, g, or t
  misc_feature (627)..(627): n is a, c, g, or t
  misc_feature (629)..(629): n is a, c, g, or t
  misc_feature (638)..(638): n is a, c, g, or t
  misc_feature (640)..(641): n is a, c, g, or t
  misc_feature (644)..(644): n is a, c, g, or t
  misc_feature (657)..(657): n is a, c, g, or t
  misc_feature (666)..(666): n is a, c, g, or t
  misc_feature (690)..(690): n is a, c, g, or t
  misc_feature (693)..(694): n is a, c, g, or t
  misc_feature (696)..(696): n is a, c, g, or t
  misc_feature (708)..(708): n is a, c, g, or t
  misc_feature (712)..(712): n is a, c, g, or t
  misc_feature (746)..(746): n is a, c, g, or t
  misc_feature (748)..(748): n is a, c, g, or t
  misc_feature (751)..(751): n is a, c, g, or t
  misc_feature (758)..(758): n is a, c, g, or t
  misc_feature (760)..(760): n is a, c, g, or t
  misc_feature (763)..(763): n is a, c, g, or t
  misc_feature (774)..(775): n is a, c, g, or t
  misc_feature (780)..(780): n is a, c, g, or t
  misc_feature (790)..(790): n is a, c, g, or t
  misc_feature (795)..(795): n is a, c, g, or t
  misc_feature (806)..(806): n is a, c, g, or t
  misc_feature (809)..(809): n is a, c, g, or t
  misc_feature (831)..(831): n is a, c, g, or t
  misc_feature (845)..(845): n is a, c, g, or t
  misc_feature (851)..(851): n is a, c, g, or t
  misc_feature (855)..(855): n is a, c, g, or t
  misc_feature (864)..(864): n is a, c, g, or t
  misc_feature (873)..(874): n is a, c, g, or t
  misc_feature (893)..(894): n is a, c, g, or t
  misc_feature (897)..(897): n is a, c, g, or t
  misc_feature (911)..(911): n is a, c, g, or t
  misc_feature (913)..(913): n is a, c, g, or t
  misc_feature (925)..(925): n is a, c, g, or t
  misc_feature (927)..(927): n is a, c, g, or t
  misc_feature (929)..(929): n is a, c, g, or t
  misc_feature (935)..(935): n is a, c, g, or t
  misc_feature (954)..(954): n is a, c, g, or t
  misc_feature (984)..(984): n is a, c, g, or t
tccgggggnacgctactntgtngcngnngtgagaggggaattgccggtgccgccgccaccgctgtctgtgcggggaggtgtggnggnagnatggggatgttagagaagatgtnggagatngagaaggagatgggnngganacagaagaagaagggnagtgagtatnatntggggntggtgaaagtaaggtggggaagtatgggggggaggtnntggaagggtggaaatgggggtgatggaaaggagaggggtttgatgtgatgaagtngggtgatgggggggggggggngattggatttggnggggtggggaagtggagantgnggagtnngagganntncanggnnagngaggnagngggctangagtgnagnagtntgangtgtatgnntggggtgattgaatacaaaggtgccaacatnnagctcctggaccttcctggaatcattgaaggcgcaccaannaaaannccgttnccgccagntnatcnctgtnncncncacntctnangtcatcatcatnatnctnnatnccaccaanntananttncatagttctctnctgnanaantanctntantctgtnntcatccncctcaacaancacaagcctaanatctacttcaancncaataaagntnntgncatctcctttaantctacattnactcttacccatttctcttaaaanctnntncagctcatcctncacnaatacaatatcttcaatgcagaagtgcttttccnanaanactgctncncgnacgagttcatnnatgtnatcgtgggcnaacgngtgtacatgcnctnctgtatgtttataacaaaatcnagcagatctccatngcagangtgnacgcctggngcgaaaagnnaacagtgtggtcatcagcnnggnatgaagctgaactngnactatctgctgnananctttgngagtacttgccctgacctnatctacacaaaaagagagacagaggcagantcacagaggcatcatctccggaaagggctcagt

SEQ ID NO: 515469 - DNA, 117 bp, Homo sapiens
gggtgagatcgctggagaagagaggagaggagagaggcagagagcggtctcaggctggtgggaggggcgcccacctacccacgccctcccctcccctgctgcaggggctctggagag

SEQ ID NO: 515470 - DNA, 396 bp, Homo sapiens
agcgtcaggcatgagcggcagagtacgtggggcggccttaatgcctcctctaacttcggtttgattccaagtgcatgtaggcatagggcagcaacaggtggtgtggcagcagcctttgcttctgactatctaaagtgtctttaggggaaggttagagcctgggacaataaaccagtgactatgtgataccagagccacatggaaaatacgacgagcagctgtaaaacacacacgtgttgagcactttctacacctaggcccttgatgtgtgatataacaacgcatcaccacattcaatcctcacaaccaatacctaggaggtagattactgcagaagggaaatgtaaacacacagagatgaagtcactttcccccctgatgctataaatgtatgaa

SEQ ID NO: 515471 - DNA, 344 bp, Homo sapiens
tgcacaatcacactgaactacagtttggtgtttcttaaaaagttagacacaaatttaccatagaaaccagcaaacattctactcccaggaacctacctaaagagaaataaaaacatatccacacagaaaaacgtatgtgaatgtgcacagcagcatgattcctaatggccaaaaattagacacgatccaaatgtccattaattggtgagtagattaacaaaatgtattttcatgcaatggagttcagcaatttaaaggaataaagtattggtacatgccacaacatggatgaacttccaaaacatttgctaagtgaaagaagcagatacaagagtacattattg

SEQ ID NO: 515472 - DNA, 575 bp, Homo sapiens
ccgtgctggctaagctggtccgaactcctgaccttgtaatctgctggccttggctcccaaagtgctggaattacaaggcacctgcccccatacccggctaatttttgtattttcagtggagatggagttttgctatgttggccagcctggtctcaaactcctcacctcaagcgatctgcccaacctcccaaagtgctaggattacaggcatgagccactgcgcccagcaaggtgtcctctatttttgacaaacatttagctaagtgaatataacttctatttaatcaatattttagttttagaatacatttcataccaaagtccagaacatatttttggtcaatcaaggttccaaagatatgattaaaacaattctgctgcctatgtcatctccaaataaatcctaccagccagtatttctagaatagtacctttaaaaggttactataagaaactctagtccaaatatacatttatttcctgagcaaaaaggcaaataagctagatattcagctgtcagaagaaataaaagcttcaaaaagttacttgctatcggtcaacttgtctggagtagg

SEQ ID NO: 515473 - DNA, 187 bp, Homo sapiens
cctttccggaacattaaaaccattgttgagtgcctggcaaataagttcatcaatgttgccaagggttcctcgaattcttatcccattaaaaaaaaggacaagttggagggtgtggccaagtccaaccgttaattttcccaggtggtgcccaaaaaacctttttgccctttggggcagtcccccccca

SEQ ID NO: 515474 - DNA, 422 bp, Homo sapiens
  misc_feature (181)..(181): n is a, c, g, or t
  misc_feature (288)..(288): n is a, c, g, or t
gctaccacagtgaaaccccatctctactcaaaatacaaaaagttagccgggcacggtggcgggcgcctgtagtcccagctacttgggaggctgaggcaggagaatggcgtgaacccgggaggcggacgttgcagtgagccgagatcacgccgctgcactccagcctgggcagcagagcgangagtctgtctcgaaaataaataaataagtaaataaataaataaataaataaatgtaaataaataaatagattaaaatggaaaactaaaaaaaaggaaaataattaanaaaataaataaataaaccgtagccggccagtcacgatggctcacgcctgtcaccccagcactttgggaggccggggcgggcagatccactgggggtcgccagttcgagaccagcctgacccacatggagaaatg

SEQ ID NO: 515475 - DNA, 458 bp, Homo sapiens
  misc_feature (120)..(120): n is a, c, g, or t
gacgccacagtcgtgccctcggttcgttgggtcccgccctcctttgggggagtccaagccagcaaggccccgttggtgcgttctaaaaggcttttctaccggggacccgtgctggtggcntggaaggcaaatacatccccccttagggggggggggggcgccccccccccctccaaataaaggaacaaaaggggggggggccgcagttttttgggcctgaggcctgggcggggggggtcccccaaaaggtccaggtgccgggttcggcataaagggggccccggggggaagacaggggcccccccagaaggtttttgggttttcacccccccccccccccccggggggataaaggggggggggtcccagggggggggttttccccccccccccagggggtcaggcccttttcccggcccccaataacccccccataaattttttcttgggccatcaga

SEQ ID NO: 515476 - DNA, 424 bp, Homo sapiens
  misc_feature (108)..(108): n is a, c, g, or t
  misc_feature (111)..(112): n is a, c, g, or t
  misc_feature (125)..(125): n is a, c, g, or t
  misc_feature (138)..(138): n is a, c, g, or t
  misc_feature (140)..(140): n is a, c, g, or t
aattcctctttcagtgaggctccgtttccctaaagatccctgtcctcagtgggtctccccacacacgggcctctcactcacccactgccccaccccatttgtgccctnttnntgggccttaaagntcagacactagantntgacaaggagccctccatgccccggtagagaccatcttctctcaccactccttttgagagaaacagccctccctacaattctgttgaataagtctcctcctctgcatcctgtttcacaagtgaaagcagtttaacagaagaatgccagctcataaacgtagaaatgcgagaatgaggaaatccccattctgtaacccttaatgaaataattaaatcaggcagtgtgcactagtgggtgtcaaacccttaggtgaaagtgtgcaggcgaacgggtgctaattgga

SEQ ID NO: 515477 - DNA, 975 bp, Homo sapiens
gatccacctcgcttctgaccactcactgctctgacccagagcacctcccattctccatcctctctagattgtgattaaggtactggagacaaaaccctgtgaggactggccgatgcgacgcccgagaacgctccgcatgtggtcagtcgtcgatgatagcggatggcggcagtgtggaacccggcgaggctgacaccgttcccaaccatggaagatgaggtgcctgctccacgtccgaccatatctcgatcgcctctcccattgagtgatctcccaaggtgcgtgggacctgatgtccataggtattgcttcacgtgacccccagtaagcccttaagcaagagggcctggttccctgtaatgaaccaaatctccaggaagggggccttgatccctccgccttgctgagagtgaaccctcgtctctcctcacccgtccatttctatttctgggaattggggcttagtttcgaacctttggcaaggctgtgcttactaatgcccaagccccgtttacccctctccctataggttacacaggggagaccagggctcggagaagactgctgcacacttccgaatcattctgcttgccaaataggtcatcttcaccagttgactgacccaagtttaggaccattggttatcgtgttgtttaaaaaaaacacgatataaaaaaactcttgttgaatattcttgttatgctaggcagcaggccaggtgcttcttcccctctacggctctgcgctgggggctatggtagtacagtttgtgttcctgtgcttttttctgcttcccctggcaaatgacagggcttactctcccattgggctccttcccttttttcaaagaaccagcagggcccctgggccacaggtgccgattggggcgcgagttctcgacttgggcgcgtccgggtggtccggggcctccttcggggcaggaactctcgtccgagacaggccggtggggggacg

SEQ ID NO: 515478 - DNA, 447 bp, Homo sapiens
  misc_feature (25)..(25): n is a, c, g, or t
  misc_feature (205)..(205): n is a, c, g, or t
  misc_feature (208)..(208): n is a, c, g, or t
  misc_feature (240)..(240): n is a, c, g, or t
  misc_feature (442)..(442): n is a, c, g, or t
ttttttaaaaccgcgtgtgctcctntttggcatgtttgaaatggtgaatttttgcccgtaagaactattcagaaccattgcatacagatatattttttttctcccggtttgtatttgtttttggtactttcggtctactcccctccccactctactttttattttactacctccctcctcatacatttaatccttaaaaggtttntanctttgggccgccttggtcattatgcctccagnccagggtactgggcccaacgcgggatagacactcttatcaagtctttcattgaatcaaaacggtatcgactggcttctgtcaaaagtgtctaccttttgcaactctctgctgggcccttttttatttgctgcttctctgtggtatcagactttgtgaaaacagtgttgctagaagtgtgtattctgaataagctctgaatgngtgca

SEQ ID NO: 515479 - DNA, 400 bp, Homo sapiens
  misc_feature (84)..(84): n is a, c, g, or t
  misc_feature (87)..(88): n is a, c, g, or t
  misc_feature (101)..(101): n is a, c, g, or t
  misc_feature (114)..(114): n is a, c, g, or t
  misc_feature (116)..(116): n is a, c, g, or t
tggttttttaaagattttgttctcagtgggttttctatatatgggttttttatttacttactgccccaccccatttgtgccctnttnntgggccttaaagntcagacactagantntgacaaggagccctccatgccccggtagagaccatcttctctcaccactccttttgagagaaacagccctccctacaattctgttgaataagtctcctcctctgcatcctgtttcacaagtgaaagcagtttaacagaagaatgccagctcataaacgtagaaatgcgagaatgaggaaatccccattctgtaacccttaatgaaataattaaatcaggcagtgtgcactagtgggtgtcaaacccttaggtgaaagtgtgcaggcgaacgggtgctaattgga

SEQ ID NO: 515480 - DNA, 158 bp, Homo sapiens
tcccaagatgaggaactggttgggtgataattaaataaactttttttttactagtaaacctatggtagaaggctagcttatataactaaagggtaagtctattcagttcttttggtcactacatttacaatgttactatgtgctatcaacaaaatata

SEQ ID NO: 515481 - DNA, 84 bp, Homo sapiens
gggagatggatcatcgagggcaggagctcaagaccagacggctaacatggtgaaacccggtttctaaaaaaaatacaaaaaaaa

SEQ ID NO: 515482 - DNA, 1245 bp, Homo sapiens
tctttatgattattattttttccaatgccagtgctgttcagccctcagaaggaatcttcagttcccatggaaataaacaatggactatataaaatcccacctttctggaaactggcagtctggacctcaggtgaaggctcaggtagaaatgtttctattcccaaggcagcccatctggtgtcccatcaagagatgtcagggttctccaagtgaggggagctggggcctggggatccctggcctcccaagtcactatggagcatctaagtctccataaggggcagggggggggggggaggggcaggtctaaaactcacagaagtcaagtcttaagaccggggggtgacccaaatggccataagaggtcaggcctgcggggcttggaacaccaggcgcggtgtcggcgcaatccggtcgcaaatacgtggaggtctatccgggcaaggcagaggccgggcccctcagagcagggggccaccatggttcccccaggggtctaaccaccatgtggggcgccaataatggacgctcttacacaaaggggggcgtcccacacctggtggactagttgcccatatacaaaaggccacgggggtatcgagataaagccagggggccccctcgaagaataggacctcaccaaggagggagatgagagcgcctggtaatgtggatctcccacaagagcgtagaagggacaacgcgaagtacctctgagcacccaagtgttggaaccccaatgtggcccagagacaaaagagagtttccagaggacacccgcgtatggtttcaattaggcagaccacaggttagaaccccaacttttgagcctgcgtgtaggggtgtcgctggaaccggggtgtgactctcaaagagctgtggggccgccatggtccagttgataaagatgttggtgtttaccaccgccaatatagggccccccctttgcccctggtgaaaacctcttagagacgtgtcacacaaggaagtggttgtttcatcccacgtgagagaataggggccaccataaatacgtgcccccctgttggatgtgtgatacaaaccatgctacgttgtagcaaattggtgataataattacctggaaggtatcggtagctccgcaagtagttgtgtgcacacgctctagagagaagaaccccccacagaggtatactgcaaagagatcccaattctccggtgaaacgaaggggtgggagttagttcccacgaaggatgtccgcacc

SEQ ID NO: 515483 - DNA, 164 bp, Homo sapiens
gtttttcttcgatgcttctttggcaaagcagttgtcacacggcgcggctcggtccgcgtgctgcccctgcctagggaggtgccagccagggggggcagcccctttccccatcagcctcagcacagccacgctgttcactagacagtggagaagtttctctagtt

SEQ ID NO: 515484 - DNA, 210 bp, Homo sapiens
ccctcctgcttactgtgatggaggaaggaattgcaccccagaacacatagcaggagtgcccaaggaggaggaagaggggctgagaaccatcactggcccgtgctttgccaacttctcattgtattggcctctgaaagactgcaggtgtagcaagcaggggatatatatcaagcaactgcaagtattatctcgcgaaagtcaacgatgggt

SEQ ID NO: 515485 - DNA, 731 bp, Homo sapiens
gaatggcgtccgcggccggtgtcggagcatggatggacccccagagctgttttatgacgagacagaatcccgtcaaatacgttcgcaagtgaggggagcctgaatactgcggggcgtccgggggtcgggaagcggcaagtagccctgtatgctggcgttgcccggaaaggccgtagaatatggagggtgcgggaaggtgaagtgacccgggtgggtgccgattatcttgtctctggtaaatcaactttaagttgccgacctctctgtggcctcggtacctcagctgtagagctcacggatgattgatatccagaccaggatggctgggcgagcatatggagcttctattatcttgccagagaataagccctgtatacctgctggatatttggctgtggcactgggctgaagtggaagttatctgtcagcatgaagggcactatatgggtgggcctggataatcagccctgccaatgcaggatgagagctgtggaccgagaagatagacgggagactgctgctgggggatatgggccagggcatcccatatcaagccaggcacatattgatgggtagcatcaggcattctgcttgtgcaatgagtctgtaatgctaacaaggacgtctgaaaccatgccagcggctgtacaggttaagcgtctctaaacaggcctcggccgggataccagcggctgagtgacctgagagcaagaatgagtttaaaacggcaa

SEQ ID NO: 515486 - DNA, 341 bp, Homo sapiens
  misc_feature (64)..(64): n is a, c, g, or t
ccgagatcacgcaagtggtcgcgatcgcggtgaagatgaaggcgaccaaggccgatttcgacgnccacggttgcgctgcatccgaccgcggccgaggaactcgtgacgatgcgcaccccgacggcgcgccacgtgcggcaggcggcggagtagggcggcctcgttccttaacgccgggttggttcgtcgttgggtgccaagggcgccgccttgtgcatcgagacgaaagtccgtcccatcgtgacgttcttctgggcgcggacctgcgaattgtcgtaggtccagcactcgccggaatcgtcgagaaagacgacccacagcaggttgaactccgctccgta

SEQ ID NO: 515487 - DNA, 210 bp, Homo sapiens
gctgttcccaggatggtgatccgtgtatatattgcatcttcctctggctctacagcgattaagaaggaacaacaagatgatgcttgatttcctagaaggccaacaaaataggatttgaggagaaagatattacagccaatcaagagaatcggacagtagactgagagaaaatgtacctcacaatagtcgaccagccacaggttaccccct

SEQ ID NO: 515488 - DNA, 487 bp, Homo sapiens
agccggagttgcggagccttaggctggagcgaagagaaccggtcgcggcaatcctagcgcgcagcagcagcagcagcagcagcacctgcatctgagcaggatccgagccggaaccagcgacgcaatgtaagcatgcccgtttccgtcttcgtgatagatcgtcagcgcgtaacactatcagcaggagccgcagttccacacgatggaaaaccaggcacgcacgataggcccggatcgagtctcctaccttggtttgaaagcagttgtgcgcaatgacacagcagcaaccaccgagcaccagcaaattgacctagccgagactaggaccaaatagacatccagggctgtacatgcactgcagaggaacgctatagcactccacatggccgagaatacgcaatcctgcccaggcgtattgaaggcctcgcgcaagtcactgtcgagccccggggcaatcacactacgatttggtctaaccacatgcatg

SEQ ID NO: 515489 - DNA, 543 bp, Homo sapiens
gggcccatatttgatctgtcaaggaaactgttggctgggaactcctgaggtcaggagttcgagaccagcctggccaacatagggaaaccccatctctactaaaaatacaaaattagctggccatggtggctggcgcatgtaatcccagctacttgggaggctgaggcaggagaatcgcttgaacctgggaggcagaggttgcagtgagccgagatcgcaccatgcactccagcctgggtgacagtgcaagactccgtctcaaaaaaaaaaaaaaaaaaaaaaaatttggggggggccggaccctaagaaaaggtttcctaaacccattctcttgttggcgcgcgcggcccaagtgagtggatcgccaccctggcccaaagcttggcccaaaggagaagccgggcgccatgggaaacggcgcgggtttcccccaaataaaaaacccgcgggggaacccggggctcctggaacaatcccaaggggggcccgagcgaatgcgggtcccaccacggggccagggagcgaataatacgggcgggggag

SEQ ID NO: 515490 - DNA, 329 bp, Homo sapiens
  misc_feature (77)..(77): n is a, c, g, or t
  misc_feature (132)..(133): n is a, c, g, or t
  misc_feature (136)..(136): n is a, c, g, or t
  misc_feature (164)..(164): n is a, c, g, or t
  misc_feature (260)..(260): n is a, c, g, or t
ggggcggaaaagggtaactctgctgggcgcatggggcgggaaagggtaactgtgctgggcgcatggggcggaaaagngtaactgtgctgggcgcatgggacgggaaagggtaactgtgctgggcgcatgggnnggnaaagagtaactgtgctgggcgcatgggncgggaaagggtaactgtgctgggcgcatgggacgggaaagggtaactgtgctgggcgcatgggacgggaaagggtaactgtgctgggcgcatgggncggaaaagagtaactgtgctgggcgcatggggcggaaaagggtaactgtgctgggcgcatggggtggag

SEQ ID NO: 515491 - DNA, 177 bp, Homo sapiens
actagaggtatcccccggggccacacggatgtggatcacttgaggataggaatttgagaccagcctggcttaagaaatgcgagaacttgtttctacaaaagattaaaaagactaaaaagtggcaaatttgtcgaacccataacccactgtaaccagtaaactctgagaggttgaggc

SEQ ID NO: 515492 - DNA, 915 bp, Homo sapiens
  misc_feature (159)..(159): n is a, c, g, or t
  misc_feature (167)..(169): n is a, c, g, or t
  misc_feature (173)..(173): n is a, c, g, or t
  misc_feature (183)..(183): n is a, c, g, or t
  misc_feature (192)..(192): n is a, c, g, or t
  misc_feature (201)..(201): n is a, c, g, or t
  misc_feature (223)..(223): n is a, c, g, or t
  misc_feature (226)..(226): n is a, c, g, or t
  misc_feature (230)..(230): n is a, c, g, or t
  misc_feature (235)..(235): n is a, c, g, or t
  misc_feature (286)..(286): n is a, c, g, or t
  misc_feature (312)..(312): n is a, c, g, or t
  misc_feature (355)..(355): n is a, c, g, or t
  misc_feature (374)..(374): n is a, c, g, or t
  misc_feature (404)..(404): n is a, c, g, or t
  misc_feature (414)..(414): n is a, c, g, or t
  misc_feature (421)..(422): n is a, c, g, or t
  misc_feature (428)..(428): n is a, c, g, or t
  misc_feature (442)..(442): n is a, c, g, or t
  misc_feature (445)..(445): n is a, c, g, or t
  misc_feature (458)..(459): n is a, c, g, or t
  misc_feature (479)..(479): n is a, c, g, or t
  misc_feature (915)..(915): n is a, c, g, or t
cctgctttctcatgcctatctccagtcaaagatgggatgcttaatccaactctggagagggaccaagtcttttctgcccacatctcacacaattgaggtgtctgaacaagcttggggagggtctataaggggtaggctcaaaaaaaaaaaaacccattngcagaggnnntttngccatcacangggctcttncaagccgantttcacaaagagagccggactngtnagtnggctnctgtctctttagagccaagaaaatagtaattaagtggcctagatataggangggcagaataagcacttactcccccngcttccaagatgaagaggagaagcaggccaaccctcaataatngcaagcctgaagagaagtnatcttagagaaagcagagaacagaagggcntggatagacntcttganntctatncagcccgtagtctngtnatctggagagtcnngttaaggtaacccagatttngacaaccgcttcctgtgagcaaagttttctcattacccctccatggggaagcaggtgaggccaggcttgttccgtgggaaattctctgctctccatcttcgtgcatgggcatggtatgtgcaagtgtcttaattcttgcccatttatgctcaaggtggcctgaaccactaggagtggcggggggggtggatgggtttattcatgtagtgaccgggggggtttaataaaagacctccctattggggtcaaccttctaagggtgaaaaacatggtgtgtaaaaaaaagaggggggaagatccggggcacacgaccggtttgtaaaggcaagggggaaacagagagggtaaggggaaggacgggtggagactccggtggaccgatcctttttttttgtgtttttttctctctctcttgctctttttttttcggaaaagn

SEQ ID NO: 515493 - DNA, 233 bp, Homo sapiens
ggcaaaaagggttttaaccgggggggggggggggaaaggccttttttttttttcccccttggtttccaaaaaaggtccccgttttttgggggttgggttcccgggggggggcccccgggggtttttttgtttttttccctccccctgggctttggggtccgggggggaacccgggcccccgggttccccttttggggggggaaaaccaaaaaaagggccccttttttttggga

SEQ ID NO: 515494 - DNA, 298 bp, Homo sapiens
  misc_feature (46)..(46): n is a, c, g, or t
cattgtgacgcacctactatgtgctgggtgctcccacacttgtggngttcacggggcctcaaaccatttaatcaccatgtgtaaactgttgtgggcgctgttccaggctaaggagactgaggcttagcgagcggacggcagcccctccacaccacgtggctcgtggttattagccaggctgtgtcatgtgacggcccccgagcagagtctgggcctctgactctgagtccactgatccatttataaccccaggcttgacctgcgactgtcggcgaggctgtctggggcctttatcaaa

SEQ ID NO: 515495 - DNA, 954 bp, Homo sapiens
  misc_feature (1)..(1): n is a, c, g, or t
ncgtatgagaagatccaccaatcttgctgtgtgtctagtgagactcgtagaagcccaccagtgtgccccttgggcccccctttttctcagggcgagttgttgttgcgaccctatactagcgggcgcccctttcttccgcccccagtgtattgtgtgacgcttccccttcccgggttttgggcccgtatacaaccactctctggaaatatcgtcccacggttccagcccccaattgtcacgcggctaatttccctctcgggccacggcacggcgcgtgtcctcaagggaaacccgggcgctcttgtcgtgtgcccacataccactactgtcggaacaattgcaccattctcatgcgggaactccccccggccgtttttgtcacccccacccccgccatgtaagacctcccagccgtcctccccccgggcatgttttggtcgtgcgcggctaacccctctgattaaatttggggcaagggcaacaccccaatgttcaagccatttttggggcaccgcttcccaaacaacctggggtgactttcgcccccgcatcacagaagttaggccttctccccctctccgggaaattacactcaatagcatcgcggataatcaccactgggccctagtgcatacccctcccttaaaagaacctggggagaacgtcaacatgcttctaagcccacgctgacgtggggagatccttcaaggattgttctcaacccagcaaacgagggctttgaaaatgtggtcccccttgcgggtcccaccacctgttccccccaaagactatcccacgtctcaaaaggacaaccatgagaactagcccggtatgcttacaagaggagaatgatggagtcgtgagctgctctctataatacccatattatatgattgaacaagccccttgcccttttacttttcaaaaaaaaattttcccctccccccaaaaaca

SEQ ID NO: 515496 - DNA, 270 bp, Homo sapiens
gtcggggatgcaggtatggcgtctgtctgcctccaggtcatggcatgtgcaggcgtgtgagctgggggccggcaggagctcgtacagtgcggcgtgatcgaacagagggttgcgcacctccatttccccggtcggggccagtgcccgggcactcgtacaccgtgaagtctccgtcctcattctcctcatccgaggaggccgtgtccagctccttgagtggcactatatgccgctccaggcacagcatctgttgccgttaatgctggacga

SEQ ID NO: 515497 - DNA, 332 bp, Homo sapiens
  misc_feature (315)..(315): n is a, c, g, or t
cagggtatagtgcagtggcgcaatctcggcccaccacagtctcgacctcatgggctcaagtgatcctcccacctcagcctcccaagtagctgggactacaggcatcctccaccatgcccagccaattttttgcatttttcatagagaaggggcttcaccatgctgcccagactggtctcgaactcctgggctcaagccatggaattgccttggcctcccaaagtgttaggatcacagccgcgagcccctggacccggcctatagtttttgtttcgctttgtttttgttttttgagatggagtctcaccctgtcanccagatgggagtgcagc

SEQ ID NO: 515498 - DNA, 349 bp, Homo sapiens
gttccttagtcttatttaaatgttttatttactggagatggatctgctccgtgcctgggctggagtgcagtggcacgatctcggctcactgcaacgtctgcctcccgggtttaagcaattctcccgcctcagcctcccgagtagctgggactacaggcacgcaccaccacgcccggctaatttttgtattttcagtagagacagggtttcaccatgttggccaggctggtctcaaactcctaacctcagatgatccacccgcctcggcctcccaaagtgttgggattacaggcgtgagccaccacgcccggcctgatttttgtatttttagtagagacaaagggaaaca

SEQ ID NO: 515499 - DNA, 317 bp, Homo sapiens
gaagtagcccgggaaggttggaaacccgcccccaggattgcccccccgtaggacttcaaaggccaaagggtaaccttctattgaagtacttcataaaaaaaaagcaatcccttaattcggatcatcaaaggtttttgaaaccaaggggcggaccccaacttctaattaaagggtttccttgggtcttcccaggggtttttggtttcccttcaaaaaggaccccctggccttcccaaacccctgggagagcacagccctgggtcctctgggccccttttaaaaacaatttccccaaaaatcttctaaaagaatttggg

SEQ ID NO: 515500 - DNA, 1588 bp, Homo sapiens
ctgcgcgcgagccccgtgtcccacggctgggcatgcagcggctggctgtgctgtgctgtgctgaactgctggatgtgtgtgtgctggagtggatgcccgctggctggctgtgcagcatgctacatgctgaacatggctggagacttgtggcttgacacctcggctggctgatcaccaatgcctgctgaactctgaattgacgcctaacggaccctcccagcgaactttccctcgacgatcggatcgttgatgcaacgcctgcaaactggtaggtgggtctggcctggggccggctatcatcactttacgcaaattcagttgctcaatgaccaaatctttcctactttctcaacgtctgcaatcgacatctacctgttacgacacgaagggataccacgttgacctttgaaacttgcgcatgccgacagtgacattacgcgacagacgagcagccacacggctccgtaggatatcaccccgtttcccctggggcaacacgccgttcttatgccgctcaagccttccccttttctccgacgcgacgattcgatggcgacattaattatctgcattgaccaacttttctaacttctgcagggcaaagccgcaacacccacactggcgtcttcgtcgcacgcacggtctttattacaaaccacaggggtcatggcttggcgcaccaatcctcattcctttgtgctaacccggaacaatcgcgaaacgccggttcatgggatcctttaccacacaccgttttgtttcttcgtctacgcccaaccgcaccttgacacaactttaaacttacggcattttaaccacacagcgcctttattacacttcctcacaattcgttaccacagcttacaagcacctctttggcgccattggatcgactcttttcgtgcaaagcgcaagcggtgggcgccaacatacccggttcgacctacattttcagcgctccgaagttatgcaatacacgccacctcccccagctagcaacaggaaaaggtttcctattaccgcctttattagtagggcacatttcatcgtctgctccatgcgaaaagacgctttggggctaattaaccaacttcgccgcttttccaacggtaatttccgtaaagcccacctatcaagttttattcctaccgaggacgtctggggagttagctggatatatcggggcagcgttactcgacgaccaacatggtgtcacattcttccgcctattacgatcagcgaaggtctcccctccatcatccgaggccttatccattataattaaagctggcgctatcttatcgtgtgacttgtccaagatggtggcgtgtgtccagctatattgtcgccatatcgaaagacccgtgttcatatccgagcgtgtagaaatgttgagccgggtcaacatcaaatcagcggttcgatgcacgatggctttctatttgtcacggctgtcttgcactgtgtattgtccttgtccattttcactgcaatctatttcacccgatcactgtatgatgtctagccccattttcttcgcaccacgttgtcatgccgacgaactatgtcgcactctccgctcatcacg

SEQ ID NO: 515501 - DNA, 127 bp, Homo sapiens
  misc_feature (31)..(31): n is a, c, g, or t
gagtgtaattcttaattattattaaataatncattgaatattgacaattttacacagtactcatcaaaacatcctagacccgggaaaagagattcattcagtagctttttcgcagagtacacaaaga

SEQ ID NO: 515502 - DNA, 1698 bp, Homo sapiens
gttctgcagccatgttcctgtgttaactcgttcttgaagtggcgtgcgtgcgtgcgtgcgtgcgtgggtgagtgctgtgtgtgtgcctgtgtgtgtgtgtgtgcctgtgtgaaattgttgcttgtgagtgccttgatcatgctgtgtgtgcctgtgtgtgtgctgtgctgtgctgtgctgtgctgtgctgtgctgtgcgtgctgtgctgtgctgtgttgtgatgtgctgtgctgtgtgtgctgtgttgtgaactggctcattgctgccatccgtagtgctggatgtcagtcatgctagccatcatgctgatgtgctgtgcttgctgcatgtaacaagcgcctggatgccccactgccaccacaactgcaacacagttacttccagacagtttgatgtgccggactgatgatgttgatgtgatgtgtcctgtgcgatagtatcctggagtgagcttcttttgctcgcatgcgttgggcattgggagttgattgacaattgtgatgtggtcagggctgccagcaggaaagcttcagttgagatcagttatctacagatagattgtggtttgttgagcagctgagcagcgctcttgagtacatttgaacaggcagcttgagcttgtgcttgcttttgtgcagattctagagcagcgagtttgtctggcaatggcagttgggtggtgctctgttgtagtttgtggagttatgcctgcacaagcgctacattgtggctacagtggcctatggggcgtatattagatggtggacatttacacagaggggtaaccgttttggattggtggagagcaagacactaggttctagaagacacatgtgttttgtggctcatggaggcaccatttacgttagctagagaagcaatgggtataccagaagcaagcctttggaagctctggacgtccaatgagggagctcccacgtatcttatggccactgcgtagtggttgagaactttccccctagtgtggttagcccagtatttgaacagtgaccgagtgccgagtgtgctttctctccgatcgctttgaaaaagttgtagagcgaatccgatccttactacaccgcgattgtaattctattcccggtaacgtgctttaacctttccagcggattgcaaatacgcgcttgtgggccaacacctagtgtgtagaatttttgtgaacaccacaacctttctcgtatctcgatggcgcttagctctgtgtgactcaccgagtgggcactttgtgtagcagggcgcaatagtgtgattacccctgattgggccccattatccagtaaacacttccttcttttgtgcagcataaacagtgactttaggcgcacccattggtcgaactaacatactccgcacagaggtgtggaagcagaaggttccaaaggtgaggatgtttggcctttgcatgtgccttcggggtaattttatatttcccttacgtagccatctatggaggagaccactacaacaacgcccggtgccccgcagtccacacaagatgccgatagacatatgacaaggaaggatcatcagttaggtaggcacactcatcgatcatgcatcacgcaggtggtacgtacaagctacatatgcgcgtgtgccaagcgcccaattcataagagggaggacgtcctgtgttataatcccacaggacagctgataaggaggcatcagagtag

SEQ ID NO: 515503 - DNA, 494 bp, Homo sapiens
cacgaggctggagtccggcgccgggggcggccgggacgccgaattgcgcagctgggtggcctgtttggtgcgccccctcaccgaccacctcgaggagctgggaaatccgacctggtatgcgcggttcgcggcgcaggcgatgaccgatcccgcctactacaacatcatcgtcaagggcgcgctcagctcgccgtcgctggtgcaggtcgtcgagggcatcaaccgctgcctgcccgacctgccggccgaggtgcacttcgaacgcaacgtcatggctcgaaacctgttgatgcacacctgcgccgaccgtgaacgtgcgctcgccgcgggcacgtcgacctcccatcgttcctggcgggccgcggcatccggcctcatcgacgcgatcgtgggcctgtggctggcgcccgtgacgccgtacgagtgaaggactgggcagatgaaagtgaccgtcgaccaagacctttgcgcatcgtcggggaactgcgtgatga

SEQ ID NO: 515504 - DNA, 88 bp, Homo sapiens
gccacatagccctcgtagtaacagccattctcatccaaaccccatgattgtgaggggtaggagtcaggtagttagtattaggaggggg

SEQ ID NO: 515505 - DNA, 140 bp, Homo sapiens
ggttgccggatgacgacacaggttcctccctgaatcagttgaacaaagctccactgcacaacaaggttatccgccaacgcgccgctcccttgagggtggtgcggggtcagtcgtcggatagtggtaaaacagttcaggtc

SEQ ID NO: 515506 - DNA, 1218 bp, Homo sapiens
cggaggctcatgggatcgggttggtcgaggctagactcgagaaggttcggtgtcgctggaacaggcaacgacaagggcggcatggcgggcgtgaggcctggaacacacgctgcgggcgcgcagagggcaaggcgcgagccaaggcggggcgcgacggtcgtagctagggcttgacgctgcggacgagcagtgcggcgtgccgcggtcggattcgaacatgcgactcgcctgagcgaggctgcgccgcgtgtgtggggacgggtacagagggacgtgcgtagcgagactccttgggccacctacgcgtaacacctggggcgccatgtgctgaacgtggcgaggcacaggctacgcacgggagtggaatagcgcacacctgcagtcgctgggcacagccagagcaagcaaatccattgggccttagccttacgtacagaccattgcgaagccgcagcgaaatagaaagcggccacacgcgcatgtgagcctcgtggtgcattggggaggttcgattggaatgactgcgaaacggaccttggagggatactggcgttgcagagggggaccgccgaacggacatactccggggattgcgtgtgtacggggcagcggagtacgcgagcggacgggcatgggcacgggttttcgggaggcaaaggcgtccccagggggatggccaaggcattgggaccctctggaaacgcagtcgaggggtgcaccaatggatggcggcacggccttgtggaccttgttggcgaaccgaagggacaccaagggaaacacgttctaagcacgtgccacaggttggccctgtggacaatagggcacggaatctccgcgagacattcgtggcaatggcgtaaattggactggggcgaaaatttcgggggaggtcccaaggggccacacccattttgccaaggttggaatacggccccgggacaaccgaacggttgtgtgtatcgcgtgggtatgcccaaacaatgaatgtggttggcgacagaacggctttgagaaccaaaatgcaaacagccatggagcgtgggcgccacatgacacaggagcgggccggaaggcaaaggccacttggcgttccccggaggccaaggggtgcccacaagggccgaccagtgaggaaggcccacaacgtgggacacatttatcgcctgagagttggccccaaagagcttgggccgcagagggcccacatgtggagac

SEQ ID NO: 515507 - DNA, 327 bp, Homo sapiens
ttgtctctgagccttggctcgctcatccataagatgggagtgatgaggctgggcgtggtcgtcacgcctgtaatcccagcactttgggaggccgaggcgggcagatcatgaggtcaggagatcgagaccatcctggctaacatggtgaaactccatctctactaaaaatacaaaaaatcggccgggcatggtggcgggcgcctgtagtcctagctactcgggagactgacacaggagaattgcttgaacccaggaggcggaggttgcagtgaccaagatcgcgccactgcactccagcctgggagacagagcgagatccgtctcaaa

SEQ ID NO: 515508 - DNA, 183 bp, Homo sapiens
gtggcggcgggctggagcaggtgtggtggcatgcactgtagtcccagctactcaggaggctgaggcaggaagatcacttgagctcaggagtttgatgccagcctaggcaagatggcaagatcctgtcttaacaaaaacaaaaacaaaacgagattggggaggtgggtgcccagtcccctgttt

SEQ ID NO: 515509 - DNA, 229 bp, Homo sapiens
gtcggcccgagtttgtttcatgggtgaggggtggatttttggcgtctttggtcagcgtatacagaagtaggcctggtgtgtgatgctgatggagatacatgtgggacctctttttcttgaatttccttttttcccccatagtagtcctcctggatcacaggggactgtggtggggattttgagagagcccaagaaataacactttgtctcctaggttctaagcaaaaag

SEQ ID NO: 515510 - DNA, 762 bp, Homo sapiens
ggccgggcaggcgtggtgctgctggagtggctggtaccccgcagcaggtgggctggtgtgcggttggctggcggcggctgtggccgggggctgccggctgctgctcggtgccgtgcgcggcggccgtgcgggcacgccatggacttcaacatgaagaaggctggctgtcggacgctgggcatcttcttcacccgggcggtgcagttcacggaggagaaagttttggccaggctgagaacgactgagcttgatgcccactttgataaccttctgtgccctgggcagacaggaccaagaactggacagagaagatcttgaggcagacagaggtgctgctgcagcccaaccaccagtgcccagagtggatggagttcctgtatgagaagctggacaggaatggtcccctcaagggtcaccaacggggagctgctggctcagtacagtggcagacgcggtcagtgagctgtgggccgaccatcgccctatggggaagacactgatcgaaggtggcagaagcgtgaacaagcaactggtgagccagcggcgacgggattgatccaactggcctcaatcagcttcctcaggacctttaggcaacttcctggaggcgggactggaagaccatctcgaaggacgacggcggctcctccaacaaccgggcgtctggacttggatgcctgcaaagcgagggtgaagaaggcaaaggctgagaagcaaaagccagaagggtgcctggactttcaggagactagaactcgtaaa

SEQ ID NO: 515511 - DNA, 161 bp, Homo sapiens
cttttccccccgaaaatttgtttttttacagaatccaggttttcccctccctcatcacgggggttgcttcctttgaaagtttaaaccacgggagggttttttttccttcctttttccttccccagtttcctttgtcccaattaaaaccaggatggagagca

SEQ ID NO: 515512 - DNA, 754 bp, Homo sapiens
ttcatttggggtttcggttcccccccttccccttccccgtggtgtctgggtgtgtgacattgcaccgcgcccctcgtgggtgtcgctgttgccaacccactggcggacaatccccagactggcgctgcccctcccatttgaactgtcctggtcagtgcccccaccccagacatttcccaccatgaccagaacaaatggggggcatgcgagtgaattataattcaggctgcacatattcagtcgacagtaacagtgacacaggccctatcaagctgctatatatctatgaatcacttgtggcattgggtgaccctgcattcagcgattatcaatcctggtctgacaggggcatttatacttgagctatgagtcttcccattgctccctagtgtccatctagtgtgtcttgagttcatctattgtgtaccaatgttgacctgaccctgtgatcaaggattgccaccggcatccaagtaacagagctccctgatattaataggttgattgcttgtcatctagtccatatactaacaaggacggtagtacacagattatgaccatacatacaaagcatgcattaaagcaagtgccagcattgacgagcgcgttagccattcgctgaagtgaggaccgagaagatcacccacatatccatcccgcccaaaatggccctatgttcccggtctcatacactacgggtatcatacagtggggtatcactgtaaacctataatggtgatccattgtgcaagtt

SEQ ID NO: 515513 - DNA, 672 bp, Homo sapiens
aggtctgctatacagctcagaactctcgtccggatcctgctcaaccatggtggctttatgggagagtcccttggccacggaagggtgaatgccacgctaatcttgcttttgagaaaaatctacgctgggaatggaagtgatatgtaacacccttcacgagaaagggcttatatgaggagagccacccacgagaagaaggaaggagaggaagaagatggagaatacacgaagagaccaccctcaaggaggaggagagaagaaaagcactgggaaactcacggaggtgacactttcccttcaactcctgtttcctaacccacaagggggagagaactggaggcctaagctgcctgctaactgggctttacactggtgacagacatttccgctgggatagggaagatagcacggagagaaaagtaaaactccatagaagtgtcattccacctgggttttgatattggcttagctgccacgtctcccacatttgtgaacctatgccaatccatctataatggaggatacccacatttcttcctaatattttataatctcccactcctgaaaacccctctttcaactaatactttgctgttgaaaagttgtgaaatgttaagtgttctgggaatttttttttttaaggaaaactatttaagtacttcctagtaggga

SEQ ID NO: 515514 - DNA, 207 bp, Homo sapiens
atctaatacatagagataggctacgatcctattactgctacgtgtctggttatcattcgttctcgaagttcgtatagcttagtcatagctatgtcctggataaaaagttgtagatgagataatatggaggtggggatcaatagagggggaaatagaatagatcagtactagcggcgggtaggcctaaatatctctacggaccaatag

SEQ ID NO: 515515 - DNA, 631 bp, Homo sapiens
tgtcgggcctcgcgggcggctgacggagtccgggatcgtgtgcctcgagctgttcgggctggagacgaggccaggtctccagctggtgtgtgtgactgtgcccaccagctgccgaagtgccaagacgccaggtccggtggacgtacaagctggacatgacatggtcctggtgttgacggtgaggacatgaggaggcgcgtcggcttcctgaacaccttaggctgtggggctgcggcgagaagcgggtctgttctttacttccgtccacggagtcgggcacactaatggctgccctctgggctcccatgaacccagtaacatgaagatggtgaaagctagaaggaaccaagacgctcatcatgtgccatagcattcaagagacacgcatcggaatcagctagcgcgccggcagcaagtccaaacccggcaagcaggtgctgaacctccgatcgttcatggccaaccccacatgctgggcgtgactggtttgaccacctagtcctaccacgatcatcccgagagtctgagctcctccagcgggggtgacgtcgtccgcagcgactccctcttcttctttttcatccttctgtctctttgtttctgaggctttcctgtcgtttccttttcctgg

SEQ ID NO: 515516 - DNA, 408 bp, Homo sapiens
attagatcctcttcctcctcccactctccaccctcaagtaagttccagtgtcttttgttcctgtctatgtgtctatgtgttctcattatttagctcccacttacaaaagagaacatgcagtttgcttttctgttcctgcattagtttactagggaactagcaggtaatgatctccagcataaaaacggactaatacaagtacacaagaatacaaagaaaagaacagcagacactggggcccacttgagggtagaggatggaaggaggatgtggatcaaaagcctacttatcaggtattacgcttattacctgggtattgaaataatctgtatactgaacccctgcaacacgcaatttacccatataacaaacctgcagacgtactcctgaaactaaaaattagaaaac

SEQ ID NO: 515517 - DNA, 354 bp, Homo sapiens
tactgccggctgcctaccacgtctgccggttgcctctcctattaggacttttcgctctcgaagcgaacggcttctcacactcatgaaaattattacttttactgctgtttgagaaatgaatgagcctacagcatataggatgtttcatgtgtgtgtatgcatcgcgggtagtccgcacgtcacgtcggggcccattccgtgataggccgactgaaagtgttgtgggagatcgaggcaaccggcagggcgtacccgagctcgatcttcgtagatcgtgagtccgtagcgtgtttccctgctgtgacaaagccctcggcgatccctgagcgggccaggaccctgggcagaccccct

SEQ ID NO: 515518 - DNA, 1089 bp, Homo sapiens
  misc_feature (44)..(44): n is a, c, g, or t
tccaggctcccgggtcttaaagggggcgggggctgggggcagtncatccaaaggtggctctccgaaagcttggaggtcaacctttgggggtgggcctcgccttactccgaggggccttcaccgagggcctcgttgggcctcgaattcggatcgtggatctcgtgcccgcgttggcctcgttcgagcgtgtccccaccagctccggccgtgggccttcttccagagtttgtgcctttgggtgtgcccccgaggtgtccaacagtgttccagggttccagcggcctccttgccggccaacaagtgtgccaccgaaagagagttcgggcgttctcacgtggggagagtggaaaccggtgtggcctcaacaaaggatatatctggagagcgggtggatcgccggctcctctctgtggcatgtgcacccacgagaacacagggccccgcgggccgcaggagaccctgtgacagcggtggggcgcaccggtgtggggccggccagagagatgtgccagaaggggctctcgcggctcaaagagcgtgtgggcccacgtgtcccaaccgtgtgcgcggaaccgtttggggccacccggttgtggagaaaaaacacacgcgtggcgtgtgggcgaagacaggggcgacaacagggtgtgacaaaggggaccaatccgtggggtgtggggggggcccaagagagggggcaggggcaaacaccaccggggagagcaccgggagaggggcgcggagacaccattgcggggacacatataagggcgacaccgggggaggccgtttgaggaggagaaaaacaaaagggccggggacccaaaagattcccagcgggtggcgtgtcgagacacaccacgaaggctggacgagcaccaacgccaatgggggccaagccagagaatgggggcgggcgcaccgaacaacgcggggatgtaacgctctgtgggcgagagacacaaagggggggaaacctccccggggcggagacaaaagcaccactatgaggtccctcggagggaggccatcaccaaatgatccgggaaagtcgccgggcaaaacacgagagggggaaaactcgacacc

SEQ ID NO: 515519 - DNA, 209 bp, Homo sapiens
ggactttctgtctgccttgtacttctagaaagagacacaaagaaatgtcagcatgtgcttgttctctgttttcccaggctgttgcttctgagtctcaaggtcattacttaggagccagggcttttcagatattgtcagctttgattttagctcctcctccaaccttcccaatttgtgtgtcaagaaaatgtaacataagtctacccccc

SEQ ID NO: 515520 - DNA, 923 bp, Homo sapiens
  misc_feature (44)..(44): n is a, c, g, or t
  misc_feature (923)..(923): n is a, c, g, or t
tccaggctcccgggtcttaaagggggcgggggctgggggcagtncatccaaaggtggctccgaagctaaggtacaccctgtggcgggtgggctctgcagggcaaaggggatggtaagcggcccgtcaggctggggggatctgtgaaaggcggaaggaagagccccagggggggcagccacagctcaaacgctgagagagagagcttccctgtggcccagtccccagagcttacaacacaggcagggccgggggcccaggcagaagcctgcactgccctcgggtggcctcctgggcagcgcgcggccttcccaagaggggccggaaccccagaaacgcgtggggggcccaccgggcatccttgcccagccccatgggccggggcctcgagaacaccgggcaacgcaccgcacaactccagggccttacaccagggcctcgtgagagccccgatccgggatcgggatctctgcccgacggggcctcgctccagtggtccccacaaagttccgccggggccttctccaagttggcctgggttgcccccaggtccaacatgtccacgcgtcagggcctctccggcaaaaggggccagaaaaatccggggtccactggcgaagggaacccggcgccaccaccgtctgggaggggggcgccggccctctgatggcccaaggaaaaagccccgggcggacggcccagcacctggggcacatgtgggcccccaggatgcccaaagcgccgcaaggggggcccgccccggccgaacgtggggccgtgcaaaacctcgtggggaagacaccggacgaatacgttggggcacaacagaacgcgacaccacaggcaggcgttccccaatacacgacaccacccgcccacctcctcacaaacgagatccaatctcaccgggccacgagactacacn

SEQ ID NO: 515521 - DNA, 885 bp, Homo sapiens
ctgttaacccccgccgggccacaggcagcgtgtggtgggacccctcgtggggacagctccaagggggaagataagcaggatcgcaccatggagacgaaagaagcgctgcagcaagggtgtacttcgaagattacctcccattttgaccaggagcagcttcaggaacatcttcaaccttatgcatgagcattgataatggagtatcctaatgatccgagttggtatcctcatattgtatgccaggagcaatactattcaattttaaaaaaccccaagagggcccatttatttgtcgtccaggggattccgccttttggattgaggtaatgtaattccctttgacacaattaaaagcggtgtcagggaaattatccccggctaatacggtagcacactttggcacccttttttcaaaaaagcctgcaaacaaagaaggactctaaggaaaggagaataacccaaaggtccgggacctaatcggatgatggatcccagcactatagggacacggttcttgttgggaaagggtaagtgcccaacaggattacttgagacacatcattgactcttccttaacttcgaagagaactcctcttgcgtaaggaggggaaattaaggacgggccagaacagattaggaggaaattacataaggctaagaagagagaacccccaatttttggaaggcttccttgagcagaaaagccaggcagaggaaattgacggagatcgaactcggaggacgacagaacagggtgggggcggagacgacacttagaagggacagaacggccacaggcaggatggaagcacgcagcgggaattgggcaacgcacgaagacgaacatgaagcaagggggcatttattcgagcaaggtaaaggaga

SEQ ID NO: 515522 - DNA, 332 bp, Homo sapiens
tgaaacggatctccgtctgccgcccagctggagtgcagtggtgcaatctcagctcactgcaagctctgcctcccaggttcacggcattctcctgcctcagcctcccaactggctgggactacaggcgcccgcaccatgtccagctatttttttgtatttttagtagagacagggtttcactgccttagccaggatggtctcgatctcctgaccttgtgatccacctatctcggcctcccaaagtgctgggattacaggcgtgacgactgcgccctccctcttctttttttcttccttgctttctttcttttccctcctcccttccgtcgacg

SEQ ID NO: 515523 - DNA, 902 bp, Homo sapiens
gagagaactagtctcgagttttttgttgtttttttcccgcaggtaaaaattatactttaattggagtcaccaggaaaaaaattcaatgggggttcaagttcaaagtggttcagaaactcataacgggccaaaaagggtggactcccgagccacaagcccacggagggaaggggcaccaaacagcgagaccaaaagtgagacaagcaaccccattataaaaagaatgaacgggcgggctttacacacactctcaccaagagcaattacgacattaccaccagcggatggaaagtgtctgggacaagagcgcacaattttcacgtgtggtctcaatattcgtgatatactctctttacacaatataccaggtttgtgataagggcgtgagacaattagcgcattatatgtcacacgacgacatactaaaatacaacaagggccccatacaaagagtgccacgtggtgctacacgagggggcagaacgaggcggcaagcaccactaacaccgcacaactaaaaacgacacacaataaacacacatgagaacgcgtgaaccatgtgaaccaagcggacaacacaacccacacggcaaagtgcacacgacccgaaccaagaggagcagacaaaaaagcgcacaacacctgaaccccgctccgagaacccaaacgtggggacgacaaaatacgcaagagggagaaccaaccaccagcatcaacagcaacacaaggagcggacaccaacaaaacaacagcgagggatcaaccacagcatcaccacacacaggatgcacgacaagaaataagaggaaagtcaggccccacaccctacacaacacaggaggggagacaattcataccaacatcgcgcagcaccctagcaacacacagcacccccccggtgc

SEQ ID NO: 515524 - DNA, 321 bp, Homo sapiens
aggggggttttttcccccccaaggggcccttttcccttttttttcggggggggaaagaatttttttttccccctttttgaccccttttaaatttccttagggaacttggggggggggtgggattcccaattttttttcccccccacacccaaaaaaggaaatttttttttggtccccccccctgggggggcccaaaaaaaattttttttttaattttttttttttcccccctttttttggtttttgaaaacggggcccggtttttttttttttttccccctttaacttttggttttccccttacccttggcctttttttta

SEQ ID NO: 515525 - DNA, 469 bp, Homo sapiens
gccaacaagactagcctccacactcagagtccacaagaccagtgctgggagacatacgttggtcaggtggttctctttacccttacaaagctctgtcatatccatctcatcacttaaccccagcaactctctgagctgtcactgcccctatgttatagaaaaaagaaaagttcagtgaggtttatgattttccaagcctcaaaattaaaaaagaaaaataatcagtgcaaagattcagccaatattgaccgcatgctgggtcctgtcctaaatgcttggtcctcataagagtcctattattgtcacccttataggcacagatgaggaaactgaggcacagtggtcaagtacttgcccaaggacacagatagtaaagagcagaatgaagtcctgaacccaggaatctgctccaaaatctgtacccttaaccatgttgtacagagaacctcaaccccaaggtattatccca

SEQ ID NO: 515526 - DNA, 192 bp, Homo sapiens
gtgtctagaggtcccagcaagtctacagtcgggacactctggttctctctagagagaggctaccaaatcctgtatagactactacggagatttctcaggaaatatatcagcacactagtcctatctgtgagaaaatctaccatggcaagatatccacctgtcacatgtttatagctaggtagagagttcttt

SEQ ID NO: 515527 - DNA, 783 bp, Homo sapiens
aaaagcatggagatttctcaaagaactaaaaatagaactgccatttgatccagcagtcccactcttgagtatatacacaaaaagaaatcattatatcaaaaaaatatttacagccaggcgcagtggctcatgcctataatcccagcactttgggaggctgaggcaggcggatcacctgaggtgaggagttcaagaccaacaacatggcaaaaccccatctctactaaaaatacaaaaaattagctgggcgtgatggtgcacacctgtaatcccagctactcgggaggctgaagcaggagaatcgcttgaacctaggcggcagaggttgcagtggaccaagatcacaccagtgcactccagcctgggtgacaagagtgaaactctgtctcaaaaaatatatatttattcacactcatatgtttatcgctccattattcacggtagcaaagatatggaatcagcctaagtgtccatcaacagaggactggataaataaaatggactactacttggccatacaaaataatgaacatctgagaaatatccatgcttttttccataaaggctgtcttttgcagcgaacatagatggaactggaggccattatcctagcgaaataactcagaaacagaaagtcaaataccacatgtgctcacttataagtgaaagctaaacaatgggttcacatgggcatacagagtgtaataagaaacactggagactccgaaaggtgggaaggtgggaagggaggcaaaggtgtgaaaaattacctattgaccacaa

SEQ ID NO: 515528 - DNA, 119 bp, Homo sapiens
gagctaggcacaaataggactagtcttaaactgggtgcttccaatagtcctggtcagcctaattctgtgaagagaaagaaactacctgggttaggtctagctgggttaggtctacctgg

SEQ ID NO: 515529 - DNA, 158 bp, Homo sapiens
tgagtcggaccggctgtcttcgataaatcaatcaggctgtcaaacatgcgggttgctcgggaagtgccgatacagagccgcttcggatacgccaacggacgccgccagtttcgctgtggtaatgcgctgacttccatcgctggattcaagcattagcg

SEQ ID NO: 515530 - DNA, 109 bp, Homo sapiens
acaacgcgctgactcccaggctcaagcaagtactctcacttcagccttctgagtagctgagactacagtgcgcacaccaccacgccatggctatccagaacggcgggaa

SEQ ID NO: 515531 - DNA, 1045 bp, Homo sapiens
ccaggcagacagcctgatgaccagcagtgccttcgacaactcccaagtaaaggacaagagggacaccatcaacgggcgcttccagaagatcaagagcatggcggcctcccggcgagccaagctgaatgaatcccatcgcctgcaccagttcttccgggacatggcatgcacgcaggcagtcctggcatccaaggcagcacagcacagctgctggtgggctccagcaggcactacggccgggcacctcaactggcgtgccagcacacctgcaggcacagcaagcacacagcggctggcaacgcagaactggctgcgcatgcagccggctcattccgggttgtcctggacacttggacaagacagctggtccgcatgacaaacacccatcggggaaagcaggcagatccagacagcggctggcgccagtcctgtcggagacactggcaacagagctgcaagccagctgggcagaatgcccaggggtcagcgcgctggaagagtccttggcaatcatcagcagttagtaggcaaatgtggaagcaggcaagaagcctggcatcaatgcagaacatgcacctggtggcccagcgaaggcatcctggcagagactcttgccgacatcccaggggcttacctgcacgaaccatggacagctctctgagaccagacctccaccgccccacaaggcattcgccgtgcaactgatgtcctggccccacggggcacaagacactccatacacgacgaagcatgcacccatgcgggcagcacatcctctctccacagcatgacgcggccagaacgcggacaagcgacagacccggaaagaaacaagaaaggagacccaacgaaagacacagggcaaacacatcggaatgcacaccccggacacgtaaactacgcgaacacatcgaggcacaggcgacagatggcgaaccaacacgcaacacaaggaacacggcgaacagacggaacacccgaagcatacggcacagacaccagcacacgggtacagacgcacacaacacacaagcagacagcaaag

SEQ ID NO: 515532 - DNA, 236 bp, Homo sapiens
ttggcaggtctttttttttgttcagacccttccccgggcccagacagggcagcgctgtcccgtctaaaaaaacctgtcaggaaaaggagctttggggttgggttcgtttcccttccccgtagcgtttcttttcccctccgaggtgatgattttttaggtcaggagggtcggaaccagtttgggtcggaaaaagcagtgtttcgtttttcagggatagatggtaagataaaattgca

SEQ ID NO: 515533 - DNA, 105 bp, Homo sapiens
tggatagaagtatttgaatattcgattagtgaggcatattatattgggtataagccgactatagaatgtggatacattataacccgtactcaagagtgacccgtg

SEQ ID NO: 515534 - DNA, 407 bp, Homo sapiens
  misc_feature (406)..(406): n is a, c, g, or t
aatatgttttgttaccataaaaatgtaatttggaagttttttgttttcaattaaaagttgaggtcccctccccctactgtgatgtcaaaaccccaacaatgggtcaccccccacaggacacccacccctgctcgcaccctgtaatccccagtcctttgggatggcgcaggtaggtggatcacttgagcccccaggagttcaagacccagccctgggcaacgtggcgaaaccctatctccacaaaaaacagaaaaattagctaggtgtggtggtgtgtgctagtagtcccagctacttggggggctgagtcaggaagatcgcttgagccagggaggtcgaggctgcagtgagctatgacagctccactgctctctagccttggccacatttttaggccctaattaant

SEQ ID NO: 515535 - DNA, 785 bp, Homo sapiens
agcggagttcgatcggtagcgggagcggagagcggaccccagtagagccctgcagcagccccaccggcgaacgaccaggcgctagttagcacatcaacagccccggcgaggagccagtcagctgccgcagaccggcgcccagtgcaaccatcgaccgtcagaccatgagcatgcgaggtccgagactccagactggccggaaaccggtcgagatgcacaggagaagtatactgacgcgcgataaacaggcgcagaacgcgatagtcacgggctgacgccgtcgccaaggtcaccgtctgtcgcccttgctggcttcgtcttcgccagcagctgcgtctagcttgccattccgatggcatctcatagcgcgagcgaaagtcgctccagcgagaacgaagttcctccacgcagtgaaccggagtaccgtcttctgcaacctaccgcgatacccactggcccagcgcttcagtcctcctactgacggcacgcctggtaacgaggcacggtcgacactgtctccacatctgctgcttgcacttcaccttgcagtggaccgctggtgaaccgatttgaactcgtgcgccgacagttctgtcttgcctgcatggctgcggccagcatgactgtcctgcctccagtctccacgggacgccggccctgtcttgcccaactactgcaacgaacgccttcttacacgaacggcagaacattctgaacccgtgttggccaaactggccacgtcctggctgcgagaaccatttgacgccggctgaattggtggacca

SEQ ID NO: 515536 - DNA, 107 bp, Homo sapiens
attccaaacagccccgagtgattttgcgaaaccccttttcccttcagcttgcttagagtttccacatttagaaagcttaaggcgggctacagaaaaggaaaaacagg

SEQ ID NO: 515537 - DNA, 271 bp, Homo sapiens
gaagagatcaatatcacttgaggagctttgaaaaatagattcctttgggaggccgaggtgggccaatcacaaggtcaggagattgagaccatcctggctaatgcagtaaaaccccgtctctacttaaaatacaaaaaattagctggccttggtggcaggcgcctgtagtcccagctacttgggaggctgaggcaggagaatggcgtgaacgtgggaggcagagcttgcagtgagccgagattgcgccgctgtactccagcctgggcaacag

SEQ ID NO: 515538 - DNA, 1468 bp, Homo sapiens
  misc_feature (186)..(186): n is a, c, g, or t
gtgcggttcactgtagccttagctctcggcctgggccctttttcctcctcggtgcgccggtgtcctcggagcgcggtccctgtattggtctcctgctcctagaggttgagaacaaaaacatgcacctggagtttccccggagccctctgcgtggttgagcttcggtggaatttcggggctcttggntgccagccgcgcttggcctggtagcaaccagaaaaccagtcctgctcgcctccgtggacatttcattaccatccagaagtgtctcccattgaaggcatccgtggttgtttttaagccacaaaaaagccacacccaagatcactgacacccaccctgacaagtgtccatgatgctgggccctgagggaggtgaaggctttgtggtcaagctccgtggcctgccctggtcctgctctgttgaggacgtgcagaaacttcctctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagaatggattgggtgttgaagcacagtggtcccaacagtgccgacagggccaacgatggcttcgtgcggcttcgaggactcccatttggatgcacaaaggaagaaatgtgcagttcttctcagggtggaaattgtggcacaacgggatcaacattgcctgtggaccctgaaaggcaaagattacaggggaagcgtcgtgcagttagcctcgcaaggaagtaagctgagaaggctctagggaaacacaaggagaggataggggcaccaggtaccatttgcgggttgtttaagacgcagcaggcaggacagtaggtcataactcagatcccctctctgaagttcatgtcctggagcaagcgggcgagggcccctaatgaccggggccggggactgccagtagggtaccatggggcattcggtgaagccagggccagggccgtgaaagggaatgaggcctgtgcctacatgcacgagggctacgggggctacgaaggcaagttacaggtgccctcaggatggctacgggttcaacaaccggactggtcgggaggagacctaaataggtctcctcggaatggtctggacacctggattacgacgacagtatagtcaccggtgggcacgaccaagggcattggtccactgaggtctgcggcaaaggaccgagaagacatttaaattttcttcccttacaccggtgaagccatagggaggccaatgcaaagtgcggtgacacactgtggtgcccgaaaaacgtggattcaaaggaatacaataataattgaaaaggcagggggacacagagagggttgccactggacggagcaggagacaagagtaa

SEQ ID NO: 515539 - DNA, 176 bp, Homo sapiens
acattcgagctcggcaccccatcccccttcgtgtgtccatccccctttgtgtgtacatccccctttgtgtgtccatccccctttgggtgtccatccccctttgtgtgtccatcccccttgacgcgaggatcccccttcgcgtgtgcatcccccttcgtgggtccatcccccttcgc

SEQ ID NO: 515540 - DNA, 396 bp, Homo sapiens
gcatcccccggtctgcaggaattcggcaccaggcgagacttcgtttcaaaaaataaataaataaattaataaataaataaataaataaataaaacaggttgcagtgaagaagccggttaaaacccaccaagaccaagatggcgacgagagtgacctctggtcgtcctcactgctacactcccaccagcttcatgacagtttacaaatgccatggcaacgtcagtaagttaccctatgtggtctaaaaaggggaggcatgaataatccaccccttgtttagcatatcatcaagaaataatcataaaaatgggtaaccagccaccctcggggctgctctgtctatggaatggtcattctttcattcctctactgtcttaataaacttgcgttcacttt

SEQ ID NO: 515541 - DNA, 922 bp, Homo sapiens
atatgctttagctaaaattaattataaaataaaaacagtgaccagtctagccagcatggcaaaacccccatctctactaaaatacaaaaattagctgggtatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcatcaaaaacaataaaaacagtgaatgggtgtaggtgtgatggaattcacttatacttgactaaaatggtttcgggaggtgtttctccaggtaaaattgtcgcctctctggtcccattacccaccttcaaacattgatatgcaaacagttttaaagaaatcttacagttctaaaaggcttgtgacgaagacaagcaggcagtccctctttcacatttgacagaagaaacttcctcttgtcaattctagtagttgaagaatttatatttccgaaatggtatgattataccgtactttttgatacatcaattatttatggacttcctactagaacgcagtggagaacttttggcccattttatactgccaccaataaagacccaaggtagtattggaaatattttctacgtcctgttggtccagtcaggaaacgtccagtatttttcaattaattaatgaactaggaggttccggaggcgggggaagaagacccacattgggccccataagggtgacggaaattcctttaagaacgttccctgtgtcaacctgccgaccgccgcattcaaaaaaaaatttccctgtgcaagcacgggcaactcttttcaacggtgtacacagccgcgagcaccgaagcggccacataatgataaagacaacgggtcgtatataccgcgagtagaca

SEQ ID NO: 515542 - DNA, 1604 bp, Homo sapiens
gccagcgccatatgttcccctccggctcccgctactttagcctcccgcagcctctcccattggcggccgcggccgccgcggcagctagccccgctcctcccttcgctcgctcccagctccgcccggcagggggcgctgcctgggccccagcgcctacgtctaccgccccagccagccctcccgcattggctgggcggggcgtgctcatccacagggcagggctgctagtgcggcgcccggcatctcttaccgccgcccattttcaacatcccagctcccataacaacactgctccgcccagccgcattgctagccgcgcacccgggacactgctgcgccaaagacaacacccaccatgcgcgcaccaggctccagtacactcatggggcaggcatacatagcaaacgcagtcaccagaccacatcatcagcaggcacatctcgcccagcaggggcatccccacagcatcccaacgtcgcagccacagccacatccagccaggcatgcaccggggtcacacacatgtattcatagcgcaggcattgcaagcatggggcatcaccaagcaaaacaacacaaggcattcattggcacaaagcaagtcacaatatggatcaatccgacattcttagcggcgcacaggatcaagctcaggcacttagggcactcaaattctcaaaacacaccaagcaatcccgaagatccacttagtgggccagcatcccacagcagggccaatataggggcaattacagggtagccttatatcccacacacgcatcggctaggcctcaagtaggttagccaatcaccaggggtttatactagcggccaaacttggccaaccggccaaacacactacaaaacttggggcctttggggccccaaccattttggcaatccagcattccctccacacacagggtggccctacaagcctttattgccaccaccaggggtgcaccacaggcaaaccggtccccctaaacaacaggcggttacaagcgctcgcgcgcatgtcgccatatggcaagcccccccgggccatcacattatcagtggcaaaggcacaccccaaaacttgttgcagccggccaatccaatttacggggcagccccttttagcggggcatcccagccatcgtgcgcaccacacattattatgggcacactatttcccccccattggggtaatacaaccaaaacacaaccaaatttgcaacaggcaaagccacggcaaatatatcaggaggacgacaactcgcaccaatacttacatggaagggtaacgcacgccccagggaacacacacacacatgggggtacgacaaaacgccaccaatatcccacccaaccatggggtccagggcacaacagggtgcaccacacacacgttgacaccacaacccccaaagcaggaccaaataggaccaggcacacctacaccacccacacaaggcgggccacaagcgtcctacacccgtgtacgtgcaaccacgaggaaaccgaggcgcgtcacggcacccaagagcctagagcaacacccgtggaccaccggaagtcaacacacactacagcactggaaacgagcacaacacaacaga

SEQ ID NO: 515543 - DNA, 293 bp, Homo sapiens
gattataaaggtaactcagaagctacaaagcccagaaggtaacgccccacttgcagactcaagcctgtccttgtctcgaggcattggcaggtatacccgatctgccatgtattccagatgggacatgtacacaaggaagtactcagccgctaaatccaatgttgacaagaaaacgaaggcgcaggtactcgcaactgttacacacacagttggtggtgacaagaacggtggtacccggatgatacagcttcgcacaatgcctagatattatcctactgaagatgtgcctcgac

SEQ ID NO: 515544 - DNA, 461 bp, Homo sapiens
aaaaaaaaaaataatttacttccttgggggattgttcctgacccctctatatgaagaatacctccaacccagtattctctattccattaccctgtttaatattttaatggcacttactgttatccttgaagtaattttattcattcattttggggtctattttattcaggataggtagtgtccagtgttcagaagagtgcctgggcacatcaaaagtgctgagtaaaggtcaattggggtaaatgaatacagtttggtggactcttgaacatggagaacctaggcccagacaattctaaggtaaaatatgtcaccctctgaaccaacccgacagctttcagctgatggacctaagaccagggccttagggttagccgggatgagcttatcaaagccatgggcccctgaccatttgcatcaatatctcctaggaactggcgtgcagggcaaatactggttgc

SEQ ID NO: 515545 - DNA, 225 bp, Homo sapiens
cttatacaatcagctctgtaccccgtcggtatgtcttacggctagacgatccaagatctggcaaaagcccttgatgatcttcatcggctcactgcgatttaagtccgggacttgcgcaaaggcgtggtgcgggatactgcgagtccaatgctgatatcaacggtggcgatggtacctttctgaccgtccaaggccggcagcaacttgctcatttgcaccccgtgc

SEQ ID NO: 515546 - DNA, 935 bp, Homo sapiens
tagggttcaccccagaacgtgcctcgaacctcgggaagaaactcctgtggtcgcccctgtgccgaccgcggcaaatctaaggccgaaaatttgggaacgggtcctgagatgtacggcccgggaacccaacagtgtgtcccggcatgataggtgccccccccgtggaaaaggctccccccaacggggacccagcttcatcgtggtaccccccagaaaacgttcgccgctggctttacccgcaaggtggcccccccccccccctccgactggggccggataaatactgccacgtcgtgctaacaaagatcaacagtatacgcaggacccccacgtctgcctgaaacgacattttctctcgccacattttagaacagccctatcgttcacacgtcaccaaggctccccgcctcaagaaaaagtcagtgacgatgggatgaacaaccgaatgtcccgaataaatgaaataccgaataaattaataactggtctattcctaaaaaaaaacaagggggggcaacacgccccgctctgctttctcacaacgggagtggtattcataaacatgtattatgtcagacattacaccattttgtagattcttcttcgaggagggagtccagagccccagagttccagtggactcccgcgaaatgtgggtcaaacaaaaaggtggactaccaccagaggctagtagaaaaaactaatctcaattccttgtttggtgttcaacaacacacagtctactacgcacccgatgcccagatccttcacgcgtccctccttgtcaagaccccgagtattccttgtatctcagcacggaagtcttgtgagatacgtatcccttttcgcggtacaactacttctttggctagcacatcttttctcatgcgggggtcccccccgataaaaatgctcttaaaaacacgaaaaaaaca

SEQ ID NO: 515547 - DNA, 874 bp, Homo sapiens
  misc_feature (31)..(31): n is a, c, g, or t
  misc_feature (33)..(33): n is a, c, g, or t
  misc_feature (35)..(35): n is a, c, g, or t
  misc_feature (39)..(39): n is a, c, g, or t
  misc_feature (41)..(44): n is a, c, g, or t
  misc_feature (51)..(51): n is a, c, g, or t
  misc_feature (56)..(57): n is a, c, g, or t
  misc_feature (60)..(60): n is a, c, g, or t
  misc_feature (211)..(211): n is a, c, g, or t
  misc_feature (213)..(213): n is a, c, g, or t
  misc_feature (236)..(236): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (332)..(332): n is a, c, g, or t
  misc_feature (409)..(409): n is a, c, g, or t
  misc_feature (426)..(427): n is a, c, g, or t
  misc_feature (430)..(430): n is a, c, g, or t
  misc_feature (458)..(458): n is a, c, g, or t
  misc_feature (480)..(480): n is a, c, g, or t
  misc_feature (492)..(493): n is a, c, g, or t
  misc_feature (501)..(501): n is a, c, g, or t
  misc_feature (510)..(510): n is a, c, g, or t
  misc_feature (513)..(513): n is a, c, g, or t
gaagagctgccgggacgctccccatcttctngnancgcntnnnnctggccngcggnnctnaaaggtggagtcgttgctgttgctgttgtgagcctgtggcagcggttctgtgggaccggaaccttaaagatagccgcaatggctgaaaatggtgataatgaaaagatggctgccctggaggccaaaatctgtcatcaaattgagtattatntntggcgacttcaatttgccacggnacaagtttctaaaggaacagataaaactggatgaaggctgggtacctttggagatantgatnanaattcaacaggttgaaccgtctaacaacagantttaatgtaattgtggaagcattgagcaaatccaaggcagaactcatggaaatcagtgaagataaaactaaaatcanaaggtctccaagcaaannccntacctgaagtgactgatgaggtttcacnttgtgtcaaacacagatctgtntatattaaaggnnttcccaantgatgcaanctntgatgacataaaagaatgcttagcacgataaggtcaagtactaatatcagatgagaagacctgctaagcattaagggatcaatttttgtggtgtttgatagcatgaatctgtagaaatttgtagagaccctggcagaagtacaaagaaagacctgtaataatttcaggggcgataatttggcgaaaaaaaaagaaaaaaaaaaaaatttgcggcgccgggcggaggttctaccttctttggccccgccaagtaggacatggcacttcaagaaccggcgagaagggcgcgtcccaaaaccgggagcggggtggaacatcgttgtttttgtacgctccccccccccctcgaaacaacaccaaa

SEQ ID NO: 515548 - DNA, 507 bp, Homo sapiens
tgcctgccttggcctcccaaagtgctgggattacaggcatgagccaccacacctggctctcactagcagccttatgacccagacattctcgagaaatggatgaatcatcgtgcaaacaggttcctcaggactccaaactgagaaggatatagagccttgcatcaggacccgagtttagggggaaacgattggtcaggagtggaacggaacaggggcatagccaaggttatctcctaaagacagaaggtatctcatatgtctttgttataacacttgaaacagcacatgaatattatactttaaaagtatatcctaattcagcatttctggtaccatttatctaaggcctcattgcaatagaaaagaaaaaacaggaagaagcgagagatgatgagtgcaggtaaaaaccacacgcttgagctctaggttattctaggtgtctgtctgggctccaagctgggatgggttcataaggatcgtgaggtctgtgcctgtcttaaagtatcc

SEQ ID NO: 515549 - DNA, 306 bp, Homo sapiens
tccataatgtgtgccaggctggtcttgactcctggctcaggcatcctctcagctcagcctcccaaagtgttgggattacagacatgagccaccatgcccctccttcctttacttcttttttttttttttttttttggaaaaagttttgctctgtcgccaggttggagtgcaggggtgtgtatcttgactcactggcaacctctgcctctgggtttcaagcatattctcttgtctcagcctcccaatatagctggaactcacaggcacacaccacctatgcccagttaaccttggttattttcagta

SEQ ID NO: 515550 - DNA, 172 bp, Homo sapiens
tccctattgctgcacgtctggccaccgcattgcctaccaggacctgctgtgtgacctgctgtggtctgacccttccagggacgtgcaggactggggcgcgaacgaccgtgacgtctcttttacctttggagccgaggtggtggccacgtacctccacaagcacgacttggac

SEQ ID NO: 515551 - DNA, 184 bp, Homo sapiens
  misc_feature (120)..(120): n is a, c, g, or t
cgctgagacgtgactcaggtgatgggaagtgtagaaagacctgagaaaacgagcctgtttcaggcaggaacatcgttccacaacgaatttaacccttgtccttgggaagcttaacaaaanaaaaaaaccttaaaccctgctgtccttttttttttctaattgtttttttaaaaaaattttaaaa

SEQ ID NO: 515552 - DNA, 834 bp, Homo sapiens
  misc_feature (10)..(10): n is a, c, g, or t
  misc_feature (94)..(94): n is a, c, g, or t
  misc_feature (151)..(151): n is a, c, g, or t
  misc_feature (153)..(154): n is a, c, g, or t
  misc_feature (173)..(173): n is a, c, g, or t
  misc_feature (199)..(199): n is a, c, g, or t
  misc_feature (221)..(222): n is a, c, g, or t
  misc_feature (413)..(413): n is a, c, g, or t
  misc_feature (479)..(479): n is a, c, g, or t
  misc_feature (515)..(515): n is a, c, g, or t
  misc_feature (537)..(537): n is a, c, g, or t
  misc_feature (586)..(586): n is a, c, g, or t
  misc_feature (601)..(602): n is a, c, g, or t
  misc_feature (627)..(627): n is a, c, g, or t
  misc_feature (704)..(705): n is a, c, g, or t
  misc_feature (752)..(752): n is a, c, g, or t
  misc_feature (759)..(759): n is a, c, g, or t
  misc_feature (762)..(762): n is a, c, g, or t
  misc_feature (805)..(805): n is a, c, g, or t
cttcccgggntccctcctcctccctggccgggccccctggtcttatcacgggggctggggccaggccgcccttcggttcgggtgggcccatggnccccagtccaacgccgggggactaggcccatcccaaagcgggaccttcgcctcagancnnggcgtggcccctgccagcngccaggccatggggctctctgatgtnaccctcattgggggtgtgggtnntggggtgatggtggtggcaggtgtggtggtgctgattcttgccttggtcctagcttggctctctacctacgtgccgacagcggtagccaccagctcctgggcgctattgtgtcagccggcgacacatccgtcctccccctggggcctgtgggccacctggtggcaggccaaggcaaccccgagccaactgntctcccccctccctcagagggttatgatgagttggctggagtggcgggtgaaggtcggggagactncactggggaggctggagctgggggtggtgttgagcncagccttgagcatctccttganatccaaggcctgcccaaaagacaagcaggtgcaggcagcagcagtacanaggcccccctgaganntgaggatagcacctgcctccctccnagcactggcctcatcactgtgcggctcaaattcctcaatgataccgaggagctggctgtggctaggccagaggatanngtgggtgccctgaagagcaaatacttccctggacaagaaagccagangaaactnaantaccagggccgcctgcaacaagacccagcccgcacactgcgtnctctgaacattaccgacaactgtgtgatt

SEQ ID NO: 515553 - DNA, 622 bp, Homo sapiens
  misc_feature (295)..(295): n is a, c, g, or t
  misc_feature (405)..(405): n is a, c, g, or t
  misc_feature (407)..(407): n is a, c, g, or t
  misc_feature (475)..(475): n is a, c, g, or t
  misc_feature (539)..(539): n is a, c, g, or t
actgcaatctgtgcttcccaactccctgatctaaagtgatccgccatcctctgcctcccaactcctgatctcaagtgatccgccatcctctgcctcccaactcctgatctcaagtgatccgccatcctctgcctcccaaactgctaggattacaggcgtgagccaccgctcccggcccaatttatgttataataaaaaaggatatgcatacatatgttttactttcatatgtatgcatggaacatttctagagtggcgtatcaaccttatagtagtgattgcctgtggaggcagncatgggagggggttttcactgtaaaccttgggatcgcgtttgaatatttcaccttgcgcatatgttacctgcccttccatgtcttcctgaggactctcacggtctgagtncntggcagtgcaccttaccaaagaatggaccagcaagaaccacactaaagcttatgcatcctaagtacangggctacccacttgaaatttaaacaaatatattcttttatttatcaggccaaatacttagaggnacaaaatatattcttttttctttttttttgagacagttttgtagtttcgctccagtctgggtgacagagcgagactccatctc

SEQ ID NO: 515554 - DNA, 2894 bp, Homo sapiens
ggccacgggctcccacgggttgcgaggccgccgaggtggcgggcggcggtcaggcagccgccggggcagccatgcgcggggaggcggtggcaggggcgggcaccgtccggaccgagggcgcgctggcggcctctgccggctgaggggcgcagcgcagcaccccgccacgctcgccgattcccctgcgccgtcgcgggtcgggcagccggatgaccgacccgaaagcctaggctttgggaatgagactgatggacacaaaagcgccatttatctagagctcaccatgtgccagagtcacacattatctcactgaatcttatctaaccctttcacagatgaggaacctgaagctcaaaaaatttaagaaacccacccaaggacccaaggctagaagataacattcggtacttctaatttattccccaaccttggaccattatatcatgaacttggcctaaccctactcaagccctgcattgaaagactagccttaaggaagaccccagaatcctcataaatatcctgcatttccccctcctcctccgaagactaaagactgtgaagtagtgctcttgaccgcagtgcataatacacttggctttgctttattaacatgctttttaaaatgatgttttcagggagccagcatttcacaccagaagaggagcccttaatttccttgggggccagctggcaggtgcagagcggggagaaaaataaaaggaaaggggatggaaaagggaaagagcggagagtaaccgaaggaaaaacatacattccattatcaagcttaattttaggtgtggcctctacttgagggctcttgccattctctatggaaacaggctaacaagacatttctaaatatcacaaggaagtggaatgtggcagaaaagcaccacctaagtaggtttcagatgagtaggattgtgatcctgatgccaaaaaatctggcggcatgaattacgggataaaacaaatgggcatatcatctgccaaactggatgtaaggtttaaacaagacgagagtgaaaacccactgagttcctcccttggaaatctgggaaaatcaggcaaagtgccagaagtcctaaaagggcaagcagtgctgaattttcacaggacagaagatggagatgaaaattacaggagtaccaggtaggcggatgctgcagatacagcaaatgcagatttcaacagggcatttgacaattcacatcttagatgcgaaagtgaaatcaatgctggatgatagcactgaggcttattaaagactagcccagaggtggctgatgaagaggagggaccagcagatgaggctgctaggggcctgcccaaacctcctgccctggccagccaattcagggtgccatcagtgacttggataagaatacagcagcagtcatggaagttgtggatgacctgaagcaggaagggttgccttatctactgcatgacaaactgagcagagactaaatctaacaagttgaaatttagcaggaactattaaagtcctgtggaagagtttaacaaaaaagcataggaaggccaggtacggtggctcacacctgtaatcccggcactttgggaggccgaggctggcggatcacttgaggtcaggagttccagaccagcctgtccaacatggccaaaccccgtctctactaaaaatacaaaaaaaaaaaaaaaaaattagccaggaatggtggcatccgcctgtaatcccagctgcctgggaggctgaagcacgataattgcttgaacccaggagacagaggctgcagggagttgagatcacaccactgcactctagcctgggcgacagagtaagactgtcaaataaagtaaaatttaatttaaaaatgcataggaataggataggaaattatttgaaataaaaatgataatctaaacgtcattactgtattaactataatctaagagttggtcatgtagaatgccaagaaacatcttagggtagaacccataaaacctcactgatgctaacaaagaagctagccccccatgccagtcaggctggatttcttagggtgacatttctggacacattttgcaaagacagaggtatccagtggtcagtgactaaactcataaggggacaagacatcgttctgctgcaacatgaagtaactagggctcatcagtatgaaggataaagatacagagggagaagaagggaaagtgtagacatttctgaaaagctaaagcaaataaacatacaccaaaaagaagtgaacctgactatatgatgtgggagtattcaaagcaactgcataattagtctttagaagaagaaactttttttttttcctctaggatactacaataaacaatagaagaggaaacttttttaagagatagggtcttgctcttgtccaggccagagtacagtgaaacactcataactaactacaacctcgaactcctgggctcaagcgatcctcccacttcagcctctcaagtagttaggaccacaggggcatgccaccacatccagctaatttttaaatttttttgtaaagataggggtctcactatgttgcccaggctggtctcaaactccttgcctcaagtgatcctcccacattggcctcccaaagtgctaggattacaaatatgggccaccaccacagccaaggaaacattttaattaacaaaatgtcaaatattgatttagtgtatgggaaccttagttaaatagcttggggaactattctttctgaattctggggagggacttttgtaccatataaaaatactaaaatccaaatgtcccacatagtatttattgcaatataatgtcaaataacatttaaaggctaattcttttctctgtgtcctttaagcttaaggaaaaataaaagcatattcct

SEQ ID NO: 515555 - DNA, 876 bp, Homo sapiens
  misc_feature (65)..(65): n is a, c, g, or t
  misc_feature (197)..(197): n is a, c, g, or t
  misc_feature (265)..(265): n is a, c, g, or t
  misc_feature (326)..(326): n is a, c, g, or t
  misc_feature (377)..(377): n is a, c, g, or t
  misc_feature (397)..(398): n is a, c, g, or t
  misc_feature (421)..(421): n is a, c, g, or t
  misc_feature (444)..(444): n is a, c, g, or t
  misc_feature (464)..(464): n is a, c, g, or t
  misc_feature (568)..(568): n is a, c, g, or t
  misc_feature (571)..(571): n is a, c, g, or t
  misc_feature (576)..(577): n is a, c, g, or t
gggtcctcttccgggcaaaatggcgatgggactaatgtgcggacgccgggagcttctgcgcttgntacagtccgggcgtcgggtccacagcgtcgcagggccctcgcaatggcttgggaaaccgctgaccacacggtcctattcccagtagccccgtgctgctgtcgccaaactacctcttccttgcgggttccggncccccgaagcctcagtacctctgctatctctttgtgcagaagtccaggttcaggcccctcctgtggtntgctgcaatccctcacccaagagtacctgaggtggttctggagagactgcagatgtagtcnaaatgtgcagagcaagcttcgtgaactggggctggggtcatacaccccagnggactgatccagaatttacnngaatttatgcatgtgatctgggnctacctgtggtggggggcaatgntgcatgtacagtctttgccnctgctgatttttcctctcatcgtgacgggcagcgagaggcagcaggatccacaattcactggccagagaatccagaagttttcccaggtcgaatcagaagaggncangttanncaggagacattatggcgtatacaagcggttctcggaaggatgctactttaccagaaacacttggtattaactctataacctctatttccctgtgatcaggccaatcttatttcttcttattggttgagaaaatggcacttctgggcagtgcgaaggggctggggtcaggctcagggtcggaccattattttacgagctggaatggggttgagtgtgagaggtgagttgctcgtagaagcaaggcggacgcaaagtcagggttggccatgcgatttgaggacacgctgctccgccacgtg

SEQ ID NO: 515556 - DNA, 512 bp, Homo sapiens
ctgtgacaaatcatgcgacagctcactgttgtaacttcactgtaaggcattctgcacgatcactgcgaacgccattcaccacaaccggctatgattgcaaccatgaaactctgccaactacgcgcgcacacattcaagccagccattagctacagcccatttagcaagtactacatatttgggcccccaatgcgtccaaaccaacccgcgcgccctctcgacacagacacgatatggcacacacataacctcgggagcacaaccggattcatacacacctacaccacaacaccgctggtcgtctgcaacaacgcttcacacccccctgacgtgagcaaattgtggctactctagcacgccaccgcaactataccgaaccatcttccattcgcttcacaacctctcacgctcaacgcaccatttgcgtagacgcaacaaatctttcagtgctgcccaaaacgagctccacatctccgcacactggcatctacacaccaacggccccccgctac

SEQ ID NO: 515557 - DNA, 680 bp, Homo sapiens
  misc_feature (267)..(267): n is a, c, g, or t
tttcagagttttattgtattgcacttttggagcagggggatgggtatacaataatctgtcatgtgagttgtgagaatcattagaggctgcagattcacaataattcctttagcacccgattagaacagtgtgcataataaccaatgccttaattaggaatgagttccaaagatacacattcagaatagctttgaatgcagtcaacacaagtgatgcagaatatatttttatatgatgtttacgtatgcttcagaattaaagcatgtntgtttataactctgagggaaatatgggaaatgtctcatacatgccacatacggggagattactcgagcggacggaaaagttgagctttttattctgggagaggatgcagattctagttttcacgtgacacactaagaagcccatggagatacccactgggcagagatacattttcactttaagagaagcccactgtatatagagcgtatttatcattagagactcgcccagtgaaaccaagacgtgggcttccaggtcctataaacaagagctgccaaagaactaggacagtcggtcatttatgcatggatgccaggaatatgggtggtccgtaagacatgcaagttaaaactgttcattacacaagcaaatggtttttcttaattttacggcaaccgcgggaagctttattt

SEQ ID NO: 515558 - DNA, 1341 bp, Homo sapiens
  misc_feature (21)..(21): n is a, c, g, or t
  misc_feature (50)..(50): n is a, c, g, or t
  misc_feature (103)..(103): n is a, c, g, or t
  misc_feature (115)..(115): n is a, c, g, or t
  misc_feature (146)..(147): n is a, c, g, or t
  misc_feature (158)..(158): n is a, c, g, or t
  misc_feature (514)..(514): n is a, c, g, or t
  misc_feature (587)..(588): n is a, c, g, or t
ggaaaaatggtagcgatggcngctgggccgagtgggtgtctggtgccggncgttgggctacggtcgtggtcggcgactgtgctttcaagcggtgtctgctttnggggcagagttnatcatcggaggcatgcagagagttaggcttnntctagcagaanttgcttatgcaggctctatgtgatcttctcggacagttcaacctgcttcagctggatcctgattgcagaggatgctgtcaggaggaagcacaatttgaaaccaaaaagctgtatgcaggagctattcttgaagttgtggatgaaaatgggaaggttccctcaagtccaagctttgttaggagtgataaacccaaactgttcagaggactgcaaatcaagtatgtccgtggttcagaccctgtattaaagcttttggacgacaatgggaacattgctgaagaactgagcattctcaaatggaacacagacagtgtagaagaattcctgagtgaaaagttggaacgcatataaatctngcttaaattttgtcctatccttttgttaccttatcaaatgaaatattacagcacctagaaaataatttagttnngcttgcttccatgtgatcagtcttttactgtgaggcattaaatatctaattaaatcgtgaaatgggccagtatagtccatgatatctaaggagtgggcaagcttaacaaaacccatttctgcataacatgtccaatcctcctgcattctgtggatcacccactaacaacacagtgcttgggtaaccacaactttgcgggtatccacttactgcaacctgaactacgtttcgggaataacttggctccacggttttctaccgaacaccccaccacgacttcctaaaccttaccgacgacggttaaccaccgacccgactgacttacctactgccctccactgtgctggtgtggctcctttggacacacgggaactgacacgcagaacttacacgcaccgatacacactactacctgacgcctcaacagactggcctggctcctcaagagtctctcctcatttgcgtatacccagccttcttttcaatacaagatgttcctctattcgtctgaccaagtgactgcctgcctcaacaacttgtagcttcattctgtcaacccctattcaagatcttacagtagcatgaaacatccaccaagatcgcgtgcatgacgcctaacagaacacttctagggctggtggtccgatcatcctggaacttggctcccatcttacaaacccatcacgtgctggcgaccattactcaaagtcacactccgatggacccggcgcacagtccaacgtgttcacgtag

SEQ ID NO: 515559 - DNA, 546 bp, Homo sapiens
  misc_feature (546)..(546): n is a, c, g, or t
taaaataaatatcctaataaaagggtttaatttttttaaaaacaaaaaaaaaaaaaaaaaaaaaaaaaaaaaaaaaaaaaaaaaaaaagggggggggcccaaaaaccccgggggggccccaagcaactcgcacgcaccccacccacagttttttttaaaaagagggggggccccacaaataggggcgcgctactttaaaaaaacacggacgccaaaccggggcgcggcggtaattaaacaaaggacgcgcgcagagggaaaaaccggacacaagaggagaaccacctcggcgggaggagaggaaaccccccacaccagcggggggggggggggaaacacctgacgggggaaacacaaccacccccgcgagaaaattagtaaacgcgcccccagagagcgagaacactaacaatcttgtcaaggcgggcctaacacgggggggtaaaccacaccgcctaataatagtacgcggcgcgcagaaaaaatgtggggccacacggaaaattgattatacgaaaaatattcaccacgcgcgttataaaaagn

SEQ ID NO: 515560 - DNA, 354 bp, Homo sapiens
agtatggttgtggttaatgttgtggacatcatcagatatgagtagggattggggagtgaaaataattctgtcaagccactgataatatgagaaacatttaattgtgtggtagtgttattcctcaagatcatgattcttattttactcatacatggagacataatgacaagatctacataaacttaatttttgattgattgcaaatgcatttatatgtctgtaatccagcatttaaatcaagacttcttccttcctgtggactttggatcgtctgatgacacatatgcttggtgattagatttgcgatgtatcttttagcaggtctctgagattctttcagtgtgttctcctctg

SEQ ID NO: 515561 - DNA, 166 bp, Homo sapiens
tagccttacacaggtgttttatttgaacactgaaaacgaggggagccttctgttacaataggaaaagccacaggtgtgtgccctgggctctaaggcaggatgctaagagagagacccagggtccagcctgggagaaatagaacaaatgccagagctccaggagagg

SEQ ID NO: 515562 - DNA, 945 bp, Homo sapiens
  misc_feature (891)..(891): n is a, c, g, or t
gagaatgagaacatgcaacatcaggagagggtgtagtaaggaaatataccttaacaggctgattgggggcgtgagccagtacatacccgaagataaacagtctcattatttgtgtggctaatgataatgcagcagtcgtatccactgcacatgaagtgacgcaagaaatgagaacaagggtgctccccaggaagttgccaacttgattttccacatgagattaagaaagatctggtgtgggattgccatggcacacttgcgtgcccggaagtggttcttggccaagtgcttgtgtgaccgcaaagatttggaggccccgagggcaatacattggcctccttgtaagaactttacctgggacacaagtaaatttgtttgtgtgtggccccacgtggaaaaaagtattaccgtggagaggattaatattgaagcacggtggtggggtctatggggcgaaggggggattctttcactagataatagaagacagtggataacttggaaagaatttttaaaagcgaagtgagagagagattcgaaaaaaatgggggtatatttcgacaggggtgacttgtatgaggtattgaggacctacttctgtagtatttacactgggggtggacaataaagtgacgaagtgggtggtaaacgagagtgtcacataagagaataaaggggggtcagtgcaagaaaaagggggagcaacattgtgggggaaaaagtttgcgctgcccccagatatttaaatttaactttgggatggttgcgggaggagaaacaaagacaaatgacaaaggtatctttggaatattatgtacccacacgcagagatagcaaaaagtgtgagtgaggtggcatcgtcacaagtacactacaatgggttgtttcaanaggttccaatggaaaagtgtaattgggcggtatcacaatgtgtggggagaaacc

SEQ ID NO: 515563 - DNA, 719 bp, Homo sapiens
gcactaccctgaagagaaggtttacggaatagagcagaaccccggctgaccggaaggaggagaaaaagcggctgcccctgctcctgtaggaggagatggatgtatttgagcaggcgctggcttctgaggccccaggccaaggaccccttcggcgtcacctgtccccagagtacctttgtgttggatgaatttaagcgccagtactcccatgaggacacactctctgtggcacggccatattttctgggagcactttgataaggacggctggtccctgtggtactcagagtatcgcttccctgtgaggactcactcagaccttcatgagctgccatcgtcatcacgtgggatgttcccgcgactggaccagactgaggaagaatgccttcgcccagtgtcatcccttttgggacccacccatagcaggtcccatttctggagttctgggtcttccgaggcccggagcgttgcctttccgctgagtcccagattggcaggtggactacgagtcataacacatggcgggaactggatcctggcagcgaggagaccccagacgctggtttgagagtacttttcctgggagggggccttccagcatgtgggcacaagccttcaatcagggcacagattttcaagtgaacattttttgccatcacctagctgcctgcacctgcccttcagggagatgggggtcattaaaggcaactgaacattga

SEQ ID NO: 515564 - DNA, 235 bp, Homo sapiens
  misc_feature (91)..(91): n is a, c, g, or t
gaattaatttagggataaaccacaaaacataagattaagagagtagggtttgggatacgtgaaatttcagtcccggctgtgcattagctgnctgtgactttggggaagttactttctattcttcagtttcatcactgaaatgagaaccagtacctacctcagacagtagtagtcacaggcttataagtagcaaaaaatagagcataacacactcactatgttgctattatatgct

SEQ ID NO: 515565 - DNA, 144 bp, Homo sapiens
gaagaaagagtatgacacattattcagggtcatggctttctgaaggaagttatcttcttatttattttctgccactgaattctagattaccagaggtggtgctcctggggatgtctgctggtctgtccctccggaagaatgatg

SEQ ID NO: 515566 - DNA, 321 bp, Homo sapiens
aacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatttttaataaaaatacaaaaaattagctgggggtggtggcaggcgcctgtaatcccagctacttgggaggttgagacaggagaatcacttgaacccaggaggcggaggttgcagtgagccaagatcatgcccctgcactccagcttgggtgacagtgggagactccatttca

SEQ ID NO: 515567 - DNA, 259 bp, Homo sapiens
caggccagtagccacgatgtcctgtccacagagacgtatcaggcattagcagcgttcagattggagcatcgtacaccgattctaagagttctagccacagtgtttactgtgtcacttcctcatgagtggactccgccattaaagtccctaaggcgacgccacggggacagaagtgtatttcctcctcaggcctacaccgccccaaggagcgagatgaccctgggttttacgtgacttttgccccactattcggcagggg

SEQ ID NO: 515568 - DNA, 795 bp, Homo sapiens
  misc_feature (36)..(36): n is a, c, g, or t
  misc_feature (68)..(68): n is a, c, g, or t
  misc_feature (93)..(93): n is a, c, g, or t
  misc_feature (117)..(118): n is a, c, g, or t
  misc_feature (151)..(151): n is a, c, g, or t
  misc_feature (160)..(160): n is a, c, g, or t
  misc_feature (163)..(163): n is a, c, g, or t
  misc_feature (243)..(243): n is a, c, g, or t
  misc_feature (259)..(259): n is a, c, g, or t
  misc_feature (300)..(300): n is a, c, g, or t
  misc_feature (318)..(318): n is a, c, g, or t
  misc_feature (364)..(364): n is a, c, g, or t
  misc_feature (698)..(698): n is a, c, g, or t
  misc_feature (780)..(780): n is a, c, g, or t
aatttgctacgaattttggtccttcaaatgttttanatgtgtggggcggtgctgcgtctgcgcttggntggcttcgtccccctcttccctggngggccctggggccgccccccccgnngggggggctcccccgccggggggtcccccgggngttcctccnggngtgcctcctgcgctctggtacagcttggtggtggtggggttgcgggctttctccggctctttctgttggtgttcgggttnttccttctcggcggtntggttcttgtcgggccagttggtggtttcgttgcgcttgtncggggtcttctgtttgtnctcgtcgttggtcttgccttggggtttctcgtcttcgacagttgcnttcgtgttgaaggcgttgggctcaagtgatttcttgggtggcaccttgtccctctgcttctcgtcttcggctttgtgcttctcggcttcctgggccgtgcgttcggtgtcttccttgctcaaacggcccttgtcattagtgatagtaatcttgttctcttttcccgtactcttgtccacagcagagacattgagtataccattggcatcaatgtcaaaagtgacttcaatctgaggaacacctcggggtgcaggaggtatgcctgtgagttcaaacttgcccaagcaggttgttatcctttgtcatggcacgctcgccttcataaacctgaatnagcacaccaggctggttgtcagaataggtagtgaaggtctgtgtctgcttggtaggaatggtggtattacgcttgatgaggncagtcatgactcccc

SEQ ID NO: 515569 - DNA, 1136 bp, Homo sapiens
  misc_feature (631)..(631): n is a, c, g, or t
ctgatcaccagcacagccgcgcctgtccaccgtgtgctagctatggtctgagcaaggagcacagagtatggctgctgccgttcgtccatcgcaccgtcgcgtgccccgggcttctacgccgaccaacttcctcgggaggaagctcaacgcaatgcagggttgatcccttcggacgtgaatctgacctatgagcattagagctccaatggtcccacacatggttactaccggtgcattgcgcagttctgtgcaaccacacattcgcactgaagcaatgagtgaagcaccgacgaaagttgcgaacgggtctgtgctgttacgcatatcctctcgagcagaccatggcaggatcatcactcaacgagggaaggggcagtctgttggacttccgctctcgttccacgcgcgtcccgacttggacgtatcaggtccctcgcatcgagggccagatccattcaacatcaataccgtagtagcgatcgagcctatggtgaactcaatgaaggtacggacgtgtcggaacataactcacagtgcggagggcattcggtacactctgcttccactgcattctcaagtgagacgaagcatatgctttgatccaattcttcgtccatatgacacgtatcanttgacaccttagccacaacaattcgaaggactcgccaatatcacatctatgagcgtattcatgccgggacgggcaacggtgtcaaagagataaatttctctatctcacgtgtgtgaagccgttgttcctttcgccctacagatggggggcgaatcaagggccaaatctagtgactggagtgccctggaagacgtctttggtcagaaggtgaggcagatcgccctggaggtagcccatggccttgtgctcgagtcaggggcatgcgagtaccccggtgaagggcctggcagtaccgtgattccgggcagggggttcagaattgtggctggcccttcttttcgattcacccggagtccttttgacagcccgagtgacggcgataaggggatggggcggggataccaaccagaaggttaaaaccgtttaaaaaacccagcattggtgaaacgggcaccggtccatgtaactgttgggcgcatgcccggcaccagaggggtttgccccc

SEQ ID NO: 515570 - DNA, 635 bp, Homo sapiens
agcgggcaaagcctgccgggagcttggtgcgctatggcgacacccagcctgcggggtcgtctggcgcggtaagggaacccgcggaatgcctgtgctgaagcgccgaataagagcctctcattctagctaaccgtcgctcgggggcagtcggcgccgggagaatgggcgaggctgacttgcatcacggagatgtcggtgatgataggcttgctggacagcagaatgaattccgcgtacgatgcgtgcagaacaagagatccatggagcttccgtcgtattgtgccgcgagggctcaggaagcccgaaagatgagatcaatacaggaaatcctgggagagtctgggagtgtacttccaaataaattgaataagttgtcacagaggtttcctaacaaaccttgagctcatctgaaaatggacaagtatttgcaatgactgaaatatagcttctgagaactatgcagaggcattttagagacattggcatttgccatgccctctttggcagggtagaagaggctagaaagcacctttctttcaaccttaggacatcatagtatggggttagaagttactgatttatcttgcaaatcaaatcctctgagacagaaaagccggaaagtcctctgtccggct

SEQ ID NO: 515571 - DNA, 164 bp, Homo sapiens
cggatcccttcgattggcgggcaccttatgcactgcgttactatctaaaacaagctttgagtgtaagagattgaagagtacaaagtctgaccaagatgttgatgttggataagagaattctcttgctccccagctcgtctacagttgcccgccacatcgaaggg

SEQ ID NO: 515572 - DNA, 139 bp, Homo sapiens
gcgggcagtatcgctgtatgctcagcggcggcggaagtatcgctgctttacaatagccagtttttctctcagcaaggaaacagcacggctattgtgtataatagtaggtattttttcctacctattgccatcttcctgt

SEQ ID NO: 515573 - DNA, 99 bp, Homo sapiens
ttcaggcggtttggatgagaataggctgttactacgagggctatgtggctgattgatagacgtatgcatgcagcgatcttaggtcttgttagttcgctc

SEQ ID NO: 515574 - DNA, 726 bp, Homo sapiens
tcgtgtacccactcatcatcgactccccccccgatccccgtctccgcagtgcagtgacacacttcggcgtcactcgcttggggcctgcctgatcctccagatcatgcatcggtgactattcctagccatgcgctactcagccagaagcgcctcaagccggccctcttcaatcgaagtgcgcgccgacgaatctcctctgacgaactgtaaacatttgagtggcgtgccctcatcctgctaccttcacgccaatggcgcctcaatagttctttatctgcctcttcgctacacactcgggcgaggcctatattcatcggagtcagtcttgctctactcgagaaagcctgaaacagtcggccttatcctccgtgcttacagactatcgcaagcagccttcataggctatgtcctcccgtgaggccgaatatcattctgacggggccacagtacttacaatacttactatccgcctatcccatgacattgggacagacctagtccaatgaatctgaggaggctactcagtagagcagtcccaccctcacgacgattctttcacctttctgattcactcttgcccttcacttattgcagccctagcagtactccatctcctattcttgcacgaaacgggagtcgtacaacccctaggaatcacctcccattccgatacatcaccttccacccttataagacatcaagacgcccctcgggtttacttctctc

SEQ ID NO: 515575 - DNA, 969 bp, Homo sapiens
  misc_feature (969)..(969): n is a, c, g, or t
tccctatgaaaatgctttaaggggggtgtcggtacagcagggatgtggccggggaaaaacagcaagtgcacacagggggacaggccacaggacaggttgggattgaataaaaagttcacacggtttcccggtttccccagtgactgaaggctctaggccacctcctcctcagcctcctcctcagaactcagccctccataccattcggatgggggcatcctgggtacgcggcggggaaccaccgagacaccagggtaaaatccatggtagctctagggccatcggtgagaactccatcttcgtcaatagcccctacgcccgtgtaaccaggtgcagagaaggagccttgccgccggacacatagggccgtgaactggctcgggaagatcgcgcttgaccacgctcctgggatgggccgtgcctgtgtgccaatgaaaggggcgcggacattttataggcccccgaagggggggatgtccacagacacgccgtttacacaatgggtggggggactccactctcaccaaaaataagctgcctgtataacaggtcatggaccataacgccatatggctcaatcccaccctctgttcagtggacacatgccggcccctgaaccagggcgggaaaccggtcaggaacgcgggccaatggcggggagctcgaaggcagccaaacatgtgtctggggacattcaaacatctgcggaggtgacactcgaggcaacggcacgcgccccggacctggtaggtagccccggtagtcaatgggagaaagccggctattaacaacgtcggggggggaacgggaccatgttcacaggcagttacggaggtcagattgagctggctgggaatgccacgcaggcgtagcccccctgggagacacacccggggcagcgcccacaggggggggaccgctagagctgcacagcgcggaagctcacacagaaaggcacgcgatccacgn

SEQ ID NO: 515576 - DNA, 2074 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctcgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 515577 - DNA, 346 bp, Homo sapiens
gacctatatcttttactagtgtatatattgtatttttataaatcattcgtgtgtatttttgttcatgcacacttattttcattgcagcactattatcaatatctaagacatggaatctacccttatgcccatcaatgatagactgggtaaagaaaatgtggtacgtatacaccacagactactatgcagccataaaaaggaatgagatcatgtcctttgcaggaacatggatgaagccagaagccattatcctcagcaaactaatgcaggaacagaaaaccaacaccacatgttctcacttataagtgggagccgaatattgagaacacatggacacagagagggg

SEQ ID NO: 515578 - DNA, 2293 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctcggaggaagatccagaaattgtgaacaatgtttgatttagtagcgtgacttgcctttccctttaaaaacatcttttacaaatctgtcttggaataaagtctattttctgccttttggtttttaaaaaaaaaaaaaaaaaaaaaaaacaaaaacagaaaaacaaagaaaacaaaacaaaacacacacaacccaccaacacaaacgaaacaagaacaacaaggggggcccccaaaaaaagacaccaggagagaggagcacgaatgggaaagaaacaacagaaacggagacagagagggcaacaagagagaaagcaaaaagaaaggagaggagccgagcacacaaagagacaacacgccgcagagcagcggacgcggcagggccggcaccagacaagaagagaaaaaaaggagaagagaacaaaggcggggcccacgcccgacgcgcaacgaggcgacggggga

SEQ ID NO: 515579 - DNA, 2411 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctcgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaaaaaaaaaaaaaaaaaaaaaaaacaaaaacagaaaaacaaagaaaacaaaacaaaacacacacaacccaccaacacaaacgaaacaagaacaacaaggggggcccccaaaaaaagacaccaggagagaggagcacgaatgggaaagaaacaacagaaacggagacagagagggcaacaagagagaaagcaaaaagaaaggagaggagccgagcacacaaagagacaacacgccgcagagcagcggacgcggcagggccggcaccagacaagaagagaaaaaaaggagaagagaacaaaggcggggcccacgcccgacgcgcaacgaggcgacggggga

SEQ ID NO: 515580 - DNA, 1841 bp, Homo sapiens
  misc_feature (1261)..(1261): n is a, c, g, or t
  misc_feature (1670)..(1670): n is a, c, g, or t
  misc_feature (1841)..(1841): n is a, c, g, or t
tcacttggtaaaaaaaaaaaaaaaaatagctgttaacttggaattctatatccagcaaaaatatccataaaaaaatacaaataaagacagaagctgagagaattcctctccagaagacttactctgctagagtgcttaaaggaggttctaaggcagaaaaaacaatgcctcagatcttgaaatgtattagaaatggtagaaatataggtaaatatgagaataaatagaaatttatttttgaatttttacgtttccttgaaggaatattgatcacattttaagcaaaaacctccatatactattatgtctttaaaacatatataaaggaaaaaatatgacaaacataggatggaagggagaaatggaaatatatggtggtaaattcttacattatatgtaaggttatatgatattatttgaaaatagattgtgatgagtttaagatgcacattgaaatgacagaagaaacacaaaacaaaagaatacaaagtgttatagctgataaatctatataaaatagaatcctaaaaaattcaattataaaataggggaggaaaagaagagaaaaggaacaaaaaagagacgggagaaatagcaaggtggtagaagtaagctcaacagcatctataaccacattaagtgtaaatgacctaagagcttcaatatagtggtagagactatcatactggccaaaaaaaaaaaaaaaaaacaaaaaaaaactccaggagttattacctattacattggtgtgctatctaggagaactctctctttcacagttttaacaacccttagagtttaccgtgtacacaactgtggcgttcggcgacagacagcatcatctttttcgcggcacaacccccttttggctcttaaagaaaggcgcggggaccactttctttaatcacattattacagagaacacactctgttggccccccagttaagtattattatccgcgggcgaaatataaaagcgagacgggaacgcttgtctgggaaaccttcgctatcacagagcggcgctaccaatctttctctctccagagaaacaacccttgtggtggatacacctctctctcccaccacgctgtgtcttttttttacccccccccaaatataaaacgagaaaggctctttccaccaaacattgtgcctctggttgacaagcagcccaaatataagcggcgggacaaccacatatttcgggagacaatcgtgagcaacatgtggctgcggcacgccaaatctaccccctatnaatataattaagacgagctgggcggagagataaatgttcaccccccccattgtccgtcgggtggaacactcggggcgaagcagagaccatccccacttattacgaaaacgacaggtactgttggtcccgggcggcaagcattctttcttcgagcaacagccatcgttggcgggacacatctctaccacaaaacccgaaatttgcggatcatctccgagtgttcacaccatattttcttcgaagatatggcgtctgtaagcacaacgagacgcacgatagattgtttccacaacgttatagttcgctcacgacaatatcacgcacctgttcggaaccccttttgcgcggagcatacgatatgaacagccccaataatttgccggcggcgggtggaggaaacaaccacagngttctcctccacaacagctcgttttacaaaccatatgctcatagtcccactacacagaggtacggattactcatattggtgcagccccgcccgaacagaaatttaatcttatagaatcatgcgcggtacagcacgattaggaagtaacatttgcggatggcggccccagtn

SEQ ID NO: 515581 - DNA, 1929 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 515582 - DNA, 152 bp, Homo sapiens
ttactgctgagggtactctagacgatccccttaacggtagatttttttatattctttccactaatttacccaaaggctgaggagtggtgagaggaggtgcacaaagaggtgggggaggccgggcgcagtggctcatgcctgtaatcccagca

SEQ ID NO: 515583 - DNA, 1253 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 515584 - DNA, 1532 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtaaggctggccggggaggtcatgagactggatgctaagagtagagtcacctgacgtcactgcagacacctcgcgtgcagatgggccaggacgagggccatgggacctgctcccccttccgggtcctggctgcactcctgc

SEQ ID NO: 515585 - DNA, 197 bp, Homo sapiens
gtttcaccatgttgaccaggctagtctcgaactcctgacctcaggtaatctgcctgccttggttctcaaagtgctaggattacaggtgtgagccaccacgcccggacaaattttattttttttttttggaaatggatttccactcttgtggcccaatgcttgaagtgcagtgggcccatctgggtgttcaccagaaa

SEQ ID NO: 515586 - DNA, 523 bp, Homo sapiens
  misc_feature (315)..(315): n is a, c, g, or t
cgggggacctcccttgggagatcaatcccccgtcctcctgctctttgctccgtgagaaagatccacctacgacctcaggtcctgagatcgaccagcccaagaaacatctcaccaatttcaaatccgccactcccagaggccctggaactctggcccaaggctctctgactgactccttcccagatcttctcggcttagtggctgaagactgacactgcccgatcgcctcggttgaagccccctagaccatcacggatgccgagcttcgggtaactctcacagtggaaggttcccacggcgcccctaatcccgctngaagcagccctgagaaacatcgcccattctctctccatatcaccccccaaaaatttttgccaccccaacacttcaacactattttgttttatttttcttattaatataagacggcaggaatgtcaggcctctgagcccaagccaagccatcgcatcccctgtgacttgcacgtatatgcccagatggcctgaagtaactgaagaatca

SEQ ID NO: 515587 - DNA, 455 bp, Homo sapiens
gaacggccgccgagaggggccgccagggagggggagttgggacaggagtgatggcccaggctatggcccaactggcggaagggcccgcgcccagcggatgcacctgagcataggaacagacccgatgacctgagaaagaagaattcagtagtgaactactggaatcactgaaacaattaagactaatttaataccaagtatacccaaaaggccggagaaggcatgaattcccactgcagactgatagaggctactacgagaccacaactagacaaagacatggcaaataaggaaaatgaagagcaatataccttatgaatacaggggcaaaaatcatcaaggaaatattagtaaaacaaaccagaaacatgtaaaaaggattatacactatgtcaaggggatgtacctcagagaagcaaaatttaggtcaacatacaatacaattagtgctatgc

SEQ ID NO: 515588 - DNA, 236 bp, Homo sapiens
  misc_feature (28)..(29): n is a, c, g, or t
  misc_feature (46)..(46): n is a, c, g, or t
  misc_feature (63)..(63): n is a, c, g, or t
  misc_feature (67)..(67): n is a, c, g, or t
  misc_feature (225)..(225): n is a, c, g, or t
caaacaaaaatatatgtttttacttaanntgaatgtttttgctctncaacgatctaaaaatgnaaancaagatatcttatgtaggaaatattttggataatatttttacagtgagctttcccatgtttttatgtcttaagtttctttgtctgtcgtttatgtaggttgtcacaagaacttttactcacttgtaattgtggcctcagtctttttgaaagtctaccntctaaattttc

SEQ ID NO: 515589 - DNA, 140 bp, Homo sapiens
cttcatgcaggctatcagctgccttcattggagggctggtgctggtagggataatgaacttggtattgtcggcagaggtgattggccgggctctgctgcagtgagaatgctgactgtatgctcgggtcctccggtcccga

SEQ ID NO: 515590 - DNA, 212 bp, Homo sapiens
ctgcaggtcagacacagcaggccacgctcaggcccggtatgcgggccacccatgttctggaaaccacgtggtgtccctgtcgaatggggcgatcaagtccagagccggggcactttcatgagtttgaagggttactgagcagcagattgtcctccatttcgactccagtatgtggggctctggagaaggatgttctatcacctccctgggca

SEQ ID NO: 515591 - DNA, 850 bp, Homo sapiens
acaacaagcgaacgagccgatcagatagatgatgtgacgtagtcacgtcgccacaatgtgcccccgcggtggccccacgtaggacgcaacctgggtgtaccgccgaaggtccttccgcgcggatggaaccccacgcgggggggtcgcgccgccgaaagcatcgtgggaagctgccgcgatgaaactgccggggctttccccttcccgcggccgttgtatggcgggtgccccctgcgcgggtttttgcgttcttgccgcacgcctcctttcttttagatccaaacacaattcggggcgccccaagtgtattttcctccttctccgcccccctcagctttggtttcaacaaaccccgccccccccgtactggtttgaagaaatggtgtccccgcctgtgttttaaatttttggatgttcacaaagcagaaaattagtgcctttctcaaggcaaaatgctaaatactcccgttgctttttagaaagatgattcaattcacctccattgcgtctcccgggattaaaactacatctccccattgggttggtgcaaaagtaatggcacctcgggttatgtagaaaagatgaatattgaaataggctccgtttaagaaaaggaatgattctagggtgaatgttcatattagtaggacattatttagcactgatgctcttctttctatgcaggtgcttcatcattcctgcacgaagtgcagcctggttcccacctcaccaatagggggaaagaactaacacggttgcctccctgcagataacacacgggccggatacagtgcaataaaatttgagaaacttttgcaaaaaaaggagaaaattttcaaaaaaaataaca

SEQ ID NO: 515592 - DNA, 128 bp, Homo sapiens
accctttttccggggagaggggagcggggccgacacaggttcctgaccaagctggtgcttctgcgtgtgttcctgcatgacttggtcaggaacacacttgttgtcagccccacaaccccaacagaatt

SEQ ID NO: 515593 - DNA, 297 bp, Homo sapiens
ttctttttctttatttttaatccttttagttttaaatatattgcctaaagactcagttactacccagtttgtggttttttgggaaaaatgtaactggccagttagcttttcaattaaaaaaccccttaacccatgtgggatgtcttctttttataattagggttcccatgtggagaaaatttttccccctccttgcatgtaaaaaataatttaccttttacccttaaaatatggggtaaaacccaaaaagcatccctcatgaatgcaaaatcctttcaataaaaagtaagttttata

SEQ ID NO: 515594 - DNA, 373 bp, Homo sapiens
  misc_feature (282)..(282): n is a, c, g, or t
  misc_feature (356)..(356): n is a, c, g, or t
gcttcatttaattcttgcctcaacgggttgtcgttgctgagtcgcgggatttaactggtgccgcacaacgcgcgagagtccgtgtgcctactccgcagctgagtgggcactcgtagcttaaggcaaggatcaacgtgattaagtacgataccgcccgctattcgcgcctgtttgtcgctgccggtgcaatcccgacaatgtgacgcgggactagaccgccaacccttgagtgctgccgcgggttcatctggggcataccgaggtccgacaacgctacccgangaaaatccgattaatgcgtgcgagggcgagatccccatttcctgggggggcggccggttcgttttcctgggggntttaagcggatttgcca

SEQ ID NO: 515595 - DNA, 366 bp, Homo sapiens
  misc_feature (9)..(9): n is a, c, g, or t
  misc_feature (27)..(29): n is a, c, g, or t
  misc_feature (31)..(31): n is a, c, g, or t
  misc_feature (36)..(36): n is a, c, g, or t
  misc_feature (38)..(39): n is a, c, g, or t
  misc_feature (67)..(67): n is a, c, g, or t
  misc_feature (76)..(76): n is a, c, g, or t
  misc_feature (174)..(174): n is a, c, g, or t
aaactcacntcatattacagatggggnnncngaggncnngagatgaaactgtggtccagctggacanggtcagacngtgctgtcctgtgatccatggggtcctgcttgattcagaaatgggctcctgacactagaagggcttccagcacgccaagccatctggtgcaggtccangtcgggtgctgtgtaagagttgcacccagctggccaccggacagattctgaccagggagctccttgccctgcccaattcagccgctgctgccccacctggatcacaacattggctttctgatggcccccctggagtcttcagcctcacagcttccacagtccagcccatttcctgtgtgaccattcttatgc

SEQ ID NO: 515596 - DNA, 694 bp, Homo sapiens
  misc_feature (622)..(622): n is a, c, g, or t
  misc_feature (679)..(679): n is a, c, g, or t
  misc_feature (686)..(686): n is a, c, g, or t
gaatattgtgcatttaaaagagatgaggtttcaccatcttgcccaggctggtctcaaacccctgggttcaagcgatcttcctgcctcagcctctcaaagtacagagattacaggcatgaaccaccgtgcctggtcctatttttaattttttgaggaaactccatactgtttttccataatggttgtactaatttgtattcccaccagcagtgtgcgagggtttcctttcctttacatcatcaccaacacttgttcattgtttttatagtagccgttctaacgagtgctaggtgatatctcattttggtttgttttttatttatctatttttgatggagtatcactctgtcacccaggctagagtgcagtggcatgatctcagctcactgcaacctcagcctcccaaatagctgggattagaggtgtgcactatcacggccagaaaatttttgtgtatttagtagagatggggtttcgccatgttgcccaggtaggtctcgagctcctgacctcaagttcaggtgatctgcccacctcagccttccaaagtattgggattacagacatgagccaccatgcccaccctaattaacagtatttgtcaaattttaatgtgcatcanattcttaggtttcagctggcatctgtttccagctcttggtgctatttgcaaccttgnatcttangatgaagc

SEQ ID NO: 515597 - DNA, 947 bp, Homo sapiens
tacccaaagttacccaccttgtatttttaaaaaattggaaaaaaacggacccccccttcctggcggccctttcccctttttatggtcccccccccaaacaaggggggggggggcggcgccttcgattttggggccacccgtcgccccatccttgtagagcggtgtgggccctcccgagggtagttggggcccaaggcccagacccccgagcccttctttctccggggttcgtgggttgtgctgcagccccatgccaaagcccagggtgttgtttgtgccccagagctgtgggggtgtgctgtgggggagaccacctctaagaagccccagaaaaaccctactgtgccgcgggagcgcaacagggcacggggcggcaggggggcatgagttttcccagtgggctcaacagaagaaaacatagtgtgggtgggccctcgtgaaacagagggggagggacccctcgggggttggtgaatcccacttcatccgatggtacaattaatatctgtgggctttataggaaacacggggtccccgctttattcccccaagctgtggagatgtgccagggggtgcaaccagggcccaaggtgctagccctcaaaactgccggggcatcacaaacaactccctccggaggagagaacccccgttgtcgtataatagacgtggtgcgccgcaagaaagggggggcgtataattcgcaggggtatagaaaaaggggcgcttccccccaccttttgggctcaaagaccttgaccccctccctttgagcagcagtatatatggatagcatatcgattactacgcgcagaacaagcgcagagagtacgacggccaaattccccaggggggggggcccacacagaagggggcggcaaggatgtcactcaaggggcggacctatgtgatggcaacgggcaaggcaccctgtagcaccactgtgt

SEQ ID NO: 515598 - DNA, 129 bp, Homo sapiens
tggtgggattacaggcgtgagccaccattcctggccctgaaagaatattttaaatgatcattctgctgctggttgattatgcatactagcagcttgactcaattttaacattttgcagttgaagtccat

SEQ ID NO: 515599 - DNA, 371 bp, Homo sapiens
tgtatgactggtgtgaaggtgtctgagtagtgcggcggtagacgttggtttctgatttattatagtgtatgtgcggttaaattttaggaagaactagacacgttttatatactggtataataatgattgaaggagcagaaggtgtctttggcaggggtgatcaggctcagggaactcaacctgggctcttgaccggtcctggttttctgggaccccctgagcataagttacagctgtgcgtgtctgtctgtggtttactctggggaatcactgaagtcttggtcaggttcacgaaagggctagaccctgtcgtatagattaaccccctctaggaaggggcacagagagccattgcagatcatgcagatgtt

SEQ ID NO: 515600 - DNA, 551 bp, Homo sapiens
gtcttgggtctgtcaccggtacggtgagtgtgatacaggcgggggttttacaggtgctgggtcgtacctgggctctgagttacaaccttagcgtgcattccatctcgtacgagcgtggtacctgcatctgtgagactgctctagccaatctctaagtcccttccttctctaatatacagccgtctgtcaggtcgatgtctcagaacactctcccagctgtggaccactgtggaccacttagcagactcagggggtagttctttactctccctttactaccctggagggacagctctgcccttgaggtccttcagaaatttgtgctgattcggtccctgtgccagggcacagggtggtcaggcactgtggaacgaagggactcaggtgagggtcttctggactctaagacggtaaaggcactaaagtcactttaaagcttttggagaagcaggagggcattggcttaaccaagccgaaggctgctggctgggcttgctagcccagctaagatcttccttcagcccacctcaggatccgggcttgagggctgc

SEQ ID NO: 515601 - DNA, 948 bp, Homo sapiens
ggagaaggaatccgacgctggggggcttgtccgggcggcagcgatgctgctgcggatgggagggggccggctcgggcgcccatgagcgccaggaggtctcccgccactccgtctcgtcggtggagagcaggtggctgggaccctgaaatgggggggggaggacgccattggtctcgacgggggaggcaagggtttcggttcgccagggtgttggggggcttcgggtgaaggggcacagaagggggaatcgagaattgggctttttacaggggccccaactgagttttttccaggcacaggggggtcagaacaggctttgaggaaaaaagggggcgcggttctatcacaaatggtttgggatgggaatactgggggtggagaacttgtggtacaaggagggaattctttgggggaagcccaaagaactccaagtgctgaagacaggaagaggcacgacatgtcgaacgaggttctccacgaggacttcggggatgttacgtggaacctcaagttgggggcttagatggggtcacaagggccattgcgggaggtgacaccgcgaaagttgagggacctgacttggtgttggacggcaaggggaatgttgcattttaaaaggttcccaatcatggagagggtgttttatcaaagtgggacgagattacaattttgcgagtctccaaagggttttgtgtgacatggggtggggtgaacatttggggggtttcttacagaggtatcttagtggcaagggtagataagctggttgccaaggaatttaatggatagggtaaggaggcaggcataattgaactgtgtctgaggtacgttcttgttggaaccgtctcgttggacggggcggtgactgcgttccgaaaaagggcgactggaaatgcatggttaggcttaaaacagtgtcacacaaagagaggcgggtgaagagggcaa

SEQ ID NO: 515602 - DNA, 126 bp, Homo sapiens
cgatctgacatctgaatacgcggctgggggctccaagctgggtgctgtgggtaggtgggggcggagacttggcagggatgaccttgtttaggctgttggggggacaggagccgcgtagtcagatcg

SEQ ID NO: 515603 - DNA, 108 bp, Homo sapiens
tgatctttgcatcggcatccattccatttggcaactctgccatttatttctaaatcatcccgttatcattgtgtaatgacccttgttctctttttatccttttattat

SEQ ID NO: 515604 - DNA, 116 bp, Homo sapiens
tccgtactcttcgtatgactctcctctgctggaccctcctccaattcagactcctctgcgtggactctcctcgtgtatggacactcctctgcctggactctcctccatacgaacac

SEQ ID NO: 515605 - DNA, 327 bp, Homo sapiens
tgttgaacacgtagattgctttgggcaatatggccatttcagtgatattgattctcccaatccatgagcacggaatgtttttctatttgtttgtgtcatctgtgatttctttcagcagtgttttgtagttcttcctgtagagatcttttacctccttggttggatgtattcctgggtattttatttttttggtggcaattgaaaatgggattgtattcttgatttggctttcaggttgaaccttatagtgtatagacatgctactgatttttctatgttgatcttggtatcctgaaactactcaagtcatttggcagagtctttagg

SEQ ID NO: 515606 - DNA, 272 bp, Homo sapiens
taaaatggagtctcgctctgttgcccaggctggaatgctgtggtgcaatctcagctcactgcaacctccgcctccggggttcaacaaattttggtttctcagcctcctgagtagctgggtatacaggcgtgagcaacacgcctggacactatctagctattttcttacctagttccttcatttctcacctccacactcttgcttagcctgggccctctgtttttcctaggccccctgtttttcctaggccccaccctggattccattggggg

SEQ ID NO: 515607 - DNA, 726 bp, Homo sapiens
  misc_feature (59)..(59): n is a, c, g, or t
  misc_feature (63)..(65): n is a, c, g, or t
  misc_feature (596)..(596): n is a, c, g, or t
  misc_feature (603)..(603): n is a, c, g, or t
  misc_feature (629)..(629): n is a, c, g, or t
gagccggtaccttacattatagatttgatcatcgccagtagggttcgggctgactagtncagnnngaattagtaggctcaaggcagtgcccactattcctgctcaggcaccaaatagtaggtacagggtgccgatgtctttgtggtttgttgagtatagtcaacgatttacgaacataggtaaaatggctgagtaagcattagactgtaaatctaaagacagaggttaagccctctttttgccagttccgtggtgaatatcatgttgaattgcaaattcaaagaagcagcttcaattctgccgggacttctcccgccttttttttcctgcggcgggagaagtagattgaagccagttgattagggtgtttagctgttaactaaaagtttcgtgggtatgtaatcccaccaatctagtgaggatttagcttaattaaagtgtttgatttgcattcaattgatgtaggataagtcctgcagtccttaggttttcaggagttaagtactttgtacttacttagagctttgaaggctcttggtctgtgttaacctaaattcctagtttagggacgagagggctggtgttataggtaggantagtgtngataatacaattattgtgggaagtanttttatttgttttgtgtgttcgaattgtcattttatttttatgttattggtggatgggacatagtcagtgaggggcaatcaagcttgggtaccgagc

SEQ ID NO: 515608 - DNA, 1267 bp, Homo sapiens
  misc_feature (59)..(59): n is a, c, g, or t
  misc_feature (63)..(65): n is a, c, g, or t
  misc_feature (403)..(403): n is a, c, g, or t
gagccggtaccttacattatagatttgatcatcgccagtagggttcgggctgactagtncagnnngaattagtaggctcaaggcagtgcccactattcctgctcaggcaccaaatagtaggtacagggtgccgatgtctttgtggtttgttgagtatagtcaacgatttacgaacataggtaaaatggctgagtaagcattagactgtaaatctaaagacagaggttaagccctctttttgccagttccgtggtgaatatcatgttgaattgcaaattcaaagaagcagcttcaattctgccgggacttctcccgccttttttttcctgcggcgggagaagtagattgaagccagttgattagggtgtttagctgttaactaaaagtttcgtgggtatgtaantttcaggtagtaggttgtgttgtttagctctagggctagtatgaatcctatgatggttacgattagggctgttatttttatgtaaaggggtattgttgtgtttggtactgttattggtgggatgttgttggagatgataaagccagcgaaaatgcttccgattaaaaggcgtttaatagagttaattagtagggggttattttcattaattaggactaggggtgggaaacgtggttgtccctaggaatgcaaagaagataattcgagtgctgtaggcagcggttagggatgtggcaattaatgttattagtagggctcaggcgtttgtgtaggatatgtttgctgcttcaatgataaggtcttttgagtagaatcctgtgagataaggcattcctgttaatgccaggcttccaataattagtgctgttgttgtgaatggtattgctttatacagtccgcctatttttcggatgtcttgttcgtcattgaggctgtggataatggatccggagcatatgaatagtattgctttgaagaaagcgtgcatgcagatgtgaagaaatgctaggtggggttggttgatgccgattgtcactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaaggggtagaagcggatgagtagaaataccctgctactactattgtactggagtgtagtaatgctgatacgggagttgggcctctattgctgagggcaatcagggatgccgaaagtagtacgga

SEQ ID NO: 515609 - DNA, 398 bp, Homo sapiens
  misc_feature (331)..(331): n is a, c, g, or t
gactggatacggtgctgggtctggggactggagggcaggggtccttctgccctggggtcccagggtgctcgtgcctgctcagccaggcctctcctggtgagaccacatcgcccagaagactcagattggtcgaacttggggggctgtgtcacaaccagcccgcccgtcctggttgggctgcagagctcgaccgttggttgccctcctgccccggttcggagagccgagtctgtgggcactctctgccttgcatgcatctgtggctttctaacgacgtcgcgcttcagactgtaatcacaacgatccgtggagctccgtcatttattccaangaagggaacagtccaggctagtgctagcaaataggatgacaatgaaaaccaccagataacatggtgg

SEQ ID NO: 515610 - DNA, 534 bp, Homo sapiens
atgatcgacataaaacctgtctgcgacccagtatggtacatgatgaatatcatctcccattagtataggcgtggagaaatcgatgccaggaacgcagtgatgctagaaggggacactagtcagcgaagtgctggtgtacaatgttttaacaacccagctctctgcgggaagacgtcctggtttgtagtggatgccgataaccatcgtgtaaatactccacacctatggattgatacaagctaacaacataggatcatctgaattgcagagttgggaagaatggacaatataacagctcttgtgagctgaaacaagccagggtgcagaattaattggcattaatagattcagtatctggctacagtgctcttgccattgaccacttgacggacccaggctcaggaccactttaaaataccaaagttaaactctcagattctgctcagactctcactacagtgcctttgaagcgtgtatatcaaactttgagttggtaacccatagaacaggcctgaaacttaatatagggaacag

SEQ ID NO: 515611 - DNA, 1419 bp, Homo sapiens
  misc_feature (59)..(59): n is a, c, g, or t
  misc_feature (63)..(65): n is a, c, g, or t
  misc_feature (403)..(403): n is a, c, g, or t
gagccggtaccttacattatagatttgatcatcgccagtagggttcgggctgactagtncagnnngaattagtaggctcaaggcagtgcccactattcctgctcaggcaccaaatagtaggtacagggtgccgatgtctttgtggtttgttgagtatagtcaacgatttacgaacataggtaaaatggctgagtaagcattagactgtaaatctaaagacagaggttaagccctctttttgccagttccgtggtgaatatcatgttgaattgcaaattcaaagaagcagcttcaattctgccgggacttctcccgccttttttttcctgcggcgggagaagtagattgaagccagttgattagggtgtttagctgttaactaaaagtttcgtgggtatgtaantttcaggtagtaggttgtgttgtttagctctagggctagtatgaatcctatgatggttacgattagggctgttatttttatgtaaaggggtattgttgtgtttggtactgttattggtgggatgttgttggagatgataaagccagcgaaaatgcttccgattaaaaggcgtttaatagagttaattagtagggggttattttcattaattaggactaggggtgggaaacgtggttgtccctaggaatgcaaagaagataattcgagtgctgtaggcagcggttagggatgtggcaattaatgttattagtagggctcaggcgtttgtgtaggatatgtttgctgcttcaatgataaggtcttttgagtagaatcctgtgagataaggcattcctgttaatgccaggcttccaataattagtgctgttgttgtgaatggtattgctttatacagtccgcctatttttcggatgtcttgttcgtcattgaggctgtggataatggatccggagcatatgaatagtattgctttgaagaaagcgtgcatgcagatgtgaagaaatgctaggtggggttggttgatgccgattgtcactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaatattctctacccttcgacgtttcgttctgctcagcacttttgttcggtgtagtcatgtgtttattgtcatttttgattttgtgtaggacctgaataacgactggctacattgtaaacaatgtcacattgcagtgtgtatttgttcaaattatgtataatcggtaaacatatgtttttggtatttgctttctgtctcagagatgtacgtttggttgtagttattttcatagtcctgtcatttgtccggggatgagttcacgagagcggaccggcc

SEQ ID NO: 515612 - DNA, 112 bp, Homo sapiens
ggggtggtactaaaatccaaaatggcgtttgcaccatttttaagccaattttttccttttgatgttgggtaccagaattactataagggactgctgctttttggggcaaaca

SEQ ID NO: 515613 - DNA, 895 bp, Homo sapiens
  misc_feature (479)..(479): n is a, c, g, or t
gtgaaacacgccgtgttacaccataatacgaatagggaaccaattttatacgccacaagcccctttgttaaaccaccttttgaaaaacacgacataaaacaatgtgtgtcccgcaaaacacttcaaaccctcccggtttatcaaggtcccttcgcacacacagtagtgtcaacaaccccgcgttttgtgcccccaaccgtaatgtaccacacccacaaaggctgtttttattaggcgtcccacacacaatatgtgcgcgataatactactacttccaccgccttccgcaatatagaaaccgccttctttatcagtacaagaaagatcatcgtgaacaccccttctattagaatttgagccaactcccacccctgaaaagcccttagttaattgactactactcccccctcgttaataattttttcctattactaatgcccaatctctctacctgtttatgaagagaataggacctcttnttattctccgcgtgccgcccgtagataagaataatccacacttttcaaagaatgacgtgtgaacaataaccatgttgtataaatgagaatattaatttctccaccgacaagattttcaggtaacaccctctgccaccccaaggatagtgaactactactctctctcgtattgacaaaccactccagataagattaatagtctcattagggcttcttaggccaccactatacgtgacacacgcgcttaaaagataattacttgtccaaaagttcaaccagcttcttatcctcccaaaacttgtcatgctaattttgttttcccccttttacccaacatacactaagatactgcgcccttttttttaaaattggcccccaaaacccccctttaacaaaaaattaaccccccacaaaaa

SEQ ID NO: 515614 - DNA, 1227 bp, Homo sapiens
  misc_feature (59)..(59): n is a, c, g, or t
  misc_feature (63)..(65): n is a, c, g, or t
  misc_feature (403)..(403): n is a, c, g, or t
gagccggtaccttacattatagatttgatcatcgccagtagggttcgggctgactagtncagnnngaattagtaggctcaaggcagtgcccactattcctgctcaggcaccaaatagtaggtacagggtgccgatgtctttgtggtttgttgagtatagtcaacgatttacgaacataggtaaaatggctgagtaagcattagactgtaaatctaaagacagaggttaagccctctttttgccagttccgtggtgaatatcatgttgaattgcaaattcaaagaagcagcttcaattctgccgggacttctcccgccttttttttcctgcggcgggagaagtagattgaagccagttgattagggtgtttagctgttaactaaaagtttcgtgggtatgtaantttcaggtagtaggttgtgttgtttagctctagggctagtatgaatcctatgatggttacgattagggctgttatttttatgtaaaggggtattgttgtgtttggtactgttattggtgggatgttgttggagatgataaagccagcgaaaatgcttccgattaaaaggcgtttaatagagttaattagtagggggttattttcattaattaggactaggggtgggaaacgtggttgtccctaggaatgcaaagaagataattcgagtgctgtaggcagcggttagggatgtggcaattaatgttattagtagggctcaggcgtttgtgtaggatatgtttgctgcttcaatgataaggtcttttgagtagaatcctgtgagataaggcattcctgttaatgccaggcttccaataattagtgctgttgttgtgaatggtattgctttatacagtccgcctatttttcggatgtcttgttcgtcattgaggctgtggataatggatccggagcatatgaatagtattgctttgaagaaagcgtgcatgcagatgtgaagaaatgctaggtggggttggttgatgccgattgtcactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaatcgctcgaagcgcatcatgtagcaatgctcctgaaaccacaaaagttctctagtgtagtccgcccggcacaaaggggatcct

SEQ ID NO: 515615 - DNA, 355 bp, Homo sapiens
  misc_feature (209)..(209): n is a, c, g, or t
tgtgcatgttgttacaggttttaaatgtgataaaacacacaaaacgcaccaccttaaccatttccagtgcgtggtcggtggtgttacattcacgctgttgcaggcgtgcaggtcggtggtgttacacacattcacactgttgcaggcgtgcaggtcggtggtgttacatttgggctgttgaggcgtacaggtcagtggtgtacacacantgctgttgcaggagtacaggtcggtggtgttacacacattcatgctgttgcaggcgtgcaggttggtgctgttacacacatgctgttgcaggagtacaggtcggtggtgttacatgctgtagcaggcgtgcaggtcggtggtgtaa

SEQ ID NO: 515616 - DNA, 972 bp, Homo sapiens
  misc_feature (108)..(108): n is a, c, g, or t
tctagaggacccgaaacctaataacggggagagggggtggcggtgtatgatggagggataatatcctagtatgttggaaaatttgtatgtttgtgaggggtatttaantttcaggtagtaggttgtgttgtttagctctagggctagtatgaatcctatgatggttacgattagggctgttatttttatgtaaaggggtattgttgtgtttggtactgttattggtgggatgttgttggagatgataaagccagcgaaaatgcttccgattaaaaggcgtttaatagagttaattagtagggggttattttcattaattaggactaggggtgggaaacgtggttgtccctaggaatgcaaagaagataattcgagtgctgtaggcagcggttagggatgtggcaattaatgttattagtagggctcaggcgtttgtgtaggatatgtttgctgcttcaatgataaggtcttttgagtagaatcctgtgagataaggcattcctgttaatgccaggcttccaataattagtgctgttgttgtgaatggtattgctttatacagtccgcctatttttcggatgtcttgttcgtcattgaggctgtggataatggatccggagcatatgaatagtattgctttgaagaaagcgtgcatgcagatgtgaagaaatgctaggtggggttggttgatgccgattgtcactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaaggggtagaagcggatgagtagaaataccctgctactactattgtactggagtgtagtaatgctgatacgggagttgggcctctattgctgagggcaatcagggatgccgaaagtagtacgga

SEQ ID NO: 515617 - DNA, 620 bp, Homo sapiens
  misc_feature (59)..(59): n is a, c, g, or t
  misc_feature (63)..(65): n is a, c, g, or t
gagccggtaccttacattatagatttgatcatcgccagtagggttcgggctgactagtncagnnngaattagtaggctcaaggcagtgcccactattcctgctcaggcaccaaatagtaggtacagggtgccgatgtctttgtggtttgttgagtatagtcaacgatttacgaacataggtaaaatggctgagtaagcattagactgtaaatctaaagacagaggttaagccctctttttgccagttccgtggtgaatatcatgttgaattgcaaattcaaagaagcagcttcaattctgccgggacttctcccgccttttttttcctgcggcgggagaagtagattgaagccagttgattagggtgtttagctgttaactaaaagtttcgtgggtatgtaatcccaccaatctagtgaggatttagcttaattaaagtgtttgatttgcattcaattgatgtaggatgtatcgtacaacccttagacacacaggacagcaatgcccaggacttcctaagagagctgaaggctcctggtctgtgttaaactataggcataaagcagtgacgagagccacagagttataagcactatcagtgacaataatacagattattg

SEQ ID NO: 515618 - DNA, 656 bp, Homo sapiens
ggatgttatcggttcaccctcatgggttttgtccctggtcccattccacgcccaccgccaagggtggctacagtagccttcatcctcgatattgcccattgcgtctgcctcggctcactctcaacggtcggtactccagctgacctgagacgctttccccaccctctggactttcgtcatctttctgcctcccttcctactccttttggttttttggggagaggggaaggatcagggggccaggccagcagactcgggggccactaggagatggataatgtgcctgtttgtctaacacgacgatacaagcctacctccaaaatcccctttttgttcttcctggacctgggcattcaagcctcctgctcttaactgaattgggagcctgctggccacctgccccgtgtatcctaggctctcagtctcataggggaagcgcagcatagacatccctttcttcgccttgacacgcatcgctagtcagctggtaaggtcttcacatcctgattcctcaagttttctgcttagtggcactgacattaagtagtggggggactagtccactgccaggatcagcctggagatagccttcccccttggccgtgggcaggccctaactcactgtcgctttggagttacgccgggtctttatcttt

SEQ ID NO: 515619 - DNA, 235 bp, Homo sapiens
cagtaatgagcgcggattaatgtgacgaggccctgaacccacgctgtgggctacctaggatcctgctctctggtctttcttcatccagctgcgaagcaatttgaacgcaaacattgtttctctggacgtgatagatgccctgagttcacctctccccagccagtccttattttactgagggtcggtggtgagagcggtcaatgtatatgcagctttggagaagggtggacttgac

SEQ ID NO: 515620 - DNA, 626 bp, Homo sapiens
  misc_feature (496)..(496): n is a, c, g, or t
  misc_feature (503)..(503): n is a, c, g, or t
  misc_feature (529)..(529): n is a, c, g, or t
cttaagctacgatcctatcgacactaatcctacctatacaccagccctctcgtccctaactaggaatttaggttaacacagaccaagagccttcaaagctctcagtcagtacaaagtacttaactcctgaaaacctaaggactgcaggattcatcctacatcaattgaattgcaaattcaaagaagcagcttcaattctgccgggacttctcccgccttttttttcctgcggcgggagaagtagattgaagccagttgattagggtgtttagctgttaactaaaagtttcgtgggtatgtaatcccaccaatctagtgaggatttagcttaattaaagtgtttgatttgcattcaattgatgtaggataagtcctgcagtccttaggttttcaggagttaagtactttgtacttacttagagctttgaaggctcttggtctgtgttaacctaaattcctagtttagggacgagagggctggtgttataggtaggantagtgtngataatacaattattgtgggaagtanttttatttgttttgtgtgttcgaattgtcattttatttttatgttattggtggatgggacatagtcagtgaggggcaatcaagcttgggtaccgagc

SEQ ID NO: 515621 - DNA, 308 bp, Homo sapiens
ccctgagcaccttcctgtacttggatatcgaaatctgaatctctttaagttatacagacttgtacacggaacttgcagcgatatgataatattgaaagtggagctgtttggaaacaagtctaccaagatcttggaatccctgtcttaaattcagctgccggatacaatgattaatgtgcttattacaagtacttatatggttttgaggagtactgtatatcagccaacattgaatttcatcatgcattgcctgagaaagttgtatacaagcaatgtaagtgcaggttgctatatgaaggttgctaagg

SEQ ID NO: 515622 - DNA, 331 bp, Homo sapiens
  misc_feature (23)..(23): n is a, c, g, or t
aagatcatcattgtaatttgtgngccaggtccatgccgctcgagttcactgtagattgggagcaatggtgcatgcattcctacaatcccagcgctttgggaggctaagacaggcagatcgcttgagttcaggagtttgagattagcgtgggctacatggtggaaccctacataacacaaatgttagttgggcatggtggtttgttcctagagtcctagccactcgggagcctcaggtgagaggctcagttgagctcggaaggtttagtgtgcagttatccacaattgggcctctgtgctccagcctgggcgtccaatcaagtcctgtttcc

SEQ ID NO: 515623 - DNA, 345 bp, Homo sapiens
  misc_feature (215)..(215): n is a, c, g, or t
  misc_feature (222)..(222): n is a, c, g, or t
  misc_feature (248)..(248): n is a, c, g, or t
ggggccacaacaatcttcaggtcccaccaatctagtgaggatttagcttaattaaagtgtttgatttgcattcaattgatgtaggataagtcctgcagtccttaggttttcaggagttaagtactttgtacttacttagagctttgaaggctcttggtctgtgttaacctaaattcctagtttagggacgagagggctggtgttataggtaggantagtgtngataatacaattattgtgggaagtanttttatttgttttgtgtgttcgaattgtcattttatttttatgttattggtggatgggacatagtcagtgaggggcaatcaagcttgggtaccgagc

SEQ ID NO: 515624 - DNA, 357 bp, Homo sapiens
  misc_feature (33)..(33): n is a, c, g, or t
cggcaccggatcagacgccacgtgggggctggngctaccaagcggacctggcctctacgctactgacccccaagtggcacccgttgacacgctaggtgtaacgcggcaatttgcccttaaccccgccatgactcgaatggccaccttgttcaacacgggcaaggcggccatccagctcaatgtcggcccgctgatcgtcccgctcactcgagataactacgacagcaccgaccacaaaacctatccgcgcccgccgcaactgttttcgcacaatgaccagcaatccatctggcaatcttcgaatccagaaggcgccaagattggctggggtgggaacatcgccgacgtggcgtctgt

SEQ ID NO: 515625 - DNA, 304 bp, Homo sapiens
cgctgcgtccacccccgtcccggtcctcagcccctctgctgcagaccatcggtatcatctctggaaagattctgaagcttggcggagagggttgtgtgagtggacaccagtgaagtaacggtttttgtgcaacgatgatttgtgttttcctttgctcccctgtaatggcaggaactcggatagtgttgtcttcaggccaggaggactcccaggagagaacggagagccagtgtcctgtgtgtcacggtccatggatgaacgtttgtggaagtggaatgacttaaacaagacgtgcaaagcaaca

SEQ ID NO: 515626 - DNA, 173 bp, Homo sapiens
cggttggttccgaaaacccagaaagtgggaagtatcctcctgatgcctttgatctccagggcctgagggggatctcagcataaacgaagacctggcttccctctaacctctagctgagttcacaaatacccagattgacaaatcttgactcaccaaaagatctcctttattat

SEQ ID NO: 515627 - DNA, 607 bp, Homo sapiens
tcggtcccagatcggcctagtcgatgaggatagtaaatgtgataaaagctgttatagtgctgatgttgagtagtgctaatgtggcccctccaattagatgaattaataggtgccctgctgtaatgttggctgtcagtcgtacggctagggctactggttgaataaataggctaatagtttcaataattacgagcataggaattaatggggcggatgtcttgttcgtcattgaggctgtggataatggatccggagcatatgaatagtattgctttgaagaaagcgtgcatgcagatgtgaagaaatgctaggtggggttggttgatgccgattgtcactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaaggggtagaagcggatgagtagaaataccctgctactactattgtactggagtgtagtaatgctgatacgggagttgggcctctattgctgagggcaatcagggatgccgaaagtagtacgga

SEQ ID NO: 515628 - DNA, 190 bp, Homo sapiens
  misc_feature (2)..(2): n is a, c, g, or t
cngcaacgctttatattctcaacgctttatacttcctcaacgtttatacttcctcaacgctttatacttcctcaacgctttatacttcctcaacgttttatacttcctcaacgcttctcatttcatttcccggtatgaagtataaagcgttgagagagtataaagctttgtgcgaagtataaagcgttga

SEQ ID NO: 515629 - DNA, 365 bp, Homo sapiens
tctgaccagctgggaaaacaccccgtcactgtgtgcactgcgcatcacgacactgtgtccacctccccaaatcacccccactctctgcaacctccccaagtctcccacactctgtccacctcctcaaatccccccactgtttgcaacctcccaaaatctccctatgtgcaacctcgcaaaatctcacccactatgtgcaacctcctcaaatccccccactgtgtgcacagctccccaaatccctcccactgtgtgcacactcctctagtcccccactgtgtgcaccccccaaaaatccccccaatgttgtggcaaccttcctcaaatacccccttaaatgcgagcaagctcctacaaatctctcc

SEQ ID NO: 515630 - DNA, 122 bp, Homo sapiens
ttactaactacctaattcttgtttatcttctacctgagtgtttatcacaatttttacatgccttgttcacttgtgtgtcacatatttactgtctgtctctccgaaaatgtgagctctctgag

SEQ ID NO: 515631 - DNA, 553 bp, Homo sapiens
cggaaatagcgacgcaatctcagcatagtgtaattgaatgtctcgggtgaaatcatgtagtttaaaaattaaaagacattaatccttcaaaacaaatagaaatcaaggaacaaacacaaactctttcaggaagctaggaaatatctacaactaacgatgaaggaaaatggacggaggatagcacagggcttagcagagcagaggaatagtaaagtgtatttgaagaaagcgtgcatgcagatgtgaagaaatgctaggtggggttggttgatgccgattgtcactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaaggggtagaagcggatgagtagaaataccctgctactactattgtactggagtgtagtaatgctgatacgggagttgggcctctattgctgagggcaatcagggatgccgaaagtagtacgga

SEQ ID NO: 515632 - DNA, 641 bp, Homo sapiens
ggcgccaggatccaggtgtaaaggggaacccccaatcggggacttcccatcccccaactctgtgtccaccatctgtgttggggagagtggagaccagactgacgcgagccaccccaggtggttggaaccagctcaccgggccagacgcccccgtgtgtttccccagagtagatacactgtccagatcccttggcatcccgagaaatgaaaagattgctgtcgccccgcaacccgatttgaggggcgccaggccagagagaaaaattcttggagaaggggttctaaagagtgcgcggagtgatggagttttgagaaagaaaaccactttttcagataactggaaactttggtgtttgggagtcccggggacaccatcgatctgggtgatccagataatgacccccgacaattggtattttacggcctggacatttttatgtggtgctgggttggagcccggatttccggccatccgccagaccaaaagcgcagcgacaggctcactttgggcccaacacaggaatccacccaaaagagagagcccagccctggtttccacaaaaatattatgggatcatccttcctgtgccaattaatttccctttttatcccaaagagaccaattaaaaattttccaatta

SEQ ID NO: 515633 - DNA, 677 bp, Homo sapiens
atcactttaaatgtgtcatgccactctcttctggcctgcaagatttccactgagaagtctgctgccagatacattgaagctccttcatatgttatttgtttgttttctcttttgagatgcttttaggatcctttctttctccttgacctttgagagtttgattgttaaatgtcttcagttagtcttatttgggttaaatctgtttggtgttctacaaccttcttgtactgaatattgatatctttctctaggtttggaaagttctctgttatctctttgaataaattttctaccccagtctctttctctacctcctctttaaggccaataactcttagatttgccctgttgagggcaaattaattcctttttatttttttctcctctccctgtgtattttcaaatagcctgtcttcgagcttactaattctttcttctgcttgatccattctgctgttcagagactgatgcagtcttcaatttgttaattcaatttttcagctccaaaatttcccttgatttttaaaaattggttcaatcttttgttatattaacccgataggaatctgaattccctctgggttaactcgaatttcattgcacttactcaaaacagctatttttaatatttttgctgaaggtcacataaccttttcatttcaaaaccatcactgatg

SEQ ID NO: 515634 - DNA, 261 bp, Homo sapiens
  misc_feature (236)..(236): n is a, c, g, or t
ccaaagatacactgtgacaacccgagtggctttatttccttaggtggaaaggggctgcttgccgctgctagccaacagaaggggcatggcccatggacttaggggcgggagtcctcatccagtgtgccctaagctgaagcaggttaaaagtttagctctgccagcatgtacccacagaaagattttctagaaaaggtctctttcttttttgagcggtttcattatatatgaagggnttaagaagttttttgaccaagaaac

SEQ ID NO: 515635 - DNA, 1361 bp, Homo sapiens
  misc_feature (221)..(221): n is a, c, g, or t
  misc_feature (490)..(490): n is a, c, g, or t
ggacacaaaactcaatagcatcgtcagctaagctgtctcagatgatgcagatagatccatcagattcttgcagtcccttcgaagaaagactggatggtctggtagaagacaccaacaggatacattgataagcctgccctagcggttagattacacatacgtacgagtgacagtgcatctcaacacatatgctgctagagttaacaatgtggcacacgcantaggaagtccaagaattgctatgaggcacagttgcactgtagtctgtgagaagcggaacgtatgcctgcgttgctctatccagtccatctagttctcgataatgccgcatttcgacaagttgatgtgaattggccacatttgatggaacctaacgcgacaggaacgcacactcgttgacattggaaagacccatgcattgacagcaagggactgcaggatgttctggcagtggagagttggagagagcatacacagggcccacaggatntcgcagagcacttggaggaacagagacgggattgcccatgataacacaggagagaaaccccgagaagggcaaatttgcctcggacaatttgtgtggggtataaccatggtatgttctcaaggcacactagttctcgaacttgtggctgccagttcgcagtatagggtatccagggagagcaaccgaatgaaaccgccttagttccttgaaacgcgagcgttggcaaccaggattagtctaagcaggtgaaaggttgtcttcgacgattgcgatgggccacagccattatgaagttatgtgctcgttacgacaatttcacgttttgaacacccaaaacatgacatactcttgaccaaaattgcacaggtagcctgtacaaacagaccattaccaggattgcaggtcagaaacccaagattgattctcgattccctttttcttatctggatgggaccagcaaattcatgggggttcgtacagggttgccagaatacgaattgggcaccacaggcaacagcacatggtcccctatgaacagcagctacttaaggaacaggatgccaagagaccaccaaaggggaacgtggggaaccggatccgttcacttgggcggacattaatacgacggttacccaatgggactcttatcgctttaacgattttattagggcccatacacgaaaaagggttgctgtgaaaaattggacaatttttgcgaatacataatgagagagaagaactactctatgtgcgaacgagcttataaaatggtgtaccatatatcagagtgagagttaatatctcaaaaaaacaaggggaataattaaccaggaaaacgaatactttagaaacataaattgactaatcacag

SEQ ID NO: 515636 - DNA, 450 bp, Homo sapiens
ttatatacgaggaatttttagaaactgttttccttgtctgcggccattgtgctgctgctacacaactaccgcaagcagcccttcacgccctcctcccagtacaaagctaattgacttgtgagaaatgttaagcttggaagagtcagcatcgctgcacttattttttattctactctgacattagaataatccttgagtgggggaaaggttaaaaacccccctggataagtgttactaattaatgatgattgttttaaacaatgtttggataatttttccttgtcccttgacataaacttgataaataactgagaagtgagaaggagattagtgggttgattaaattccattcaggtacttaaagttagctccaaaaatttagctatttgtaaattgtcatgcatcgttaatgtataagagatgtagatttcatttatctttggtggagcg

SEQ ID NO: 515637 - DNA, 123 bp, Homo sapiens
caggtctcggtggccgctctgcttgcgcgctgttcctgctctgttaactgaatgttgtaccatctttgggtaggcagattccctgatgacatcagtgataaccaaagctgagcagagcgtggt

SEQ ID NO: 515638 - DNA, 173 bp, Homo sapiens
ctcccaagtatgagaaactggaccaccatcctgaatggtttaactgtgtacaacaagtgtctcaaggctacaagcctccggtgtgcaacaataccatctgctttcctggttctccagcttgccaactacagatcttgggacttgtcagcctccataatcacatgagccaattc

SEQ ID NO: 515639 - DNA, 275 bp, Homo sapiens
ctcatagatacttctcaaggtgcagtcatgtcctcacgggtcctctgaaaactcatcttcctccatcccctccccaacgtaccagatgaacaaacggcacgtttgagcatatcatcaggatcaatacttggtgtgtccagagcgatgcccatggcctagagcaatggtctgtggatgttgactcagcgatgcacacagactctctgatacctatgagtcaggatctcgcacacaggtcaccactagtgggatagcattggtggttgagtgccgat

SEQ ID NO: 515640 - DNA, 447 bp, Homo sapiens
cggcacagggcggcctagtgggcgtacgggcctcttttgaacctgagttacgtgtttgacgcgtcgtatgcggccagactaaggcaagtgcttttatatccacggcccattgtcttgacagcaaccctaccaagcaacgtgttatttcctctgttttacggctgaggacgcgcaggaaggtttacagctagaaagggctggagattgtggattcaaactcaggatcagaccaaagccactgccctttagaactttgcgggccgattgattcttgaatctagcttctgccacttcagttgtgtgaccttggggtatctttccgatcccaagtttgctcatctgaaaaatgggaataaagctacagtatctgtcccataggctgggtataaagtgctttactgttgagctgagtgatcatctccgattttcagacccctctcctccgct

SEQ ID NO: 515641 - DNA, 101 bp, Homo sapiens
tctagagatccccaagaaagaactctgggcaagcagacactctgggctatttatacctcagaagttttttggacaggtggtgtgtggtggccttggtacct

SEQ ID NO: 515642 - DNA, 1631 bp, Homo sapiens
  misc_feature (717)..(717): n is a, c, g, or t
aggccatgattgcgaccgtgggatcgctgtgattcgtagacatggccgatgggctatatggcggaccgagttacgatgtctcggtattgtcacgcgaagacttgctcacgtgtgagtcatgtgaggaatggatatcctctggaaccatctcaggagacttacatgactcaaggcggaacgtctagaaattagttgagcgagccaggcttgagagagagacattagacagcccggtgggattggtgcggcgaaaggacgttattctagtagattccatttgagttttccgcggattctcatctagagcatgcaaaagttcatctagcacgagaagaaatattctcatagttctcaggcgcttagatatctgtcgcacaaatcgagtaggacaaggaatgtttgcgaggaagtgggaaaggacaagtggatcagcttgtcaataatcagctggcaaggcagcgtagaaaatgcgtgacacctacaggtccaatgcatctgtatacatatgctcggcataccatttatcgatattacacgcgaacaaacggcagattgccaagagcaaggccggatagcatcctggaccagttatgctggctgcgaatgggcaatccatgtgagggtaggttagagtcgctctcacccgaagctcgcataatcccgtagggagagcacacgcaacgaagaatctcgcgcttggtacttcacactttacangcaatcggggggtagccttggcctcaccattggcaccgggtgttccaattgcagtgcactggagaagcattaccaccggcaaggaaaaacccaagttggttgcgattaccttatccatagggacgtacgacgaggataacatttcttccccctagggtatggttacttaatggggagacgaaagcgaatacaaccgaggggcttaagggcccattgcgtaacagaggcttggggaagatttctctctcccccagggagtttttttcccaccttggtggctataaagagacataatacacaagtgaaactttccaaacacttcagagggaatggcttagtttatttagtcaacccaatcaagttttagggcacagtggaaacattcattaggtacaaggaggtgtgggtagcagaaggttactggtagaagaatgaggacggcggtctcgagacagcgtgtgttcccaaatggaaattgaaccgacagtatagtggggaaggttcaaatctttggtgttggtaaaccggatggggacattgtttattgaaaggatgccgtgggaattggattagggagtaaagataagttggagtgagacgtgaaattcactacaagacgtgttttacactttggaggacaactgcagtgaataacaatgaggtagggtgtatgcgacgaaactagacacaacgttaccatcctgcgtgggggtggtgccacagctactttggggagataaccacactgtaagagtgagaatttacaggggtgaccacagtaatagaatacagaggttaaagagtatatagtgagaagacgacactgcaacatgctctgctgtgtgcaaaagttgtgtcgagactgtgtgtagaacaaatactcggagcagtagtaactgtgcaaagacaagact

SEQ ID NO: 515643 - DNA, 216 bp, Homo sapiens
cacgagggcgatccttgcttccctgagcgctggtccgggaggaaagaacatggcgactggctctggatttgcttcaggtggataaaggaggggacccacccctcatccgagagacgcaggatatgcgcttcaaggacccgggactactggaccagctggtgaatgcacacagcgagtggcgacgatgtaaatttcgagcacacaacttgaacaatc

SEQ ID NO: 515644 - DNA, 515 bp, Homo sapiens
cggctcagtggtcccaggcagctcgggtgtcggaacccccagacagttcacgcgacaaagaatcacgcgggtcaacctcagggacctcatattatgtttagaaaaggaacgtgagacaagccattcactgctgctctacaaagcattccttaagggacacaggaggacgcctggggactataaatatataagcagattacgccttttgggaacgagcaaatgggatattgtttaaaaaacagccacctctttacaatggaacagttttatattcctgtatctaaatcagctcttcagatgcgaaagaaaacacgtttctggaacagagagaacacaaaggcctgtggatactctcaaagggcaattagaacttaactcatgtggaatgaggggcccctcatgccaaacaaggcatatgtaaagaactggagggaattgctaggcaaataagttagcgggccctctggcaacctcataaggaggatgtggaaaaatgagcggcattcgggctcaga

SEQ ID NO: 515645 - DNA, 736 bp, Homo sapiens
aattttgcttcgcaactcttcctgtggaccaagatattgacgctcccacataattttctcttggcacaaaaattctccgtatgtttttcttgtcagcctctctcaagacatataacaaccagttgtgttctctacaatctctttctgatcataacgttgctataacccacctcggtctcacacccccgcaaggtaggctctccacatttctttctcccacacgttgtctataacccccccgctggagggtactaccccccactctcgaaacaatgcttctgtctctttcactcgtattctttgctcttgttcccctcctcacgagttcatacatgttgcgtggaacactcccgcgctcttttacaatttcatttctgtgcgcaatacggtattgcagattcccttacaattttcgaggaattccccttgattccccacaacaagttttggatactttccttatataccccctactccacatctggttcttaaagatttcaccacacgaggctatcataattctgtcagctttcccctcggccaaattttttatcatgaccgcccatagctttaatgaccccaagaggcttctccgtcacccctttgatgccccactactcgtcgcccgctgtttatacatgagagatcatcaacccctttctctttcgggagataactatatttcaataaccccccctgaagacctcccccttctgtccgcatcatagtcagaaca

SEQ ID NO: 515646 - DNA, 326 bp, Homo sapiens
ggtcgacattagaagtccctaagtcttttattagaagtccctaaggccgggcgcagtggctcatgcccgtaatcccagcactttgggaggctgaggtgggcggatcacgaggtcaggagtttgagaccaacctggccagcatagcaaaaccccatctctactaaaaagacaaaaaaaattagcagggcgcggtggtgggagcccgtaatcccagctacttgggaggccgaggcaaggagaatcgcttgaacctgggaggcggaggttgcagtgagccgagattgtgccattgcactccagtccgtacgacagtgcgagactctgtc

SEQ ID NO: 515647 - DNA, 914 bp, Homo sapiens
ggacagggtttcaccatatggtcaggctggtcttgaactcctgacctcgtgatctgcccgccttggcctcccaaagtactgggattacaggcgtgagccaccgtgcccaaccatgaaatatttttacttaaaaatgggaataagctcgcttttttttttttggaaatggagtctgctcctgtgtgcaggctgagtgcaggggcacgatctgggctcactggcaacctccaacctcccggggttcaagcaattctccttcttcagcctcccgagtagctgagattataggcgtgcaccaccacaccgggctaatttggtattttagtagagacggggtttcaccatatgggtcagggcgggtcttgaactcctgacctcgtgatccacccacctcagcaagtgctggggattacaggcgtgtgagccaccacgcccggccatgaaatattttacttaaaaatggggaataagcttttgggtatccggggggtcctccggtcttggcccccagggtcatcaggtaaaaatatcattcatcggaaacgggggctatggcccccttgtgtgcagccaggcggtggagtgggccggggggcacaaacttctgggccacacgtggaaacgtcgccacacactccgggagacaaagacaaagctccccacgtagttgtagaggccgcccccgaggagaacagcggggaaacatcacaggcggaatagtgcaaccacaccacacagcctgagcggctaaacagaagggggtgtctcaccacacaacaacgcacggcgggtcacccgcaaaatcggaccgcgagggtagtggttcagccaaccaccccgtgacacctcggtggtgacgtcaaccgcgggcctataacccccccagaggcggatagagattcacggggacttga

SEQ ID NO: 515648 - DNA, 357 bp, Homo sapiens
tgataagcggataggggcgggggttaggctggagacagccttccctgctaagggctcgtggtccaagccacaacagaggtgctctgtgtggtgtccaggaacatgcagtgccggctccggggaggagggacgagaagagaaaggggagtcacagaggaggctgcagatgagcacgagtttattggactctgggcctcgcgctgcttgcttgatgaagttgatgagcccattggtagaaggcggtcgtgagaggtcacttgagcactggccatcaagctcaggctctattttcttagccagctgctttcccagctccactccccactggtcaaaagcttgttgatgtcccagatgagg

SEQ ID NO: 515649 - DNA, 700 bp, Homo sapiens
  misc_feature (61)..(61): n is a, c, g, or t
  misc_feature (63)..(63): n is a, c, g, or t
  misc_feature (233)..(233): n is a, c, g, or t
  misc_feature (235)..(235): n is a, c, g, or t
  misc_feature (558)..(558): n is a, c, g, or t
  misc_feature (619)..(619): n is a, c, g, or t
ggccgggggccctttatttttaatggcggcagggagggggggtaacatctacccaattccnancaacagcgggttcatgctcctaacaccattatggggtctctgacggcgcacaagctgctattgttctcaacgtgcgtgtcaacagcttacaatatcatgcacctaatgttttaccttccgtgttttcatcatttttattggccgggggggtgtcctactcttccactacntntctacaatgaaagatgttatcaagtctataaccttagactgagcgctgactaagtatttttcttttccacagaattcttccttagctcataccatgccacttggcctctacctaccttaacacgtctcggtgtttctgtctttacgagacgatctcctgcgggacccagctctcttcttattgtttttatattgaaagatttcctacccttccacgcctgaaactctttttatcttgcacatatagttgcacccttacttttttatataatcctcctccccgcccatcttttgatattgtgcctgttttctatttttttcttnttttacctcgattttgtccccttcttctcttttgttttattccctttcgtttgttctctcnctctcttttcttgtcccctcttctcttttcccgctccttttccttcgttttttccctttcttcgcccatattaaaataata

SEQ ID NO: 515650 - DNA, 436 bp, Homo sapiens
ttggacctgaggctctcagtgtggatgcgcccttgcttcatgctgcagcccctgctgacaatgcactgattgtctgcagccccttggaggagtcagccagggaaacctcaggatgcctttgatgaatcaaactgtatcctccccttccaaccccactacttccttcccagccagtatctgatatcctgcctcagccaggacaaccctctcccccacatgtgattgctggtcactagtttgtctctggactcttggcctgtgcagaacatggggtcttggtgtgtgttagagctggccttgaagtcagaattggctaggtcttcgccagggtgattttgatctggttgggcagactttttttcttggtgttgcctccggactcctgagctagacaccggaactatcaataaatgtgtatgaaccatcaaaaaaaaaa

SEQ ID NO: 515651 - DNA, 126 bp, Homo sapiens
taaacaaatctatgttgaagtccttttataaaccagtatcaccttgtaatataaacacctatttgtacttgattttgtaaatttggatttctatatatatcatattttcttaattcattgtacaca

SEQ ID NO: 515652 - DNA, 310 bp, Homo sapiens
atcgcaggggaaaaaaaaatctaaaactcttagtcagtgaccattctccctctgcatttgtttttgtttgttttgttttgttttgtttttttgagacagagtcttgctctgtcgcccaggctggagtgcactagcacgatctcacctcactgcaacctccgcctcccgggttcaagcgattctcctacctcagcctcccgagtagctgggaccacaggcatgtgccactgtgcctagctaattaaaaaatatatattttttgtagggacagggtcttgctatgttgctcaggctggtcccaaactcctga

SEQ ID NO: 515653 - DNA, 141 bp, Homo sapiens
ctgagactgtctgagacaagcttccagaaactcagacgtaaacttccagctggtcacactcaggtgctgtgaggctgggcagagagaccccaggttcccaggatgcggagtctcggaggcggagacacatgaagatggggc

SEQ ID NO: 515654 - DNA, 168 bp, Homo sapiens
cactgtggagggtgtagaatagagtctgagaagcacgaaggaggtcgggagctcatgcaggaactgaactactatctggctccttggcgcactataggtttcttcaaactccatggtaggtgtcaatggccagcttgagacacgcgacgggcatcctctagagctcga

SEQ ID NO: 515655 - DNA, 742 bp, Homo sapiens
tacgacgtcataaaagcgacacatgcgacagacgacaaagactcatatcacccattgtcgctcattggacacgtagattcgggcaagtccaccactactggccatctgatctataaatgcgagtggcactcgacaaacagaaccattgaaaaatttgagaaggaggctgctgagcatgggaaagggctccttacaagatatgccatgggctcttggataaactgaaagctgcagcgtgaacgtggctatcaccaatgatatctccattgtggaaatttgagaccagcaagtacatatgtgactatcattagatgccccaggacacagcagacttatatccaaaaacatgattacagggacatctacaggcatgactgtgcatgtccatgaaagtagctgactggctgattggctgacattctgacgctggtatctccaagaactggagcacgacccgagagacatgccctatctggacttaccacactgggctgtgaaacacactaattgtcgcgtgttaaccaaaaagtggattccacttgcagccaacctaccagaccaggaacagagctatgaggaaaatagttaaacccgaagtcaagaactttacaattaagaaaattggctacaaccccgacacaacgtagcattatgagccaatcactgcctggaatgctgacacacactgctggacccacctgctcaacgccttgatccacgcatcgacacagaaccgacagtg

SEQ ID NO: 515656 - DNA, 430 bp, Homo sapiens
tactacgggtcctgtgagcacgctgtggtgacgaccacgacctttacgggtgctgacggtggatcaggccgacctgtggcgaggctctatgtgtggtaatctggtttgggacacactgtggagaactggatgcaggtaggagccgtggaagtggcacgaactgactggattctgactattatgttcaacagtggacgccagcacagtttgttgactggactgactgtggggtgtgatagaaagacgacggacgtcaaggaccaattctgaggaccttagtcggagcagctggaagcaggaggctgatgtgaatggagatggaatggagctggtttaggtggggatttcaaccatggataccatcatttgaaatgtatcatcagcatcctactggagatatgaactgggcagtaggacttacgcgtttgga

SEQ ID NO: 515657 - DNA, 949 bp, Homo sapiens
cagctgtacccttggttatgggatcccggtcaggcctcgtctgtcggatctggagctcagcctggcgcgcctcccgatcctgtccgacccaccgcactatcgcgccgtgccgctgcccgccccggctcctgccgctgctgctgctcgcgctcctggccgctcccgcctgtccgcgccagcagagccgagtccgtctccgcgccgcggtcctgaacccgagctgcgagtcgcggccaccgcccggcccggtggcccgggaacaccaccgcggtttgggtctggggctggctggtctgcatcggcgagctccaaccagcgatgcgggcgacggcctttggtgacccgcgattatccagtcctcgctccgcggagctacgcgcagcctcaaggcagccggtgatcggtggcggtaacggccgtttaaccggcaaacctccgtcatcgccgtgcctatgcgtagcatgacggcagatcatatcaggggttaaagaccatagtatcaccagaccatgagtgggcattccgttgtgggaaaggtatgagacaaggcatggcaaccattgggggatgtgcaacgggactcgagaccgttggacaggcccttcgtatggacgtacgggaagggctggtaggagagaccgcacgaagacccgacagcggtacactagtaattagaaaagcccccaagactaacaaatcggtaggccgatagtcaccaggacagttctttggctgttccaaggaagcgatgattcacaggtcgagggacagcgcggccgatcaggatataccgcaacaggataaaacccaggcaaagatgggaaggtatagcgcttttcgattaggcaaagacagcgctattagggagacagtacccgcgttgtacaaaagagtatggcccacacacgtaaagattaccataaaagtaccgcccccaattgtataaaga

SEQ ID NO: 515658 - DNA, 133 bp, Homo sapiens
ccttcgtgaccctgggagaaggtgcaccctagagagaatgtgtgcagcgggagcaggcttttttcctactttcactcatctccagccaccacccaagcgttgctacctgcaagaccttcacagaggctggtgg

SEQ ID NO: 515659 - DNA, 777 bp, Homo sapiens
agggaacggcaggaggctcctctagagaatggtggtggtggagactcagggagccggagcttggaactaggatgtggcgcccattaagcgtcaatacctcaccacccagggagacagtttcaccaattcctggaagccaaagggcaggagaagacttgccggggaaacctgaggtaggagaccctggctgtgcaatgagctggctgatgcctgatggcgtaagcggatcctgactgtgatggatggacagacggcgtgactgggcatgacggagtgaggcagcagagccacggggagcagctacatgactcagaagagggccctggggacaagaacaagggcctggtcccatgtgaagcccaacgagactactgacaagaacatgtgctgttgtcccatccctaatccagtgagtcggcttgcataagagtaatcttctggtgatcgcatgcctgctttctgcgacgacgtggggctgcatgaactgtgagacacaaagaccggcacgagcctgggcccccgacatagcgtgcagactcgagacctacggaccggtggccctacaggcgtgaccatgcacgcttcgatgtgggaccaccatgaggcccagagggaacagaaccctggatgcaggaggagaagagggaccagcgggaccagaccccgatacaaacgcaagggcctggaaaaaggcctgcagcagcaggatgagaaacagcgaggacagctcgagcgagctagcaggcctgcgccggtacagcaggccaaacccgtgcg

SEQ ID NO: 515660 - DNA, 604 bp, Homo sapiens
cagcaatctggggggtgtgggcagtcccatcaaaccggggggtaaggtttctcctcgggggtgcccgggcccacggtttcccatgtctctgacatcgttggtccggatggtttagtttaagcagtcgagttctcccaccgctctggccgtgacctcattaacttggccaagaaaagggccaacatcattcctgtgattgaggatgctcgacccccccccaaaaaccgcatgctcatcgcaatggtggatgtgatttttgctgatgtggcccacccaaaccaaacccggattgtggccctgaatgccccccccttcctgggtaatggaggaccctttgttatttcccttaaggcccactgcattgactccccagccccaaccgaggccgtgtttgccccccaagtgaaaaaaatgccaccggagaacattaaacccccggagccgtttaccccttagccatattaaaaagaccctcccgtggttgtggggggggacaggccccccccccaggtgaaaaacttaagttcagccctgtcaggattgcgaaaaatgtgggttgaaactgttgcccgggggtttttttattaaaaaactcctccgtcca

SEQ ID NO: 515661 - DNA, 984 bp, Homo sapiens
  misc_feature (57)..(57): n is a, c, g, or t
gtggactggatatctaggttcccagcatatgatccagtactcgactcggcgagtaantaccgacaagcggtggaaaggggactcctcttaccatcgcatagtcaagactgtctagaaacaattcgcgcacacgctagtttggaccccccacatctgttgtggtacttgaccacgcacgacgttgtccgggtaccatacacgttcgcacgtacgcggagcgctatcgatactagaagtggattacattccaatagaggctcataaaggagactatacgatgaatgagcagatcttatcagagaaggattgtagaaatgacctgtatgagtagatacgccttgatttcttgatgccttagtggagtatgaatcattgtcgtgggggtttagccgcgagactgcgtgtctagatggaagttcgtcgaggtacatctccctcaggaactaggacgtgaagagacaatgtagtagctggaagcggctcgctagaatatgggcctcctattgccccgtagcgaactagcgcagcgttcctttccgtgacttccacactcagaacagagtcgttggcttcggagattggccagttaagtcgttattcacatcatacgcgctcgggtctgacctctgaaaagacgatcacgtaagcgaaatcacggaagacaggtactaaccgcataaaaagttcaaccccatcgcatgtcattggtccgatcagaccacgtgagtgctgggacagtcctgaccactcgaggacaggcgtggcttcagttcagacgagaacaccgcgccctaatatcaacgaagtgatgcagaacttcggatgacggcaaaatctcttaccctctctagaaacaacaccctttaccgctttacccatattaccagtcctgacgcggaaacgtactcaaacgtgtctaacccgccaacaagcattcctcgtcggcctaacccggagaatggccgcggactgtgggcatcggga

SEQ ID NO: 515662 - DNA, 238 bp, Homo sapiens
caaataggactcttctatatctactatgggcacatgcaggtcttcagacataaagtctcccagcccacatcttatgttttgttgtttgtatgttagtttgtttgtttgagacagagtttcactcttgtcacccaggctggagtgcaatggcacgatcttggctcactgcaacctccatctcccgggttcaaggaattctcctgcttcagcctcccaagtagctgggattacaggtgcc

SEQ ID NO: 515663 - DNA, 396 bp, Homo sapiens
gaaaagagatttaaacacagaggtaaatggttaattattagtggccaagttactcaggggactaattttttcttggtacacattcaccaaaattttacacttgaagccaaatagtaaatacctttaggagtagagagtaatccctagcagaagttattttctttatgtcaaagaaaagtaatagaacgcaacccaggcttacgacccctgttaaggagatgattgtttaaagcatcacagttcatgcactttttaaacgcaggagattgacccttgcccttaagcttcttaggggtatctgagcacagccacaagctccatcaggcctgctcagtccaagtaggtctgtaaggtgcctcggcgccgcacatcacaggtacagctatgaaagcctct

SEQ ID NO: 515664 - DNA, 927 bp, Homo sapiens
caaaatgctagtaaagaaaggttcacatcgaaggaactgatgatgtccacatgggctactagaactagactctgggttttagacgtgaattgttactttctttacagcttcctggaacgttgagaagcaacaaaagacattccagatagctgtggctgagcatagagtattgatctcatttatatacatcttaattattgtactccagaataaattggctaattctacatagacaaaaagaaatggctggaccacactcaccacctttatttctatctcttgcgatctattcttaacaactgcaacgctacacatacacttactactactactgctctatctgtgtgtttcacttcacacgaccgtacgacgcttacacaaacacgttcgccactatctgcagaactcccctaatctgtgtccgcactacgcggcaacatacgcacagaccccacagttaccaagatgtcactagctagaacacgaacctacgttggcgacattgtttccaacgcactatgcgccaaactaccctctcacaaaccgattcgcgctgatccactccaacgacggctctggaacactccaattatccccagaagcgaacattacaccaggttgcaacaacattccccctccacgttccttataaacttttgctcccaaccccctccccgccaattacgcggaaactttccaaataggtagcccccagatatagcacgcgtaacttgtttccccaaaccccgactagggccccacggggcaatagaggcattactgaaactttgtaattccccccggaccacaccttcaacatcttgagcacacataacgtctaaattcagcgtgcatctttccaccctggattacgcactgttattctattcaggtatctgggccccccacggcatcaacttgctccac

SEQ ID NO: 515665 - DNA, 818 bp, Homo sapiens
tcgcccttttgttttattttggtacaaaatacttatgtattcatgaatccatgaccaaataactatgaaaacctaatataaaaagaggtgtggtatgggtctcccgccccccaaagctcccctcctctgtgtagaattcagctctgagagtgaccaggaaaccagggctggtgcctcctgggcggggacctccattcagtatccctcaccatcccctcgtgttatcaggtatgggccatccgtggggggtgtaccctgaatccggattcccccaggagttctagaagagaatagagtttccttggggacacggggacttcattgacactacattgtaccccccatcatcataactcgcgtgcccgtgggaacccatcaccatgcgtgagcggaacacagaggaacaccccaacagtatgcggcacgttggcaatcaacccaaacagtagcatccacagtgaaggaagcaatcatcgcggggcaccgcgcgggaatcgcaccagtacgtgagtctcccacaacaggacacatcggccgcaaagcggacccgagggagggcacccaatgataaacgatgggcgggagcgcagaccccagaagacacccaaggtgagtgcccacgaacaccaaaaggggcggtaacactcatcacccacggaagggacgaacaacccaacaatacctacccgccaatgaaggagggcggactctccaccataaaccaagacaccactggggggcttcagcagccgtcacggcataaccatacatgggcccaccggggacatccccccggggaatcccccaaccaaggggaa

SEQ ID NO: 515666 - DNA, 213 bp, Homo sapiens
  misc_feature (1)..(1): n is a, c, g, or t
ncctatggtaactttcggacatccttcccggactgacagccagcgaagaaggattccagcctatgccctcctcacagggagaccaacacatgaccaacatcttcctactgcaaatacttgcatttctcgactttacgtcccactctattcctctaaacagattctcaaacagaaattgtctctcgccattaagaccaagaattttggttttga

SEQ ID NO: 515667 - DNA, 128 bp, Homo sapiens
cggcacgaggcaactggaaaattacgtaaactggaaaagattcggcaggatgatacgagttcatccatcaattttcctgactcgagttagtggcattggtccatctgctgcaaggaagtttgcagatg

SEQ ID NO: 515668 - DNA, 108 bp, Homo sapiens
gcgaaggccgctggcgccgcctcggccagcccttcccgcgcggttccactgccttaggatgaagttgtagggaaccctcgaagttggagctgccagtggttgccaatc

SEQ ID NO: 515669 - DNA, 764 bp, Homo sapiens
gatacaaacacagacccggagaggacttcaacgagtctcagagtgagcgagaaagcactatgccttctggtgctgacgtagcatgctgtcgatgcttttgaaagtccactccttgcatggttatgcctggcaaaccagagggcaccttcgctgcagtcgcgtgtgtctcttgggatgtcattcagcaggctggccagtaggatgagacatccgccaaagtcctcagatttcttgcggtatggtaccgtggcttggctggaccgtaggaattcagtctgcacatgtgttagggtgcccctgacttgggccagagaccccagggaccaggccaggataggcaaagcagaggccaaggagaggccccccctggcccggaacgtcttcaggccagggggtcacagctatggtgggggggccaccaatgccaatgccaggacaaagggaggcaccgggcagacaggaggcctgacacagcccaagaaggatgaacccaaaaagctgccccccagacgggcggcctgaacccaagccaggacaccctccccaaacaagggaggctacagcccggactgtgaccccaaaaggacagcttcccggaggcaaggcacccccaaaagcaggatcgtggccccagctccttcctgctgacgaaggccagggagcccgggcccccagagagccaaagagccgtttcgccacccgcgatagacccaggagtaaatgctctacgtgtacaggacgctgacgatgctggaagaaaggga

SEQ ID NO: 515670 - DNA, 123 bp, Homo sapiens
atggatgatggagagatagatatatagatcagacgtagacgaacagatgatagatagatgttaggtagagtaaatagatatatcatcggtagatggccagatagatgttaagtagacaggtgg

SEQ ID NO: 515671 - DNA, 139 bp, Homo sapiens
atgattctagaggatccctgagtagtgactcagttcttcatcttgtaatgtcgatagttttgccaccctaggccaggcccatgccataccttgtcatgactgtcaaagtgcttgtggttaggtcaaactggttttggtt

SEQ ID NO: 515672 - DNA, 188 bp, Homo sapiens
gatctagaggatcccgggggttcttccggacattcatcactactcactcactcacccagagcaacctccagcctggcaagctctatgatacaagcggtggagtaaaataaatctaagccggccaggcaggatggctcacgccggtaatcctaacagttggggaggctgagacaggcagatcacctgag

SEQ ID NO: 515673 - DNA, 106 bp, Homo sapiens
aggtgccattagacagcagcggcatcaatttgtcaggctttgggagtgagcagctagacaccaaatgacgagagtgatgttacccatgtacactacagttacatct

SEQ ID NO: 515674 - DNA, 216 bp, Homo sapiens
ctgagacattttcggcatgtgatagccctgatctgctcccctcaaaagtcccttggaatatagcctagctaatctcagcatacgcttttcttacatcctggagtatgacattacgccaagcccacttgtctatattgtccttgtctacacatcacttaatcaaccatcaaacttaaaaataccgattatatgaccaatctccattattccacagca

SEQ ID NO: 515675 - DNA, 357 bp, Homo sapiens
agatcacgccactgcactccagcctgtgtgacagagcgagactccgtctcaaaaaaaagaaagaaaaaagggggggggggggagaatagatataaactacagatatctttaataaagataaggaaatcccttttaagtatctagagagcttcctgcagaagtctttagaataaatttggtcctatagttgttttacctttaaaagtctatgtcaagtattgtataaaggcataacactaagcttcattacaattgagtagggaaaataataattcctacctctgttatcttggaaaactgtgtataaacttctattctcaacacataataaccagacttacactaagggaagccata

SEQ ID NO: 515676 - DNA, 171 bp, Homo sapiens
ccggacgcgtgggccggaccgcgtgggcagaaccccgacccctgactccccggtggggaggtggcccaggatgctggagctgaatccgacgctgaccgtttttcaggcaattctatttccccatcggattggaccccttggccccaataaagttggaattttaccccccca

SEQ ID NO: 515677 - DNA, 358 bp, Homo sapiens
agacaggttctcactctgtcacccaggctggaggggggtggcacgatcatggctcatggcagcctccacctccagagctcaggtgatcctcccacctcagcctcccaagtagctgggaccacagatgcctgccatcacgcccgactaatttttgtactttccgtagaggtgggtttttgccatgttgcccaggctggtctcaagctcctgagctcagtctgcctgcctaggcctcccaaagcgctgggattacaggcgtgaaccactgtgccaggccaagggtgatcttcaaacagcctactagctctccagcttggactctctagatcgctattgcctcccgcttcctttctgtcca

SEQ ID NO: 515678 - DNA, 197 bp, Homo sapiens
acacagcaggcattccaatgtattgatcatgcagttgccggcttcatacaaacattgaagctctacaaaaccatgacaatgagtctgtgtataacggcttcgttacgcttaattgcgaagtatttctctgtagagcgcagaggacgatcaacacgttgtacccgaaactacctctgaaggctacactttccaagttc

SEQ ID NO: 515679 - DNA, 422 bp, Homo sapiens
  misc_feature (7)..(7): n is a, c, g, or t
tggccgnggggcaagaacaccatgatgcgcaaggccattcgtgggcatctggaaaacaacccagctctgcagaaactgctgcctgatattcggaagaatgtgggctttgtgttcaccaaggaggacctgactgagatcagggacatgttgctggccaataaggcgccagctgctgcccgtgctgttgccattgccccatgtgaagacactgtgccagcccagaacactgggctcggacccgagaagacctactttttacagactttaggtatcaccactaaaacctccaggggcaccattgaaatcctgagtgatgtgcaggtgatcaagactgtagaccaaaggtgtggtgttaaaaaggggtccccccccccccaaaaaggggttcttcggggggaaaaaaagtatccagcagggtgttg

SEQ ID NO: 515680 - DNA, 192 bp, Homo sapiens
ataccgccgctggccgaatggcacagtgagaggtcagctcctaaggtggtcaaacaggagaacgaagaagaagaagaagacaggtcgggctaagcggcggatgcagtacaaccggcgcttggtgaatcgattgtgcccagcttttggtcaagaatgaagggccccaattgccagttgcgcccagcgggggtg

SEQ ID NO: 515681 - DNA, 213 bp, Homo sapiens
ctctacgacggaccccaggtccgggtcccccactgggacttcgattagcggcagcccgggagctttttcacttataccaggggcagaataagtctccaggtgggtggtatgggtgtgctccaatttttttttttttttttttttttttttttttttttttttttttttttttttttttttttttttgtttgttttttttttttttgggggggg

SEQ ID NO: 515682 - DNA, 265 bp, Homo sapiens
taaaaaaatggccccttggggggggcaatgtcccccccccccccgctagatttgggcccaaagtttttccctgggtcgctgttgctagcagggggattttttttcccgcccccccttttttccccctgaacttgggtaaaaactcgggtttcctgagggggggggggccccccctttgcccccccatttttgtttttctccccccccctccccctcccccgttttgggtactaataaaaaataagccttttggttttctttttta

SEQ ID NO: 515683 - DNA, 729 bp, Homo sapiens
  misc_feature (506)..(506): n is a, c, g, or t
  misc_feature (729)..(729): n is a, c, g, or t
gggcacttgtgataatgcgccgggagcggcgaggtattgcgccagcccggagcagtgttgcagacaatggcgatgaccactcagaaggaggcctggtggagaaccacgtggacagcaccatgaacatgttgggcgggggaagcagtgctgttccggaatcccctcaatgtcgggtgtgggcggtagctgtgccgctgttccggtcagaaggtcactgagtcagacaccggcagatgggcaagggtggcaagcatcaccttggcctggaggagcccatgtaagctgcgtaacacccctctggcaggatcgtcccgtagccaactaggaagctgtgaccagagttcctggaagctggcatctcacgacctatgtcgcacttcgcggatgatgctggggcacctcgtggtagcgacctcatcactccactgctactatcctcgcaacgtgtgtacaagtcatggctctagtacgaactcgttcaaactagttgcatatgaatgtcgtcnttgaaccgtggcatgcagatggtggacgatgcgtcgagtgattgtgaagcgcctctaaacaacctgcgagacagccttgatgcgcaggtggcaaagccccgccaatgctattacgctgtgttgggggaaccccccagatgttgttcagatccttcgtttcgttagcaaacttgaaggacaaggagaagcgcacgaggcctcagacagcgtgggttgacaccan

SEQ ID NO: 515684 - DNA, 457 bp, Homo sapiens
ctttacacctaccctgctccatccattgccttgacttgccagttgctttccccacccccaaggcaaagaaacaagaagcaggagagtgcaagaggctcaggatctgatcttctcaacagcaggagaaaaccctagcctggcttcactcagaagatgtcatcttggattagaaaagagagagagagccccaacttggattgacagagtatggagcctgaaggagcccaggtccctgagacacggtggaacaaagccactatactacctcaggactctgtacgccctgctttatatagaggagaagtaaacttctatctttttaaagcccctatttgttgaattgtattgtcacagccatatccaatcttaaggaatatacaaagattatgccatggcttttgtagcccaattggctatctaggcaagtaaaataatttgaatgatgaaaaaaaaaaaa

SEQ ID NO: 515685 - DNA, 85 bp, Homo sapiens
catggccagacaaaaacttggccttttaagggaaaaaaaaagggggggccctccattttgtttttttaaagccccttttttttta

SEQ ID NO: 515686 - DNA, 900 bp, Homo sapiens
  misc_feature (248)..(248): n is a, c, g, or t
  misc_feature (265)..(265): n is a, c, g, or t
  misc_feature (267)..(267): n is a, c, g, or t
  misc_feature (296)..(297): n is a, c, g, or t
  misc_feature (304)..(304): n is a, c, g, or t
  misc_feature (306)..(306): n is a, c, g, or t
  misc_feature (322)..(323): n is a, c, g, or t
  misc_feature (338)..(338): n is a, c, g, or t
  misc_feature (340)..(340): n is a, c, g, or t
  misc_feature (342)..(342): n is a, c, g, or t
  misc_feature (361)..(361): n is a, c, g, or t
  misc_feature (377)..(377): n is a, c, g, or t
  misc_feature (379)..(379): n is a, c, g, or t
  misc_feature (384)..(384): n is a, c, g, or t
  misc_feature (386)..(386): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (443)..(443): n is a, c, g, or t
cggacggcgtgggtctgcccacgcgtcgggcgctgcggggcggctggcactaagcggtcctgaggctgtggctacggctgctccggagctggtggcgccgcgataggagagccgatggccaagtggggtgagggagacccacgctggatcgtggaggagcgggcggacgccaccaacgtcaacaactggcactggacggagagagatgcttcaaattggtccacgggataagctgaaaacactgttcntggcagtgcaggttcananatgaagaaggcaagtgtgaggtgacgganngtgagtnangcttgatggagaggcnntccattaacaatcgncnanagggaaacttatcttcttntatgaatggagcgtcnanactanantggacaggtacttctaagtcaggagtacantncnaaggacatgtggagatccccagnttgtctgatgaaaacagcgtggatgaagtggagattagtgtgagccttgccgagagatgagcctgacacaaatctcgtgggcttaatgaaggaagaaggggtgaaacttctaagagaagcagatgggaatttacatcagcacctcagaacagagttcacccagggcatgatcttacctacagatgaatgaggaggtccaagtagaccccaggtggggcatcagcactgaaaaactgaggagcgcaagggctaaggctggtccttcaaagacccaggcagacctgttggagtaaaatccccattgttagatcactcttaagggaaccttctgaggtttccgaagagccccataggggtatcccccaagaatgggaaggcgttacccaggtccttgatttagccaccagggggagtcccctggaatggcgctcgggattatggtggcctcgaacatggg

SEQ ID NO: 515687 - DNA, 844 bp, Homo sapiens
  misc_feature (142)..(142): n is a, c, g, or t
  misc_feature (184)..(184): n is a, c, g, or t
  misc_feature (284)..(284): n is a, c, g, or t
  misc_feature (327)..(327): n is a, c, g, or t
  misc_feature (331)..(331): n is a, c, g, or t
ggacttcccagattgtgcactctccatccagggtgcgctctcgtcgggagtcccagccatgtccgacgagagagaggtagccgaggcagcgaccggggaagacgcctcttcgccgcctccgaaaaccgaggcagcgagcganccccagcatcccgcggcctccgaaggggccggccgacgccgncgcctcgccgccactgctgcgctgcctagtgctcaccgtggctttggagtgctacgacaatggtgaagcttgcagagcctggcctggcatgctgcccccnggcccctgggccctgggcagctgacgctgcgtctgcgtggccntgcngggctcaacttcgcagacctcatggctatggcatggggctgtacgacctgtctccctgcctctgcctgttcactcctggtcatggagggcgcgggtgtcgtgatcgcactgggcgagggagtcacgcgaccgggaaggccaggcagaccggcgtgagtggtgttgaaccgggtccagggctgtgcgcacggaacaaggtgagtgtaccctcggtgccagaccttcctggattcctgcacggaccattgaccttttgaggaaggcgtggctgcctgtgtgccggtctcatgtagcatggacagggctaacatgggttgctacttttgaggtgtcaggtggaccttagcaagtcctggaccatgaggccgtatttgaatactagattggtgtagcggggggggatttggattatgtggttgccagtgtcagttgtgggggtagcattggcgaactgtggcagtgttcggaaagggcctcgtttgatgacagatggagggaccttaaggctacttc

SEQ ID NO: 515688 - DNA, 965 bp, Homo sapiens
  misc_feature (60)..(60): n is a, c, g, or t
  misc_feature (113)..(113): n is a, c, g, or t
  misc_feature (164)..(164): n is a, c, g, or t
  misc_feature (313)..(313): n is a, c, g, or t
  misc_feature (330)..(330): n is a, c, g, or t
  misc_feature (332)..(332): n is a, c, g, or t
  misc_feature (361)..(362): n is a, c, g, or t
  misc_feature (369)..(369): n is a, c, g, or t
  misc_feature (371)..(371): n is a, c, g, or t
  misc_feature (387)..(388): n is a, c, g, or t
  misc_feature (403)..(403): n is a, c, g, or t
  misc_feature (405)..(405): n is a, c, g, or t
  misc_feature (407)..(407): n is a, c, g, or t
  misc_feature (426)..(426): n is a, c, g, or t
  misc_feature (442)..(442): n is a, c, g, or t
  misc_feature (444)..(444): n is a, c, g, or t
  misc_feature (449)..(449): n is a, c, g, or t
  misc_feature (451)..(451): n is a, c, g, or t
  misc_feature (481)..(481): n is a, c, g, or t
  misc_feature (483)..(483): n is a, c, g, or t
  misc_feature (485)..(485): n is a, c, g, or t
  misc_feature (508)..(508): n is a, c, g, or t
ggcagatcatttgaggccaggagttcaagaccagcctgtccaacatggtgaaaccctgtntccactaaaaaatacaaaaattagccaggcgtggtggcgagcaccaccgtggncagccctgagtcccaagtactcaggaggctggggcaggagaatcacctgantccaggaggcagagattgcagtgagccgagatcacagacccacgctggatcgtggaggagcgggcggacgccaccaacgtcaacaactggcactggacggagagagatgcttcaaattggtccacgggataagctgaaaacactgttcntggcagtgcaggttcananatgaagaaggcaagtgtgaggtgacgganngtgagtnangcttgatggagaggcnntccattaacaatcgncnanagggaaacttatcttcttntatgaatggagcgtcnanactanantggacaggtacttctaagtcaggagtacantncnaaggacatgtggagatccccagnttgtctgatgaaaacagcgtggatgaagtggagattagtgtgagccttgccgagagatgagcctgacacaaatctcgtgggcttaatgaaggaagaaggggtgaaacttctaagagaagcagatgggaatttacatcagcacctcagaacagagttcacccagggcatgatcttacctacagatgaatgaggaggtccaagtagaccccaggtggggcatcagcactgaaaaactgaggagcgcaagggctaaggctggtccttcaaagacccaggcagacctgttggagtaaaatccccattgttagatcactcttaagggaaccttctgaggtttccgaagagccccataggggtatcccccaagaatgggaaggcgttacccaggtccttgatttagccaccagggggagtcccctggaatggcgctcgggattatggtggcctcgaacatggg

SEQ ID NO: 515689 - DNA, 804 bp, Homo sapiens
  misc_feature (142)..(142): n is a, c, g, or t
  misc_feature (184)..(184): n is a, c, g, or t
  misc_feature (284)..(284): n is a, c, g, or t
  misc_feature (327)..(327): n is a, c, g, or t
  misc_feature (331)..(331): n is a, c, g, or t
ggacttcccagattgtgcactctccatccagggtgcgctctcgtcgggagtcccagccatgtccgacgagagagaggtagccgaggcagcgaccggggaagacgcctcttcgccgcctccgaaaaccgaggcagcgagcganccccagcatcccgcggcctccgaaggggccggccgacgccgncgcctcgccgccactgctgcgctgcctagtgctcaccgtggctttggagtgctacgacaatggtgaagcttgcagagcctggcctggcatgctgcccccnggcccctgggccctgggcagctgacgctgcgtctgcgtggccntgcngggctcaacttcgcagacctcatggctatggcatggggctgtacgacctgtctccctgcctctgcctgttcactcctggtcatgtgatgtgtgctgctgtggttgtttgttgaatctgcatgttgtgtgctgacgggagtcagctgacctgcaatggcatgtgatgacctgggtgatggttgtttgaaccggtcatgtggacttgttggcatggaagaggtgacttgtgccctcggtccagaccttcctgattcctgagtgccatgaccttttgaggaagctgctgccttgctcgtcaattacattacagcctacatggtcctctttgacttctggcaacctacagcctgtgccacagcgtcttggtaacacattggctgcagggggtgtgggtatggctgccgtgcagctgtgccgtaccagtggagaatgtgaccgtgttcggaacgggctcggccagagcaagcccgagg

SEQ ID NO: 515690 - DNA, 577 bp, Homo sapiens
taccacagcgcactaccttattagtatcagctaatttattcttcaccccaacccctagcaaccaccattttactttctgtgtctatgaatgtgactacttgtagataccttatgtaagtggaatcatacagtaattggctctctgttattggcttattctttcagtataaggcccttaagattcatccatcttgcagcatatgacaggttctttctttttaaggctgaataatattcccttgtatgtacatactacattttctgtatccattcatatgtcagtggacatttcggttacttcgacctcttatctattgcgcaaaatgggccaataaacatgagtgtgcaaatatctcttcaagattctgccttcgattattttgtatatatatacccagaaaaagaagggggaggctgggcgcagtggctcacgcctgtaatcccagcactttgggaggccaacactgggcggatcacgaagtcaagagatccagaccactctggccaacatggtgaaaccccgtctctactaaaaatacaaaaattagctgggtgtggtggcacgtgcttatagtcc

SEQ ID NO: 515691 - DNA, 721 bp, Homo sapiens
tcgatgccgcagacctggtttaagccagatctggtataacaagtctaggacggccaccaagatggaccgcttgctcaaggacatgacgatcaagttcctcgaggacatctatatcatctccctgcccatgaagcaatcagcgatcattgctatcattctgcaagactctatcaaggacgcggtggtgaagattatcccagagcagaatctgacccgtaccgcacagctgacacggttccaggcatatcatgctatcaggttcaagcatgatcacggctactggattacaagtgctacatggatactgggcgtcgacatacgcaaggacatgatcatggtcaagctgtgcatcattatcgtggcaaagactactggggtaacaagatcggcaagtcccactactagcactttgatggagtctgaccactataccttctaaggtgagacgactcatcgatgtacccatttgtaacagcattgcttccgaaactgtgactacaatgctcctcatgaccgttggctaacgatgactggatcacctcaacccttgaggtacagttgcaccctgggccaattttggcatgacccacctttggtagcatttgtaaaagccacttttactctacccctaacgcctttaaggagatggcattaacaactgtcccttttataaatcaccgccctttgaggtgactagagtttcgggcagaggaccttcttc

SEQ ID NO: 515692 - DNA, 152 bp, Homo sapiens
  misc_feature (2)..(2): n is a, c, g, or t
  misc_feature (141)..(141): n is a, c, g, or t
tntttgggaccgagaggaaagatacaggtttatgatcttgccgacaaagcacgtgacaattgacgtctggcgagggggcatcttcacaagagacagtgaaagatgatgggggaggaatagaatcaggttaaatcaataggnatttggaacac

SEQ ID NO: 515693 - DNA, 1005 bp, Homo sapiens
gctggtgtgctgcacccatagtaactgacttctaaaacatacattcactgacaaaatgatggtgaacaattcgttctgtgtaagtaagacgtaggcatctccatattgtaacactggagaggagaaaaaccaaagccaacatagagcccttgatatcccctcggtagtcaggacctaggggtttacagtaaggagcagcaggcaacaacattaaccttctaacagcaagctatcaaaatgaacttgaaataatgcacttagttccatgtagtccttaacctccctgtgagaaacctgcacatgccttgcttcctaattcttcttctggagctcagggccaggattggtagtgctgcatatagagctgtgttgggaagaactgtaagactcaatgaaggaagagtgtagtgatcaattagtgatgtctgccaagagtatgggaagggatggggacagcacatgtgctatgtatttgccaaccctgaactggggcatattttcagtaagctgtctctgccatggaactgtagtgtacaaagctaaactagtattaatgaatactagttactagtacctagtattcacttgtaacttctccagcatgagataattagtgcctttgcttgaccttccagtgcaacaattttcacagactttaccagtaattctcatagatgacagacacactttgcgtagatatgactagtctggggattcagatcactaggctgttgcaaagtcacccaagatagtagccacgaaaaagccacagaactgcacacacacttacgcacacacaaatacgaaagcacaacacacggtgcaacaagaccacagtacgacacgcagacaccactcacaaagaatcatgagcactagcaacatacagaaacgagcagggaagagcagaggcagtcgagtagcgggaccaagagaagcacgacagagccagacacgcagtatacgaaccacaatgtcacgcggcagcgacaacaatcgacaaag

SEQ ID NO: 515694 - DNA, 137 bp, Homo sapiens
ttgtagcgggcacttctcaccctgagaattgggactcaacagtgggcagctgatgacacacttggtcagtgactttcccccaggagctgccgtgctgcatgtcatgtatgagtcacctttcacactgctgtactgtg

SEQ ID NO: 515695 - DNA, 471 bp, Homo sapiens
  misc_feature (137)..(137): n is a, c, g, or t
  misc_feature (146)..(146): n is a, c, g, or t
  misc_feature (148)..(148): n is a, c, g, or t
  misc_feature (150)..(151): n is a, c, g, or t
  misc_feature (158)..(158): n is a, c, g, or t
  misc_feature (163)..(163): n is a, c, g, or t
  misc_feature (170)..(170): n is a, c, g, or t
  misc_feature (173)..(174): n is a, c, g, or t
  misc_feature (176)..(176): n is a, c, g, or t
  misc_feature (188)..(190): n is a, c, g, or t
  misc_feature (195)..(195): n is a, c, g, or t
  misc_feature (197)..(200): n is a, c, g, or t
  misc_feature (206)..(206): n is a, c, g, or t
  misc_feature (211)..(212): n is a, c, g, or t
  misc_feature (215)..(216): n is a, c, g, or t
  misc_feature (225)..(225): n is a, c, g, or t
  misc_feature (230)..(231): n is a, c, g, or t
  misc_feature (236)..(236): n is a, c, g, or t
  misc_feature (242)..(242): n is a, c, g, or t
  misc_feature (251)..(251): n is a, c, g, or t
  misc_feature (257)..(257): n is a, c, g, or t
  misc_feature (283)..(283): n is a, c, g, or t
  misc_feature (286)..(287): n is a, c, g, or t
  misc_feature (300)..(300): n is a, c, g, or t
  misc_feature (308)..(308): n is a, c, g, or t
  misc_feature (311)..(312): n is a, c, g, or t
  misc_feature (316)..(318): n is a, c, g, or t
  misc_feature (320)..(322): n is a, c, g, or t
  misc_feature (324)..(324): n is a, c, g, or t
  misc_feature (329)..(329): n is a, c, g, or t
  misc_feature (334)..(334): n is a, c, g, or t
  misc_feature (338)..(339): n is a, c, g, or t
  misc_feature (342)..(342): n is a, c, g, or t
  misc_feature (355)..(356): n is a, c, g, or t
  misc_feature (358)..(358): n is a, c, g, or t
  misc_feature (364)..(364): n is a, c, g, or t
  misc_feature (373)..(373): n is a, c, g, or t
  misc_feature (375)..(375): n is a, c, g, or t
  misc_feature (390)..(390): n is a, c, g, or t
  misc_feature (399)..(399): n is a, c, g, or t
  misc_feature (406)..(406): n is a, c, g, or t
  misc_feature (408)..(408): n is a, c, g, or t
  misc_feature (443)..(443): n is a, c, g, or t
ggcggcggacgtgtccgttactcaccggcccccgctgagccctaagtctggggccgaagtcgaagccggcgatgccgcggagccgggcgccggaagaagagctgccgcctctagaatccagaagagaatccggaaangcctggaanananngagcgcnagttncgtaaangcnngnaagataatgatnnngggcntnnnnggggangtgannaannaggaagtanatganntgctnagtgantatgagctnaaatantgttttgtggaaaaataaaaaggganagnnttagtgaaaatgntgaatggngannaggnnnannnanaaatnaatgntttnnaanagagccagaatgnngnacactnaaatctacntnaacatcaggaaaaangatgaaatnatgtgtntncaaaaatgaaaaaaagaataaaaaagaagaagttngaggagctggtgcggaccttaggcaaga

SEQ ID NO: 515696 - DNA, 166 bp, Homo sapiens
ggacctgcctactgggcgtatgccttttccgtaacactcacaaaactaactagatactaacatctcagacgctcaggaagatagaaaccgtctgaactatcctgcccgccatcatcctaggtcctcgatcgtgctctccgcgatcgcctacggcatccgtttagca

SEQ ID NO: 515697 - DNA, 696 bp, Homo sapiens
  misc_feature (3)..(3): n is a, c, g, or t
  misc_feature (5)..(5): n is a, c, g, or t
  misc_feature (16)..(16): n is a, c, g, or t
  misc_feature (26)..(26): n is a, c, g, or t
  misc_feature (38)..(38): n is a, c, g, or t
  misc_feature (52)..(52): n is a, c, g, or t
  misc_feature (64)..(64): n is a, c, g, or t
  misc_feature (165)..(165): n is a, c, g, or t
  misc_feature (354)..(354): n is a, c, g, or t
  misc_feature (382)..(382): n is a, c, g, or t
  misc_feature (424)..(424): n is a, c, g, or t
  misc_feature (485)..(485): n is a, c, g, or t
  misc_feature (487)..(487): n is a, c, g, or t
  misc_feature (518)..(518): n is a, c, g, or t
  misc_feature (590)..(590): n is a, c, g, or t
  misc_feature (641)..(641): n is a, c, g, or t
  misc_feature (662)..(662): n is a, c, g, or t
  misc_feature (676)..(676): n is a, c, g, or t
ccntnaagtccaaggngaattgtggngctggagggcgncccctccccggagnttcctcactgcnacaagtgagggaggagggggtcgattctggtttaggggccggacccactgagaggccccagagccgcccgtgatgttcctcccccgtccccatctggcagntcctgtctcgcctgagggacccagccgccttctccgtgctctggggccgggcctcgctgcttagcagcggcctctagctccgtctcccggggacctgggcctgagggagggctggagtcgcacgcgctttgtccttagcgcctgtctgctctcctctaactaggacccaggggctttggtttccccagntcatccttggaccttccgctccaccagnctggtctgaggcgtgctctgtccttagagaaggcgcggtggncgggttcccttcccctaggggacattactaagggggtcaggcactgcatgctcgttccagnancatcttgggactgggtacaagtacctccagnccccaggggccctgacctggggaacctaggttggaaatcttcacggaacctccccaggaggttgggggccanttgaattaatcccggacctcaacaactctttttcctttggagcccaaaggnaggagttgggggttgggggcnacccaggaaagggnaagtttttggttgggggccc

SEQ ID NO: 515698 - DNA, 340 bp, Homo sapiens
ccgcagctcggggctggttggaatggaaagccttaggaatatggcagtgttccagtgtgtgaacaaatcttcttgtccaagtcctccagttattcctattgggagacacacaggaatacacctctggaagtctttccctttgggaaaacagtagattacacatgcgaccccctacccagtacggagggacgagcttcgacctctttggagagagcaccatccgctgcacaagttaccctcgtgggtctggggtttggagcagccctgcccctcgctgtggaattctgggtcactgtcgagccccagatcattttctgtctgcccagccccagctgcgcgc

SEQ ID NO: 515699 - DNA, 357 bp, Homo sapiens
cagtttctcaaataatattgtttaattcaacaatgtttcattataatgtttataaaaaaaaatttgatgcccagctggggccactgtctgtgtggagtttgcaagtcctccccatgtctgtgtctgcctgtgttttctctgagtactccagtttcctcccacacatcaaagctgtgcacattaggtttgttggtgtgtctcagtggtcctagtctgaatgagtgtggatgtgggcatgagtgtgtgctgtgatgggacagcatcctggccagggtcgggtcccacttggctcctgagctgctaggacaggctccagccacccaagatcctgcactagaataaataagtaaataatta

SEQ ID NO: 515700 - DNA, 286 bp, Homo sapiens
ggggggggaaccctttttcccccgggacccggtttgaaatggtttgggttttttaaggcccccctttgggggatttggcccccggggcccaaaattgggggggggggcccccttccccccaagggggttttcccccctcccccctttcaaaaccgggtttttttggtttgggagggggggggttttttttttggggggtttccttttttttttttaaggggaaattttttttttttcgggtttttagggggggaaaaaaaaaacccccccacccaaccccatttga

SEQ ID NO: 515701 - DNA, 739 bp, Homo sapiens
  misc_feature (374)..(374): n is a, c, g, or t
ttgaagtgcggggtctgtgctctgcgagcgactatggacagaaaagatgctcgtactgaaaagcggcacgtattagcacaacggctggatcactcaggtactggaccgctagttcctgtgccatgaagatcctgtaccatagacacttgcttttaaagctacgtgctgccaaaacaaagctgagccaggcacaatctgcctaaggaacaattcgacgcagaatacatgccaagcagtatataagttttccattaaaaaaattacaatttaaaaaaaaaaaaaaaaaaaaaaaaaaaaaaaaaaaaaaaaaaaaaaaaaaaaaaaaaaaaaaaaaaaaaaaaacaataatttaaaaaaaaattttaatattgtanatattttaattattttataattattaaatattctttttctaacctcgccgcccaaatttttttttttcggggccaatctcccgaaaggcctcaaattgggcgcccctatgccctgcgccccctatatggggtccttttcacaaacacggcccggtgggtaacacacacaactgggggaaaccctttgtttccccatttttggaaaagcccgctcccctcttttggagggggggaataaaaaatagtttccaaacgggtctttataaaaggggggcccccactgttgctttcataaaaggtgggcgccttttgtggaaaaaaatgggcgaatatttttaactgcactttttgtaacaaagggggcc

SEQ ID NO: 515702 - DNA, 986 bp, Homo sapiens
gcgcggagaaggggtgcgatgctggcgtgatggctggaggaggctgccatggacgacgaggaggagactgtacctggctctggaaaatccgacaagaccatcatgcagctgtgccacgaccgtggcatatctggtgaaccaggacagagcttgaccatcaccctggaggagtacaaagcccaaataggggacaagcctgagatgaggcggcggccgcggcgcacggaccgtcacacgatgactggtggccccacaaacgatgaccccaccgaacaggatgtagcgatgctctatcccaagaggagcaccaaggtggagcatcgaagaccatcaaggatgatacattgacagcagcatgcgaggaggagaacaatcaacacgggctctcactccgatggtgcagacagggccatcgaccacacctaccgacaacgccagccccatgagtcgcaacactggccaccacaaggtagcatccctaggaacgcaggacaccgtgaaggacaggacgcatgcctccagtcaaccagtacacagggaagaaagcagaaggcatagtaccagtgaagcaacgaaacaagtcaaagaaccagaggaaggaagagatgacaggaagacatggagggacgcccggacatcatcaagaggcgtgacggaagaaggaaaaccaaggcataggaccccaagggggactacacaagggccgagggtgagtgaacaccccattcgatgggcgggcggcaggcagcaaccagatctcggcgcgggcgacaaaacaggcaagctcagcgcggccacagagagttaggagcaagaacagggactccgcgagcgcccagcggaacccaacagcgttagaaacgaaaccggagggaggggagcagagagtgagaccatccaacacacctagaaccccgcgggctggggcaggcaaagagaaacggcacgaagaatgagcatagaagaccacagagcaccgcaaggac

SEQ ID NO: 515703 - DNA, 148 bp, Homo sapiens
cgagggtgggcagatagcttgcgcttctatcgtgagtgagatcgtagagatgagagttggatggaggtcgggcagatagatgtggcttcatcgtgagtgacatcgtgaatgtcatctaccggacgcggagtggatctataggtctaca

SEQ ID NO: 515704 - DNA, 221 bp, Homo sapiens
tacttccacaggactgcagttttcacggtgcatcagaattacctggagggctttttataacccagattcctgggtctctccctcagagtttctaactcaataggtctgggaatggggccaaagaatctgtatttctaataaatttctgggtgatactgatgttgctgatccagagaccacattgtgaggactgttgctatgaaggactgcatgggaataat

SEQ ID NO: 515705 - DNA, 364 bp, Homo sapiens
caagtcaatgtggcagctaatgaaccagtttgaacagaattccatatgaaagacggcacacctggatatagttgctgggccagcaggagatgatagtgagagtgtgtcacagagacatgctcaacatgatctctagttaggttcgcttcactatagaacgcactggtagtcgaaacttgtgacatcgagttgtagcgtgaatcatttaactgtaggaagctcttgccaatgtcaacaatgcgttggatgtacacggatcagtcgaggtagtggaactggttaagggcatataagtggatgtctctgtcaatctatctctctctctcgcaaactctctctcgctatctctcgctctgtatctgtc

SEQ ID NO: 515706 - DNA, 127 bp, Homo sapiens
  misc_feature (48)..(48): n is a, c, g, or t
ccaggtttttgttatcttgtcttttttatgttgtaattttaccttatnttgtatgattttggatttgtaaatgtgtatagagatccattcctgggcatcttggcaaaaccccatctctacaaaaaaa

SEQ ID NO: 515707 - DNA, 955 bp, Homo sapiens
  misc_feature (273)..(273): n is a, c, g, or t
gtagacaatgcggacgtcccgctacggcactggattgttcatcgtggcagtgactgaaaacgaaaattatctatgggtgtaaagtagatgacaagggcattcagcgactcttatatatacagcgtcgtcccattgcgcacagtgctgaacaaaggtccgagcatgcactacgtagtgggtccaaattggccatctggatcacattggagctgcgaagcagagcgtcgagcactccatggtattcaggtcctctgaggcctgccagccagtaangaacaaaaggcaatccatcatggaggagaggataccactgatgcgagtcattaggcagaatcccgagcaagtacatcccttgggaacataaaatgatctgtgtcggcaacttaagcaagagaggaagaaagggccagacttaatagcttatctccaaaataagctactaaatgacgtaataattggccactgccttatgtaattacaaaacagagaatgtctcatgactttttctatgtgtaccatcctttaatagatctcataccccagaaggtcagatcatgaatgactgacgcgagctaatttgttgggcagtctgatttagaactaagactggctgtggtgaacctgaatttgtgccgttttgaatttgaagtagtaactcccaattccgtaatggtatcactgttatcccttttagcgattgatcagacttcgttagtatgttcactttgacaacatgtggtgcatctaaaatactgcgcatggttgcttttcgcttcatttacgggcttggacttccccatcggggcactggtcctgtttaaccgaactgccgtgtgggccggcaagcctaggggggagaaaagagaacctttgtcggaaccactaaccccgtaaaggccctagacgggcgaacccccctctgtcacattccacttcgcagtctcatgcactcctc

SEQ ID NO: 515708 - DNA, 225 bp, Homo sapiens
agttttgccccttttgcaagtttggtgccagcttcctaccactcacaggcgcgctgcttcaaaacttttggggtttttgtaaaaaacttgaaatggcaaatcccaagataggtttcaataaccaggattattttttacgttaagttaaatgtatgtgatctgtaagttggatttttcatgatgaatttgaactaaggcaaaaataaaattcctttcctttaagga

SEQ ID NO: 515709 - DNA, 185 bp, Homo sapiens
atgcacgcgtatacgggtatgtgcgcgcggccccatcacgcctttctcggccctttagttcatagcagttcagctctgctctttagtctcttgatgtctcaatcttacatgtattccattgtgattggtatacatgtaagattgagacatcaagagactaaagtgttgagttgtactgtgaaaaa

SEQ ID NO: 515710 - DNA, 957 bp, Homo sapiens
ggaacctcctgccgggctcgtggcggctactgtccgctccgcggtggaaagcgctttccccacaggatatcaatgcaagcttgagtaggaaaagacacattcttcctccctaagccatggatatcaacggttatacgagaaatactacgttggggaaccagtgcttcaggagagcctagatgagctcatacagtctcaatcaagatcagcccccaatttgcccttcaagttctacttcagtttgataaggctataaatgcagcactggctcagagggtcaggaacagagtcaatttcaggggctctctaaatacgtacagattctgcgatcaatgtgtgggcctttgtgtactggaatgatgttgacttcagagaggtgacagaagcttattaacagtgggctccaagtgcaaatgtgtagcctgtgagtggtaaaaagtactggctccaatactacagaatgatactacaagaatgactagaaacaattatgacttttttacaccatcttctgtgattcatttgcttttgaagagaagcatagaagagacttttatttattctagaattgcagaaatgactacactgtgctataccagagaatccagtaggacacggaaactttgtaagttctgttagcctctttaaatcgacctttttattatacaggcatggaaaaaccataagttctttttaagggcccaaaggtggtgccttcctaaagaaaccctctttaattaacctcattttacaactcctgataaccaaaagatagctgtagcacgacagatacataaacacaaaagggggcgcgctataaaatcatggggggcacctccacccctgttgagagcgcccaatggtgataaaaagacgcggggacaaggtagacaacgagtgttgggcgtccttgtggggggaccccgcttgcgctaaatgtggggtccgcatgtcaac

SEQ ID NO: 515711 - DNA, 132 bp, Homo sapiens
gcaggctccatcgctaaacgatatttggaggtcagcacggctgctcacgtgtcgacggaacttgtacatgggaggcatgcacctgaagtggtagaatacacgtacgaccagtgctccagccttaactgatac

SEQ ID NO: 515712 - DNA, 117 bp, Homo sapiens
ttgttttagaagtttcaatagcacctagttttagaagattcaagtagcaactagtatatatatcaatatatttctcacaaaccattcagttacacattgtgtatgcttttagaattt

SEQ ID NO: 515713 - DNA, 821 bp, Homo sapiens
gatgctgcccgctgttgctgactggctcccccagcaagatccggggtgctgatccaggtgattctcgtggccgatgttctcaggaaaaagcacagagttgatgagacgcgtccagttcggctttccatgaattgcgtcatgtatcgaatgtgccttgtgctgaatcagagatatcgccataaagagcactcagctatcatgcacgcaagctgtatctgcgaaacaactagagcgggaggacactcgactggacggcgactgcctcgcgctgcccgtgctccagagaccggtgcgtcgcaggatggcctcgtgaggacgtgggtttgtcaatagggcgatcggactgacggcggcgagttcttgtcgcgcatgtatcattgcgatggaccgttcggtgcgagggccaggtggaccgaaccgggccggtgagatgagccttgtaacttgtgtggcgtggcaccttggcgatggggacctctcctatgtaggggagacgcccactttgggggggctccagtcgcctgaaatgcgtggggtgcccggcgttggctccggagaagcgggtggttgaggagcttggacctggcaggtggttgccctggtgaagtggcctttcctggtgaagccgggcgtataacgcaaaagagggctcgggcgagcaccgacgagaggaggtcggaaggtgattcgggggaccgcatgcacgatgtagcccagcgtccccgggttgtcgggggctcgagggtgaccttcaaggaaagggccttcacgggcccacggcctggccgagggcagaaactagccaacaagagaacactggc

SEQ ID NO: 515714 - DNA, 488 bp, Homo sapiens
aaaatttctcacgcatccagtgcatatattttctattccaaacagtaagtgtaattcatcaatttatgggtgggagaatggtttgataaagatggacagcgagtcactgagtcgcccgtgacgatgtggtctgtgcttctgtgtgtatgctgtgatgtattcattcatagcagccctcacatccagttcccatggggtgctgggttctcaggaaatgcatgtgaggatggaagacacgggactagaatgcacatgactttcaggggaaaattgttagttttacagtagatggagaaggaaatttgcttttcatttgacatcttacttttcttcttttcttttttaaactaaatcattataatcttattacaagggtaatatgtcttcaatttagataagttgaaaaaatatagaaagccccaaacttatacagaaatacaaatcttgattttattcttggtccctttatctgaaggttacgtaagtca

SEQ ID NO: 515715 - DNA, 926 bp, Homo sapiens
cagggaggtgcataaggaatattccggttttggtgtggcaactaagtcctagtgccccgtgcgatatagcacctgtgttgtgccttacctttcagtgtagtgattttggatttgtgatggattctggttgttccccaagaggattcgtgagagaatttttgatattgcagcaggttgtggaaagctttctgctacttcctagtttgtactgactactttcccttttttttggatggttagaatgtcaggaatatttcatatgacagcttctcgttgtcttttgactaggactgcagacgtttggtgatacaaatgtcaaatcaagaggtgtgattttccctggtaattgtggctgtctcacaatgtgatctgtcaaatccttgagcccatctgatataccatgaagagatttcggacattctattcttacactaaatggatcaactctaggatcttaggctatgttgaacttctgttgtgttttgaatctctccagagttgcatgtagatagcatgtatcttctgtgcccgttaagaccccatttagtaaataagactacaatagtaaaaatgtagaggtaaatagaaatgtattttttcactgaactattttgatacaaatttcatcatttaatgattcaccaatgttcttgcattgaatttgaatttaaagcatctaattcaaagagaggggagcatccaatgatttgatacatgtgggcttgtgagaactccatccatttatagagatagtcaaggtgtgggccacactaagtatatttttatcatggagaaaatttctactcctcaagccgctaatggtgaacagaattggagtattttgtttataatttcttgaacaggcaaatgtaagcttattatagaatgcattgtattttctttaattttccggacatcagcagcca

SEQ ID NO: 515716 - DNA, 117 bp, Homo sapiens
acctacgagcagctcgtggcgctggagaacaagttcaaggccacgcgctacctgtcggtgtgcgagcgcctcaacctggccgtgtcgctcagcctcaccgagacgcaggtgaagatc

SEQ ID NO: 515717 - DNA, 337 bp, Homo sapiens
acgaggacctgcgctcctggaccgccgcggacacagcggctcagatcacccagcgcaagtgggaggcggcccgtgaggcggagcagtgtagagcctacctgtagggcgagtgcgctgagtggctccgcagatacctggagaacggtaaggagacgctgcagcgcgcggaacacccaaagacacacgtgacccaccatcccgtctctgaccatgaggccaccctgaggtgctgtgccctgcgcttctaccctacggagatcacactgacctggcagcgggatggcgagaaccaaactcaggacaccgagcttgtggagaccaggccagcaggagatgg

SEQ ID NO: 515718 - DNA, 125 bp, Homo sapiens
ctcttagaggatccccccggaagattcggacctctgtatgtctcatggaggaatttaattctgaccagaactcatctctcctgtcagaggaacaatcaagaaacaatgcaactttggtctcgaca

SEQ ID NO: 515719 - DNA, 661 bp, Homo sapiens
ccacgcgtcgctgagcccttccactccaagtccagcagctcccggttcctggaagtatgatgacgcgggagaggtgaccagagcgctgtcctcaccttcctctctcaccgcgcggttttgttccctctacaagctggcctgactcaggcatgcctgctcacggaactgcagtgtgactggagtgtgtgtctgaggggagcgtttgcagagggcactggagccctgcacagcccttctcttctccgctctgggagagtggacccttccagaaggggcaggccggccttcgcccggtgctcctccttcctcgtgtttttatggatctgcaccagactgttaacttgtggggagatggcgaagttgacttatttaaaaactacaaacagcaagttgtgttctagaactttgaacactaaatggaagaaaatccattagcagaccgaagtctcttcagtgaaccctccgaaactctgggaccagtttcctctgggggctccatacagagacccaggcagaacttctgccctattttttttcttttttcttgtggatgtattaaatatgttctgggggtgtgaagtgactttattacatcccaatagaaataaagaagaagatcatctcgactactctccgagcactgactgacagacaggaaggg

SEQ ID NO: 515720 - DNA, 436 bp, Homo sapiens
cccccgtagtgggtccctgcagacaaaggagttattattagagccctacttctcatgtgatctactcgaaacagaataaagactagtgatgcgacacgcaataacaatttgtctcattgtacagatacctctatgccatatcctgcctgaggcctcttttatctcatttaattctcacaataaccctaagacgttgctctcatctacccctatttcccccagaaatggattggaatctcttcagagaggtgcggcgtgcctttggttcttccgttgcatgctcattccagaagcccacccagggcctatggagttgccagcaggatgctggctcaagcccttgtgccaagtccccctcctgagaatgtcctaaagggatccttccattcaggacatcataagggtcataacagattctgtctacaaagactgacac

SEQ ID NO: 515721 - DNA, 151 bp, Homo sapiens
  misc_feature (31)..(31): n is a, c, g, or t
  misc_feature (33)..(33): n is a, c, g, or t
ctagaggatcgctgatcgaggtttctcatgngntcaggctggtctcaaactcccgactcaggtgatctgccacctcggctcccaaagtgctggtgttaaggtgcgagccgagaacccagccagtgggttactttttctgtagaaacagttg

SEQ ID NO: 515722 - DNA, 1292 bp, Homo sapiens
tattaccaaacccaacattttattgaaaacaaaaggacccatttggcttaaaggcccgatttcaattcatcaacatttcaacctgacggattggggaacaccgcgggcggttggccagccctgaagtttgccctcccagggcacggaaccagcttctggcaagtgaacggggctgtcaaacctccagggccttggccgtgggactcctcgaggctcacggacactggtgtagacaacggtgccgtgtgggtgtgaaaaatacaatatcgcgcacgaacccccccagcgcattggtgcttgcaaaaccacccctcgcgtcgggccacaatgagaaggtccgcgttagaaccttgtcgcgcctatcccattacgcttgtcggatctatacagtggttgtgtgcccgcgctcacatcctcgtggtgctcagaccacggggtgcgaccatgtggagctccacataacctccgtgcgcgccagcacagtctctaccaggtgcgtctcgcggttacccacgaggctgcgcggcccacgaatcgtgccttctttcgctcccccgaggcgccccatttgcgtcttctcaatacctcctcacaatctgatctgttcacccactttctctcacacaagccccctacatcatctttgcactcacgcgcttacacacccaatattatgaggcctattactcagaaattgatttcactccaacacaacctcccgtcttacagccctctacataaattctaccaaagaccccccactaaagcattcttcctcattcacaccacaaagaattctcccaggacgttcaccttgtttattccataccagtcggtcgtacaaacactcattgtctacatccgacaaacactggcgtctcgtcaagttggatgcgttacttgctagaacacacaacatctttctcggaccaacgctgtgaatactcatgcatggtcgctggatcgactccacagatccatatactcgtgccaaacgcagaataaacccccccgcgatctaacaaactccgctaggggaccaaaaatcctagccaaacaatgatcagatcgggcggggggtcattccacacgtacagtcagaagttagtagtggagtgccattcgaatcgcaactctagggcaagaccgtccgggtactatcattgcacactgacgtcttggcgacaccctattaataatagataccacgcacgacggcgccactatttcttaataatatcgccggcaactgacaacacccaaccccctttacttatccaagccaacctctc

SEQ ID NO: 515723 - DNA, 1752 bp, Homo sapiens
  misc_feature (165)..(165): n is a, c, g, or t
  misc_feature (461)..(461): n is a, c, g, or t
tatactggcatcagaactgactttcatggcctttccacgtagatagaaatttatgagagacaatatttcaaatagactttttccacaaatagtactaatccaactaaataccgagaaaaatctaaactactgtattaccacacaaaccatatactaactaaacanattgcatcgtaatctcccttataaccatattcgtgcaataactatagataatactgagtagcactcaccctttatagtcgtcgtgaacgaaggcctccaagaaagacttacaacaacactctctcgtatatacctagcatatgtaagactttactctactatgaactctagtcgaggtaaaaagaaacttgagcctcgggtcttaagtggataaagacgaaaggttaacgctcgagtgtaccactacttactatataagtgatacaattattgaagcagaaacccatacaacgctnttaataccttgaaaggtcacatgtgaggtgagaatgacaagcgaaagcgctttaagtgctccaaaaggaagaacaccgaacattcttttaatgttaccaaacatatagcacctaacttttcgccccgaggggcctgaaactctcccttcgtaaaaagattcaccagcaccatagatatcccaaggattatctttaaaaacaacttcgataaaaaaggacacccactaacatacgaaaaggggattatacaacgacaatgcaacttgcgatgacagggaacgagatttggacgaacaccaaaaaacacgtgttggcaatctgccatgcatggaaggctccaaaatacgaggatgttggagtaagaagcccataattgacatataaaagagaacccacacattacacaaatagagaaaatatccttctggagctcagcaaaaaggacacatatggacccggtccacggaaagcccaatgcacaaattgggtacgctatcatattcgacaatggatagggggaaacgtaccccaaagaagggatttctgtagacccttaggaacccttccacatagcaacataaagttgcaaggtatagggcgctccaaagccgttatacccacctgtcatgagagcaaggaaaggaagatgaagaatcgaagaaaaaaataaagaggtagataggaggcggaaacaaccaaaagaaggaacaaaaaacagagagaaaacagaaacagaagtatacaccaacaccaccatagagactaccatgacaggacgaaagaaaaacaaagacgacccgaagaggtcgaaccagccaccacgacaaaaagacaacacaaaataataggaagcgccccacgagatagtataaacgaccaaaagaaaggaagcgagagaaaagaaagagagcaagaggataataaaacagaagagggagaacagggaataaagcgggagaaaataatgaagcaggagtacagagtagtaataggaaagaaaaagtatacgatgatgtgaataatgaatagtagaggaagaagaaacaagaggccaagagtaaagcactaggagagacaagcattagttcattgacatgcgttcgcgcggaggaagagatacaagtgtagtaatcaacggagcaagaagagaacgagggagtaagtacagaagtagagggaagggatgagtagaagagatagcgaagggtggggaaggagaaaagaaaagcagaaagaagaagaaagcagcaatggagcagagagaggaataggaaagagaaaaaaaaggaag

SEQ ID NO: 515724 - DNA, 408 bp, Homo sapiens
ccacagaggtgtagtcctagtgtcccaagagctgctactctttggtctagcagttcactatgcaaggggtcttagacaggtcctgtggtcatatttatcgctgagctaagcttctatcttgtccagccagctatagtcaggctcggtaggtgtgtcgcctttgccgatatatcttgtcgcaattgtgccacacaggctggtgagctctgcgaggcagttatatctagtcaattggttatgctggcgctatgtctgtgagtccgtgctatgtagtgcttgcttatccttcagggtcgctggcttgcagggtctatacctattgcgtcaggtttcggttccagtcgcctatacgttacttgggtacatggagagcctaaggtttgttcgtagtaagcgtgtgtgggtttg

SEQ ID NO: 515725 - DNA, 108 bp, Homo sapiens
gtattgagtcagctccccccaagatgagctgcagcccccagagagagctctgaactgtcaccaagtaaccaggccccacgtctccaggccccccacatccgcccagcc

SEQ ID NO: 515726 - DNA, 524 bp, Homo sapiens
gcgcaatgtgtgtttcccactctttaaatgtgtctgaactcgtgctctctttctcttgtgttatatagagactctagtgtccatgtatgtgtgtctcacctattgtgtgactcgcgtgtcttgtgtgatacacttatacacatgctctctcaaccactataagagatctcttcgcttccactgtcgcaccagacgctctcgtcgtgtatcacatgtctgtgtagagcgcaaatatgaaacgtctaagtgtgttataggtttctccacgagtccaagaggctgtttaaatagtgatactcttacagacttgtgtatgcgcccatataatagagtgtaattgtgaatctcaaattttctctgtggttcgcgatatgctctctctctttcttgcgcctctcgagtttctcttctaagagagatactcgacacgctgtcatatactattactacagatgtcatactcacgaggcccctgctcgcacacattgctctgcgtgaaattttcgtacagcgcggggtatcca

SEQ ID NO: 515727 - DNA, 357 bp, Homo sapiens
gggcaagtgggagggtggttctgattcagtaggtctggggtagggcacagggacctgaaaatttagaaataggcaattagctgggcgtagtggctcatgcatagtaatcccagcactttgggaggccgaggcgggcggatcacttgaggtcaggagtttgaaaccagactggccaacatggtgaaaccccgtctccactaaaaacacaaaaattagctgcgtgtggtggcgtgtgcctgtaatcctggctactcaggaggcttaggcaagagaattgtttgaacctggggggcggaggttgcagtaagctgagatcatgccattgcactctagcctgggcgacagagactctgtctc

SEQ ID NO: 515728 - DNA, 335 bp, Homo sapiens
  misc_feature (184)..(184): n is a, c, g, or t
  misc_feature (227)..(228): n is a, c, g, or t
  misc_feature (273)..(273): n is a, c, g, or t
ctgttttgtcagaaaataggattgcaacccctgcttttttctgctttccatttgcttggtaaattttcctccatccctttattctgagcctttgtatgtctttgcatgttagatgggtctcttgaatacaacagcatactgatgggtcgtgattctttatccagcttgccgttctgtgtttttnaattggggcatttagcccacttacatttaaggttaatattttnnatgtgtgaatttgatcctatcatcattatgctagctggtttattnttgcaagacttgttgagggtaactgcttcatagtgttactggtaaaaagaaaaaccagtgtg

SEQ ID NO: 515729 - DNA, 1452 bp, Homo sapiens
  misc_feature (1297)..(1297): n is a, c, g, or t
acaccccccctacagcgacacagccgcgacgtagtcacacacaacgatgctccaagatgtcttctacttgtgggactacaacaactagcggtcggtatttatgacacacaactgctgtggttgtctcgttgactacaatacctcgcttcttgtattaatgatggagatatcctctcggggctagtcatctatcatcgacgagcgatttttgctgggcaacgatagatacactgtggcaaaacaccaactgtttgtgcaccaccttgtggggcgtcattaaaccaggtttgagagaacgtcttttgtcagcagcggcgttggcaaaataaacagacgcggggtgtctgccacgcgtgcgtttaacggccccagtttcgggcttttttttggcgaagtgaggacactgtgtggagagagagggctccacgctgttgagtggataaaaacatggtggcacggagaggcccccagcgttgtaaatagggggagacacctcccccccgcggaaaagagaaaaggggtttctacccgggggaagagagaatgccaggaaggcccccaggggctgtgcctgcgtaaagggaagggagggaaaaagggccggggcttgcccccagggcttcccttgagggagggagaattggagaggaaaatgtgggagcaagggcgcctggggctttcctggagcccccccaaggccccaaagggagcacccctttcggcgtgccacccctgggccctccaggagttaaccctctctgttgtttggggaatgaaatattttataggcgctcacaagtgaacttccccatagaggggagcaccacctctcttctggtgggccacactgccactaatattttctcggggaagacacactctttgataaaaggagtcgcggtgggtgtcccctcgtgggtgaactccaggaggtatatcgctttgtcccctcgagagagaacttcacacttcacgagcctcttcacttgaggctcgcacattctgcatgcacacctgggaaaagtgttccacgcggaacttggagacaaaagcttgagaggagaagaaatagcgctcttgccacagtggtcaaacctctttttggagaaccacaccacatgagcacggcgccacatttctcggaagttcttgggttctttccgagggccacggaggcttgcctcttccgcctgagagttccagagttggcacaggtggactaacgaggtcaaaacaacactggcggaaaactggagtcctggcacgcgaggaggagcccacgaacgctggtttcganagtaacttttcctgggaagggggccttccacgcaatgtgggcaaagccttcaaattacgggcaagatcttcaagtgaacattttttgccatcacctagctgcctgcacctgccctttcagggagatgggggtcattacagggaactgaacattga

SEQ ID NO: 515730 - DNA, 155 bp, Homo sapiens
tttttttttgcatcttaactgtttaatctcagtttaatctgaccgggtgggaaacaaaaaatcctgtcgtaccaagtcacatgttgaaggtgctgcacaagtgcccaaaagtagctctcagaggcaatgctatcctcttttctcaaaaagctcct

SEQ ID NO: 515731 - DNA, 163 bp, Homo sapiens
acgctgcacctgcgttcaaattgctttgtactccatctgccgttgcagaactgccccaccctgctgcaagaatacgtgcgttgagctggggctttgcgaattgttgccggcggggtcatcatcgcaatccgtaagtcttcaagacagacaaccgcatgtgtct

SEQ ID NO: 515732 - DNA, 401 bp, Homo sapiens
agtgatatttctgtgaccttccaccaaaaccatttgcaattggttttggtggtaagagtcacagaatataatcagaggaacaacccacttctccaccctcggataattttggctccagtggggaaggaagcttttcaggaaggaaaaaattaggaagttcactatatggcacaggtcggaagagaaacgtggtgttaatgaagacactgtgtatagccttacctcagatgaccagatagttattttaggaggacggggaatatgaatatgcccgggtaagaggagctcagtcctcttctgtagataacatctaaaatcaagcagtcaaaaggcagttctaatatggtattttggagatgtgtgagatacagaggtaaagaccaagcaggttggcttgaaga

SEQ ID NO: 515733 - DNA, 430 bp, Homo sapiens
tggaaagaaaggaggcagacagattagctagcaagactgcctttcttttgtttatgtaggtcacataatttagtagctaagcttgatttttgaaaggagacatttctttaaagtgctcaataatttgtttaaagttctagggaaacgacagtgttatttatcctgttaactgaatggcaaaataaagcagtgtacttgctgtttatcctttcaaagacttagattactattagctttcttgatttattaaaagaaataagtattgagcacctactgcatcttacacctaggagaagaaaagtcttgtgaataaactcacatgctacaagaagtgtggtaggtgccctgttgaaagaacaggtctcacaggggagaacaatagaggagatactttgttgtgatcttggtaaataactgtgacctgaggggg

SEQ ID NO: 515734 - DNA, 138 bp, Homo sapiens
cgggggaatggcatgaatccgggaggcggagtttgcagtgagccgagatcgcaccagtgcactccagcctgggcgacggagcaagactccgtctcagaaaaaattaaaaaagacgtagattgtactgaaaataaccat

SEQ ID NO: 515735 - DNA, 173 bp, Homo sapiens
atccttattgcatatagactagctacttcataaactgccaccaagaaaagaaaaatcgctgatccctgatataaccattctagtgtctaaatgcaatcagtctacatgcaatcagtctaaatgcaatcagtctcacatgcacatcagtctacaatgcaatctgggtacctgag

SEQ ID NO: 515736 - DNA, 1005 bp, Homo sapiens
  misc_feature (69)..(69): n is a, c, g, or t
  misc_feature (202)..(202): n is a, c, g, or t
  misc_feature (474)..(474): n is a, c, g, or t
  misc_feature (479)..(479): n is a, c, g, or t
  misc_feature (483)..(483): n is a, c, g, or t
  misc_feature (511)..(511): n is a, c, g, or t
  misc_feature (540)..(540): n is a, c, g, or t
  misc_feature (574)..(574): n is a, c, g, or t
  misc_feature (588)..(588): n is a, c, g, or t
  misc_feature (597)..(597): n is a, c, g, or t
  misc_feature (604)..(604): n is a, c, g, or t
  misc_feature (619)..(619): n is a, c, g, or t
  misc_feature (679)..(680): n is a, c, g, or t
  misc_feature (892)..(892): n is a, c, g, or t
  misc_feature (896)..(896): n is a, c, g, or t
  misc_feature (898)..(899): n is a, c, g, or t
  misc_feature (902)..(902): n is a, c, g, or t
  misc_feature (993)..(993): n is a, c, g, or t
ggggtggggactgcatatatagatccgggagcagggagcgggctaagagtagaagggtgtcgcggctcnagagcgagagtcacgtcccggcgctaccaagcccgacccaggcccaccgtggtgcacgcaaaccacttcctggccatgcgctccctcctgcttctcagcgccttctgcctcctggaggcggccctggccgcgngggtgaagaaacctgcagccgcagcagctcctggcactgcggagaagttgagccccaaggcggccacgcttgccgagcgcaggccggcctggccttcagcttgtaccaggccatggccaaggaccaggcagtggagaacatcctggtgtcacccgtggtggtggcctcgtcgctggggctcgtgtcgctgggcggtaaggcgaccacggcgtcgcaggccaaggcagtgctgagcgccgagcagctgcgcgacgaggaggtgcacgccggcntgggngagntgctgcgctcactcagcaactccacggngcgcaacgtgacctggaagctgggcagcngactgtacggacccagctcagtgagcttcgctgnatgacttcgtgcgnagtagcaangcagcantacaactgcgagcantccaagatcaacttccgcgacaagcgcagccgctggcagtccatcaacgagtgggccgcnnagaccaccgacggcaagctgcccgaggtcaccaaggacgtggagcgcacggacggcgccctgttagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacganaatntnnatntttaaatcgtggagatgcccctggcccacaagctctccagcctcatcatcctcatgccccatcacgtggagcctctcgagcgccttgaaanctgctaaccaaa

SEQ ID NO: 515737 - DNA, 320 bp, Homo sapiens
  misc_feature (2)..(3): n is a, c, g, or t
  misc_feature (12)..(12): n is a, c, g, or t
  misc_feature (53)..(53): n is a, c, g, or t
  misc_feature (59)..(59): n is a, c, g, or t
  misc_feature (79)..(79): n is a, c, g, or t
  misc_feature (91)..(91): n is a, c, g, or t
  misc_feature (97)..(97): n is a, c, g, or t
  misc_feature (117)..(117): n is a, c, g, or t
  misc_feature (126)..(126): n is a, c, g, or t
  misc_feature (135)..(135): n is a, c, g, or t
  misc_feature (146)..(146): n is a, c, g, or t
  misc_feature (158)..(158): n is a, c, g, or t
  misc_feature (167)..(167): n is a, c, g, or t
  misc_feature (173)..(173): n is a, c, g, or t
  misc_feature (184)..(184): n is a, c, g, or t
  misc_feature (195)..(195): n is a, c, g, or t
  misc_feature (198)..(198): n is a, c, g, or t
  misc_feature (212)..(212): n is a, c, g, or t
  misc_feature (216)..(216): n is a, c, g, or t
  misc_feature (224)..(224): n is a, c, g, or t
  misc_feature (230)..(230): n is a, c, g, or t
  misc_feature (238)..(238): n is a, c, g, or t
  misc_feature (247)..(247): n is a, c, g, or t
  misc_feature (252)..(252): n is a, c, g, or t
  misc_feature (274)..(274): n is a, c, g, or t
  misc_feature (278)..(278): n is a, c, g, or t
  misc_feature (282)..(282): n is a, c, g, or t
  misc_feature (315)..(315): n is a, c, g, or t
cnntattaggcntgtatattttaaatgctaacattgatgaatgtaagtttccncattgntgctgtttctgcatttaaanataattgggaanaactgncattctctagtcgactgccngggccttanacccacatntccatttttgntcaggtatagcnttttatagnaagggntgcatctagcntcttttattanaantgtgtgtgctaaantccntattaatntgtaancagtttanattgttttntatantgaaggtgtattttcagtgctncccnctanctgattttaactttaggaataaaattagttttnaaagc

SEQ ID NO: 515738 - DNA, 111 bp, Homo sapiens
ggttgtggtttcgctgagatcgatcggtcgagcccgggagacctctcgttcctcccttcctgcgcgtcactaccttacgactgaccgacggactttggctacccttaccga

SEQ ID NO: 515739 - DNA, 133 bp, Homo sapiens
  misc_feature (38)..(38): n is a, c, g, or t
gacacaatcatgtattaacatcctatcacttataccantatcggcagaatcaagtcacaggtcctgtcagcactcgaggggaaggtatcacacaacaggcatgaacaccaggagtcaggatcatgacggccac

SEQ ID NO: 515740 - DNA, 102 bp, Homo sapiens
gtcagatttttgactcagggggaggatgcgcgcattcagtattggagagaagggggacgcttgcccaagacattagtgtaccctgtggattgtcaccattca

SEQ ID NO: 515741 - DNA, 1139 bp, Homo sapiens
tggggggtgacagattttttttataaactttgggaagtttccctcccccaatcttcttaagaaagcgaggggggcgagggtgggaggagacaggtgaggggagaagcgtgcccggggcaagacacccgaggcacggaggcgcgtgcactgggggggcgccggtgtccgggagccttcaggtaaggcgtgggcaaagtggctcctgcggaagccctccagggggcgtatagcaggaaccgggctgggcttctccaattgggtgacgtgagtgaaaaaaggtgaccagcgggggggtatcagctcgggggacaaggggcctcagcccacagtgtggacctcggggcgtgacaacaggccaccccccagggtggggggtgcccgacaagggaagtggaggcagactcctgtagaaccggggtggccagccacagggggaactgggaaaacaggggtacctggaggggttacagcccggagaactgggggctgagagctcagccgtttgggcatcactatctcaagccagtcctccaaatgggccctcggaggagctcaggagacatctagatagccacactcccgggactcgcctactccatacctacaccgggatgctcaagatccggaaggtactcgctctgacatgggggaaacactgaagatgggagacaaaagacgccacaggagccttgacagataaaaattcccggcaagtgcacaatgtgcacggctcatccacaaaagacgagaggctggaaattcggagaaaatggcggacacagacccttgggcctaaaagctatgacaccacggaaacagggcactaggaaagatgacagatagcccctcgaaatgaacgacgagaacatacaacgaagaactctggagccccggggatcccaaaaaaagagagtttggaccagggaacaccgaggaaggaacacagggaaccacacagagagacaaaaagaatacccagcgcacaaacaggaagaaacacacaaagggataaaaacaaaatataagaacaaaacagcaaagagggagtacaagaaaacagaaaaaaaacaagagaaaacaacccagacacgatcaacaaaaccaacacgtaaaaaagagaagaacacagaacatcccat

SEQ ID NO: 515742 - DNA, 158 bp, Homo sapiens
atcagctcggtaccactgatgcagagaactcaacaaaaaaagaaaattacagggataagctttttgatatgctgctgaattgtttgccagtgttttgttgaggatttttgcatcaatgttcatccaggatatccacctgtaattttctttttttgttg

SEQ ID NO: 515743 - DNA, 323 bp, Homo sapiens
  misc_feature (93)..(93): n is a, c, g, or t
ccccccccctttttcccctcccagaaaccaaagggaaggtttgggggttcccccttttgggggggaaccaattggggagaggggggttggagncccccccccccccccccctttcccccttaaggaggggggggtttttctttccccccccccttccgggggggggggggcaaggggtccctttaagaaccccccccttttgtttagacttggcctgggggtttgtttttccaagggggtttttgggccataaggggggggggggttgccccgggaaattgggttttttttttaggaaatttttttttttaattaattgccca

SEQ ID NO: 515744 - DNA, 472 bp, Homo sapiens
attgtggaacactggttcatcaactttcccgagtaggtccctaaagcttaaatctgccattctgaatgtacaaaacaacatatggctttgtacttacaagtcgcagttcccgcaaatactgggcatttcaaattattcccataatatcatggatgacagaatgtcttggggcagaaggaagttgatatttcagttcttttcttgctaacccttctattattgaaaggtcttcagtcacaagagcaagccactaatccttaaaattagccagagaaagcaggcacttaccaaaccatgaatcgtatgtttagagtatctcctgtcatcatccaaggatggaaaaattgaggaaatccgagggggcatcataggaataagagcttttaactagtgacattgtctcccacttaacgcagaagagcaggtttgtcccaggtctttgtaccacttttctcagcaggtcagcttctgt

SEQ ID NO: 515745 - DNA, 283 bp, Homo sapiens
ttgataaccaggctggagtgcagtcggtgcaatctaggctcactgcgacctctgcctcctggtgctgcagtgattctcctgcgttcaagtaattctcctgcctcgggcttctgagtacgttgggattacaggcatattgccaccacacttgtgctaattattttgtatttttatgtacgaaattggggtttcaccattgttgtgcgaggctgggtctcgagactcctagacctccacggatcctcctgtgctcgagtctcctaatggtggctgtggatttgca

SEQ ID NO: 515746 - DNA, 400 bp, Homo sapiens
  misc_feature (326)..(326): n is a, c, g, or t
gctcaccggctctatgaccctggaagaatggaaacttcgtaagagcagggacgtgagggtgaactgctcacccgggcaccgctggagaccggaacccagctccctccagggctccggaaaaggcggcctcagcagtgtgctggtgctgccctccagcggcgctgggtccccatggcacctggctttgtcctgctccccaggggccttttcagctcccgaccacctgtcaccagccgccagggcaagtctctatgtgactatagggtgaaggtggagggaccttgcctccgaggattcatcccaagcggattccgaggagtgagagnccagtacactggcacctggtgtttagatggccaatctcacagttaataaaagcaagtttggtatcaaaaaaaaa

SEQ ID NO: 515747 - DNA, 1478 bp, Homo sapiens
gccagaactccggacgtgtgcggcgcacgtgagtcgcaaccatgttcctggttcactcgttcttgaagtggcggtcggcggctggccggcggcgcgaggacggttggtcctggagtgcggggcctgctgaaatgtgcttggatggccgtgctcagcggggcctgtgggctggcaggcggtggcggcggtggctggcggcgcgctggtggccggcggcggtgtcggtgcgcgctgggcatgcggcagtccataggcggagtcattcatgtcgccagtcatacgatggctggatgtgcctgtaacacgctcggaagaccgtgcgcggccccccattgtacacatcatttatcttccatgctacttgaagggccaacgggacgagcgtcacggacgcgtccggagtaggtttccgcggacgaacctcgtattgcgccagactgtgcttggaacgcattgaggagtggaacgggtccaacgtcggccagcaattgagatcgtccacttgaaaggcagttcctgcgaaatttaacccgcggttcgcttgcacgagtcggtaacccaggcgccttgtactgcgttgcacagaaagcctggagtcgtgttcgtcgagaggcgactctcgagccaccgacttggtcggccgacgaccgattgtggtggcggcccagctgtactgggggactcataccggaacatagccaacaatggggcagaaggccttggaggggcttctcgcggaaggtgcacaatctccctagaagggttcagcttgttggttcgaggagaccagagcttagtctaggacagacggggttagcgcccgaggcggctcgaagtgatttatctgagaccatctcacgcttgttcgtaaaaacgcgtttggaccgccgttagtcaatgtggcaacccaatttatggcctaggctaaagcttggagaccttctcctaggggttgccccttttggaaagccggccacgcgacaagagggttgccccctatccctgtggacaatttgcaggcgaaattccttccttagttagagccaacttcgaagttcccacttcctccggaacctcgcccttaatgtgccatgccaacttgcagacacatggttggggtcgcacactcctatgttgcagtaagtgtcattcggaagcagagaccgtgtcgacgtcccaaaggacatgtcggcatttgcgggttcccaattccggcatttgtggtacccgcctcggactttggttttcccccgcctttggctcgtttttaccacacaatttcatctctttttggaccaagacgaagacaatgaggagcgttgggacccaatgagttggctaggggttcgaacaccacatcccgtatggaatagatcgtgtgtcttgacagagtgttgcaccacaaaatggttaagtccctccgttgcgaatacgcttgtggaaggcacacgcatataacccccagggcaccttataca

SEQ ID NO: 515748 - DNA, 620 bp, Homo sapiens
tgactgggagatactgggcacggatgggcagacagccttatgcaggtatcagaagttcacatatcaaatatatctgcccggcatgcgcctgtgaggcctgttgacatgtaaatatgaacgtgggctatgccttcatggtttgatattattgggctttcaccagattcataggcaggcatgcaatctgggattaaccaggcagccagcaaacatatcacagctttgatgcatgcagcagtgcagcaaggcataccttctaacagcaatatgtgggagggttctcagggaggagcttcctctcatatatgccttacaacagagaactggcagtgtcaatgactcagtctgctgacttcacttacgggctacctttccacaggttctatcgcggtggtcaagacgtaattcactcattcagttggcagggattggtaactttggtcccgtacgtttggtttcaacggggaacatagcccttgtaatcctcaatggacttaaacataagtacacacttcggcacgcacaggaacaaatagtcaccttcgcgacatgtagacagagagaaataagtgaatattaatttctcctcttctttttcattttttaaaaagaaaaaaaag

SEQ ID NO: 515749 - DNA, 317 bp, Homo sapiens
gacaatctgagtcagacaagcctcaaccttccccacactggtgatccttctctacacactgccagcttccaacacccacaacaaaccaccccacagccaaaaacaaaggacataatctcttgggagctctatgtccccacccatcagctgagaaacacaaatacttatccaggtgatcttagggcaagcttgtatacccctataatgctgcagcagatgctctactatgaaagctctaactcctggctagaagccaccaaactctagacatcatagcacctcataaaagaacaaacacagtactaagacaaaaagaa

SEQ ID NO: 515750 - DNA, 804 bp, Homo sapiens
ctaagtccctgcctctactctgaagcgtataataacctgtaaacattatacaaacccacaaaccttatagaaactcgtagtgtgttgtgactggaaattgattcattagaacccagtttctttaagaacttgtgagtggttatatgtttgtcctttcccaaagactgtcaacaatagttgccccaaaatgtcagcactgcacaccctccagggacttgtgaatacaatccttttttacttttgttttgttttttgttaagaaactggcgtctctctgtcacccaggctggagtcggcagtggcaacgatcatagctaactgcagttttgacctcctgggctcaagtgatcctcctgcctcagcctcctgagtagctaggactacaggtgtatgccaccatgcctggctaatacaaaaacaagttctttctacagagatgggatccctcccttttaaaatcacgaactgtgtcacatggtggtttgcttgtggcaaaacggagttcaaatttggctctcctatggctataattctgactagcaatctgttgaggtgaacatgggagatctagactctttcagacaatgcagcaaaatgacctagtaacctccaggggcaccacacctatttatggaaactttaaagttgcccactttgaactgcacgttagtttgattaacaccccatggtgcgggtcactcatagcacggcgatagcttctacggacactgaaaagtggacccaggcatttattgcgtctcccaaatggcttttcaacctgccctgaggttgtgaccatttcta

SEQ ID NO: 515751 - DNA, 107 bp, Homo sapiens
tgcaactgggcggtcatgaactgggcacctccggcctgtgaaaagttagggaagtgtctgacacctccagaatccattcccaagaagtgcctctggcgcggctagga

SEQ ID NO: 515752 - DNA, 155 bp, Homo sapiens
cacatatctacatagtcagattttatcccagctatgaaagcaaaagataattctactatcgtcagtcatcccattacagatcactacattatattcaatgtgtcatgtctccttaagatattctttgccatgatagttgctaagtctggcctttt

SEQ ID NO: 515753 - DNA, 141 bp, Homo sapiens
tggcaatccaaaaaattacccacttaaaaaaaggcaatttccctttttttttaaaaggggcccttcaggggccccccttttaaaaatttctttttcttaacccttaatttggatgtgcaaagatgattgctggtgtctcaa

SEQ ID NO: 515754 - DNA, 519 bp, Homo sapiens
cagttccatgttaaaaaaattaactaaatcgaataagaaaatagcaatgatcagtatcagctctttatggagaaagagcaggtgaaatattttctcagcactcttcctgcaaggcgaggtcgagagtcaccttgtgttgaaaatcttactagtataggactcaacgaaaatatattccccaaatgcccgtaagaattcctacttcaagcctcagacttcaaataattgccagaactacttgactgaggttagttatatgaccgtttctctttagggtttcatttctctagcgtaattcttgtttataatttggtgaaatactgagttgttctgttgacttttgcatgtgaagtaaagatcataattagctgtgttaacacagaaaggaaatgggaactttacattttttaattccctggagctctcattttcaagagatatccatttgctaactttattcaataaatgccgggtcgccaagcaatttctttctttatgtcctatattgtgattactcgt

SEQ ID NO: 515755 - DNA, 314 bp, Homo sapiens
gagtatcttcgcagacctggccttggcgaagtgcttaacgtagggaacgtggtcctcaatccacgctctagatctcttatcaaagtcatacgctttctcccgatttcaaaagatggcgaattgtatcatggccatgtaagagtagggtggccgctcagacacagagttctgccaggacgctgatggtctcgaaggctcctcaaccttaacctgtcgctgctccaggtgacaattctccttttcctccatctcttgctcgatgctgcgggagcccagtccatcagaactcatctttcgaagccactggatgttgg

SEQ ID NO: 515756 - DNA, 88 bp, Homo sapiens
agcgggtggactgtcgtgggccaggccgggggaggatggcgccctagaacccggccttgctggggtaggggcgggaggggacggggtg

SEQ ID NO: 515757 - DNA, 254 bp, Homo sapiens
  misc_feature (54)..(54): n is a, c, g, or t
  misc_feature (155)..(155): n is a, c, g, or t
ggggaccggccaccctctgtctcctcagtgcactcggagggagactgcaaccgncggacgccgttcaccaaccgcgtgtgggaggacaggcccttgttcgcaggttccacgcctagtgcttgcacgcgctgatcatgcgggtgcaggcgggtgtnatggttttcccacccccaccgggcctccccgcgggcagcgggccccttgttggcccccaccacgcctgggacgaggagcccaagccactgctctggtcg

SEQ ID NO: 515758 - DNA, 258 bp, Homo sapiens
tgtggaggcctggcagctcagtcatagtcagctcctcagctcacctgccagggcgtctgttccagacacttttgtttttgtttagaattaattgcgaaagagcagaattgggtggtgtcctccacactataagaaaatagcccttaaacagccacctttgtttcttgatttttcattttggctgtttagtttacctctggctgtctgcctggagccttcccagggccaggaatttgtacgtcctcccacgggatccgt

SEQ ID NO: 515759 - DNA, 540 bp, Homo sapiens
  misc_feature (12)..(12): n is a, c, g, or t
  misc_feature (37)..(37): n is a, c, g, or t
  misc_feature (64)..(64): n is a, c, g, or t
  misc_feature (71)..(71): n is a, c, g, or t
  misc_feature (99)..(99): n is a, c, g, or t
  misc_feature (111)..(111): n is a, c, g, or t
  misc_feature (116)..(116): n is a, c, g, or t
  misc_feature (121)..(121): n is a, c, g, or t
  misc_feature (135)..(135): n is a, c, g, or t
  misc_feature (155)..(155): n is a, c, g, or t
  misc_feature (158)..(158): n is a, c, g, or t
  misc_feature (168)..(168): n is a, c, g, or t
  misc_feature (207)..(207): n is a, c, g, or t
  misc_feature (210)..(210): n is a, c, g, or t
  misc_feature (231)..(231): n is a, c, g, or t
  misc_feature (239)..(239): n is a, c, g, or t
  misc_feature (251)..(251): n is a, c, g, or t
  misc_feature (278)..(278): n is a, c, g, or t
  misc_feature (282)..(282): n is a, c, g, or t
  misc_feature (294)..(294): n is a, c, g, or t
  misc_feature (299)..(299): n is a, c, g, or t
  misc_feature (301)..(301): n is a, c, g, or t
  misc_feature (357)..(357): n is a, c, g, or t
  misc_feature (360)..(360): n is a, c, g, or t
  misc_feature (372)..(372): n is a, c, g, or t
  misc_feature (392)..(392): n is a, c, g, or t
  misc_feature (407)..(407): n is a, c, g, or t
  misc_feature (419)..(419): n is a, c, g, or t
  misc_feature (427)..(427): n is a, c, g, or t
  misc_feature (430)..(430): n is a, c, g, or t
  misc_feature (432)..(432): n is a, c, g, or t
  misc_feature (445)..(445): n is a, c, g, or t
  misc_feature (453)..(453): n is a, c, g, or t
  misc_feature (466)..(466): n is a, c, g, or t
  misc_feature (470)..(470): n is a, c, g, or t
  misc_feature (512)..(512): n is a, c, g, or t
taggaggacaanacatttagttttatttcaatcaaancacacaacactttcttttccaactgcngcaaagngcatctacaaaatgccattacagatccncttttaaaaggnttccngtganattacagcaagccncttttttcaaacagaggaanaancccaaattcntccccaaaaaaaccccattccagtaaatgggaaaaacanatnaattacagtaagccagaaacntaaaaggncagccaagaagncttccaacagtttattagaaagaatgnaganatttaaaaaaanccccncnggcatgaacaaaaattgagggtttcagcccggggaaaagccgaatcaaaaaaaggnaanaaaaaatccaanagtgtattaaacatttttcncccatttgccaaacngacagtgcaaanacaaatcnggncnaaatgtacagacncccaagcnacaatgtacagcnttcntcgtcccccatgccaagagatgtaaaagcttaagggtcaaanaataccaattgtataggcttcaaaaacc

SEQ ID NO: 515760 - DNA, 253 bp, Homo sapiens
gttaagtactctgaggatctcctgtgggcccttaggagtgggactctgcctgaggctgacccagttttggggctgcaggttctgatgggagtgtctccaggaatgtcttcaggcccccagcggcagagcccagagaaggtctgagggcatgatgggcatcagtgggattttggttgtgccatggggtgggcagggccaccctgtgagcaaatggcggcaagggttgggggctattggcttgcaacaaagcccc

SEQ ID NO: 515761 - DNA, 259 bp, Homo sapiens
ggtaagcagacactttcttgtattaaaaagaaaaaagtgtaaaagttggccgggcgcgtggctcacgcctgtaatcccagcactctggagggccgaggtgggcggatcacgaggtcaggagatcaagaccatcctggctaacatggtgaaacccgtctctactaaaaatacaaaaaaaaattagccgggcgtggtggcgggcgcctgtagtcccagctactcgggaggctgaggcaggagaatggcgtaaacccaggag

SEQ ID NO: 515762 - DNA, 416 bp, Homo sapiens
  misc_feature (5)..(5): n is a, c, g, or t
  misc_feature (34)..(34): n is a, c, g, or t
  misc_feature (64)..(64): n is a, c, g, or t
  misc_feature (347)..(347): n is a, c, g, or t
  misc_feature (349)..(349): n is a, c, g, or t
tttantccattgtgccatttttaccccgcccgcntcggattaaagggaatccataccagtcccntaaccaggtaattaatatagaccctataaaccttaacaacccagtgatagaagtgatgaagagattaaattagtcataacttccaactggtttgggtgccaaaagaaaacacatgtttaatctgccctctttaaaaataaatttaggcccatgtacacacactggggcctgtcgtgaggtgtggagagaggggagggatagcattaggagatatacctaatgtaaatgatgagttaatgggtgcagcacaccaacatggcacacgtatacatatgtaacaaancnctgacgttgtgcacatgtaccctagaacttaaagtataataaaaaaattttaaaaacttaaaaaaaa

SEQ ID NO: 515763 - DNA, 875 bp, Homo sapiens
ggcagcaggtcccctatgccaccaagggcatccagtgggtaggatacgatgaccaggaaagcgtcaaaagcaaggctgcatgtatctgaaggacaggcagctggcgggcgccatggtatgggccctggacctggatgacttccagggctccttctgcggcctagggatctgcgcttccctctcaccaatgcccatcaaggatgcgcatcgcttggaacgtagcccttctgttctgcaactacatgcgagtgggggccaaggtagtgcctccgtcccgcctctggctccatgctggttcgggagtcctgatctacctgctcctgcttgatggtctgcaggctgtagtccctcattctccctcccttggggcctattgcgatgaggtccactataaaccactcagcatttagagctcagcccatgcgtcgaggccattgaggaggctacgcggataggaggctagtgggcgatcatgtgaggcatcgcaacatgtaggcattcgcggattagtacggcgacttgtaagatctaatgcgaaatgtttatcagatcccccaaagcctggccaagggcacatttctttcaactccctgtcccccagtgctccttatcaaatggacaccagttttggtatacgctcctatctactcaaggagcctaaaccagtccgtacatgactactagtgaccaatacgtaactgtatacccccctgcaaagccccagctgtgaacacccttcaacttaagaaacgtacatcgtgttcccctaatactaatttccccctttcctaaattcccccggctggtcaaataaaagttacaagaagctttagaaaggaaaaactccaaaaggggggggcggctaagggaacccg

SEQ ID NO: 515764 - DNA, 1137 bp, Homo sapiens
  misc_feature (149)..(149): n is a, c, g, or t
  misc_feature (248)..(248): n is a, c, g, or t
ggacattctcgagccatatcccatggcgtatctaatctagaatgtgaatcttgtcgggtttgcgacccgtatggtgatctcaagttcatccaggccgcagttcttgaatcgtccactgctgttgtacgctatctgcaggagagcacttntcagctgcaacttgagtgctcgccatgccatgttaccatcacggatctatctttgttgttgtccacttgacttcgtataatttcactcactgtgctggnaatgaattgttaatgccattgtattctcctgtgcacgtcagtaagaattgagacctcttgtcaagactatgcgacgtacattaggtttaggtgcaagcttgtgcttatcgtgttattcttgcgctcgcttatcgaacgccacacctgggtacgccatggctgaacgttgcgaatggaccgttgtcatttgaatcatcccatgacattgcccagtattgtccagtcagcacgacttgtcatcgatcaggaccgattgttagcataaggttagccttattcggagctctagtcctccgtattagtggaagtttcaggtctccttgtcatgtcgatcatcttcgtatctatcacaagtctagtacttgagtcgagggtagttctcgaatttgcttccaagtgttattctatatctatacctatatggtgtctaaggttttaaagaagagagtctcttctaaagcgttgatgaaccaagatgggggcggggttggctccctccattagttgctagtttaacaggcattgcgtttcccaaagggtggcacagggccaacaaagggtgactttaagggagggttgggaccaggaagtagggggttaaaaggacaagggatcattcgggtatcttccgtgtgctgtagattaaattagttatctatccagtttgggttgtatgtacacgggttgcgttccgttggagtttggaaaaggtaatacagagcgtatagaagaccaaattggtgggaacagacaccccataagggaagtggggggtgtgggggaaaaaataggacggtttcaggtgggcacatggtcctggggtcaaagtaaggggaaagttttaccatgttgttggaaaggttatatgtgggaatttgtgggggacaaa

SEQ ID NO: 515765 - DNA, 222 bp, Homo sapiens
gtcgtctctacacggatccccgtatacttgtggaaatagatagtgagaattttgcttgtccgtggctaaatgctctttctgaagtaactccatgattgtcctgtttctcgatctagcaaatgtattctgaatacctctcgacttgcagtacattagctcgtgttggaatcctaacatcaactggctttcataaatgtcttaaaacggtcttaccaactcata

SEQ ID NO: 515766 - DNA, 276 bp, Homo sapiens
tgttcttcgaacatactaatgatcatctaaggtcctacacttgtggcctgctagtcaaattgctggtggagggtcttgcctcgatgttgatggctgctgattgatcagaggagtggatgctgaaggctagggggctgtggcaatttcttaaaataagacaacaatgaagtttgctgcatcaattgactcttcctttcatgaaagatttctctgtagtgtgtgatgctgtttgatagcattttaccccatagtagaacttctttcaaaatttgagtc

SEQ ID NO: 515767 - DNA, 179 bp, Homo sapiens
gcctcatggtagtgtagagactgctctatgttaacaatcagtaacagaaaaatgtcaagaatttgtcccattagtatttgggtcagaacagtcacaactgcacaaaatatggtttattaattggagtcagtatctctggtttggagttttctattaaacagcatggcaaatgttttcaa

SEQ ID NO: 515768 - DNA, 280 bp, Homo sapiens
gctgtgaaccgctccaaatactcttaactgcaccttgtgaatagtagttagaggtcttcatacagttcagcctctagaatggtaacaaatcacgccaatgggattcgaaacaaagaagactatgtaaaactacacccatcacactttgagactactcactggtaggaagaatatagtattgcagcaaatcctgtatgacagagagatgtgggcttccttataagagtctagtgtaaggtgctgagaccttttacatgggcttatacagggagagagtctt

SEQ ID NO: 515769 - DNA, 189 bp, Homo sapiens
agaccgcgttctggcatcggtgcccatcttgcggatcgcttcggccgggggcatcccggcgtcggcgaacaactgggccaacttgtcgcgggtgaagggggtcttgagatattcgaccacctccacctcgacaccgggcgtttcctcaaggattgccagcgtcttgcgcgacgtgccgcatttgggatt

SEQ ID NO: 515770 - DNA, 795 bp, Homo sapiens
ttttaaaaacttacgttaccgggtcttaatatgctgccgtggttgtcccttgcttaactcttcttactttagaatatgtttctttgagatcccctccaaggactgtgaggaaaggctgtggtaccatgaccttgttggaatccaggcccgcgccctgtactacacggcctggttacagagttacttaccggtgaactgaatgggtacccaggcttcacccaagaggtacttttttgttgttgttgtttgttttaggaaatataattgtagccccatttttagaggcacttccccccaccctgtccccacacacaccccaaccacaaatgtggtggtgttgcccttccaaaaacgacgaaagcttttgtgtcacttaccactgaccacgaagaacctttttaaaaacaataactgtccacctacattctaatttgcactttaaggagaactgttcaatctaatgctagattgtcacttttccctccttctcccaccacgaagtttactggtagtccactgtcactggctcgtaactaatccctctaaccactaccactggaaatgcacggcacccccaatgtgaaaacggaggcaccttgctgggcaatcacctgacccccgctcaatgttttacaaccactagttgagtaatcagcatatctaggattatcttgccttgcctaaatcatatgtatatagtggatgttatatatatacctggccggtctgttttaatttaattgataaagatcccaatactttgtttggctggcatatattaaattattatatgga

SEQ ID NO: 515771 - DNA, 1212 bp, Homo sapiens
tctctccctgtaatagttgtgtgcaccaccgttagggggagtttatagtgccgggttggtagacagactcccggagggccagactaagtgtttccaaccgcctgccgctggcggtataccgcacagtgaagttcagttcggccgtgatattcctcccccccccgcgggcgggttcacaagaagaatgattgttgtagggccgtgatgccttctgtgtgcccacacaacacgttgtcccaccccgggggagcgcccgagttagtgggagaaagtggaagtcgctggccatgcaccacaatggcctttcttggtagcccccttcaaggggaaggtttgcaatggcctgtgttcctggtgttgtgcgcccccgttagtgcgtggggcccctcgtagccttgcgacactttggtgatattgacgccgcaaagcgtccacgtggcaccttatgggagcccgttcgggtagcgtaggcacgccgcagcgacacgtgatgcttaacgccttggttaggcctgcgacacttgtccccacctgaaatggtgcctcagtgccactataggagagactcgtaatgtgtggcgcactccactataggagaggctttcacattgcacctgggtgtgtgcgcgcctcatgtgtctccacaggcgtaacacacccttaggagccacaaaacctcatacgtctccacagattccgcacttgtgcacacgtattcacatagttgcacatcgcggcgctataaatttctataaactcttgtctgtgcccgacacacacacacactcttttctccgcgccctaattccgcgagaatggccccgcacacgcttatactccgcgaactataccccgcagaggcactagcacccaccactggagaacactgtcctgatgtcacttctcgtgaagggtccacttcacttgttcttctagaccacgcacggtgagatagttaataaatagttgtgcactggagagtttgaggagagcctcttcgctttcgagaagccagaaaagtgtcctctatagtagagagaaccctccacttaacctcggaggtggaactatatggatgccccccacccctaccaccaccactttcgagagaaacccgtatacacttaaattctaagaccaaaaaaggaaaggaaatcgaaacccccccaagctggtttcaaacccaccccctggcctccatgactttttcca

SEQ ID NO: 515772 - DNA, 132 bp, Homo sapiens
cctagagatccctatgtctcgatcgtatatattgaagccaagcaactgtaagatactagtatgcagctagggggcctgtagttttagggcagcaagtcaatttttctttttaagggattctctaaacctggc

SEQ ID NO: 515773 - DNA, 225 bp, Homo sapiens
tggtctttttttaaaacctaagttttataaataatgtctgatacctctgtgtatataaaaattaaactccaacagccacaaagaggtgtccgtaagtttacaaaaaagggatttttttccttttttttcctttttttttataaccaagccaagaaaggaccattttgaccattattgaatgtgaacagagggaaagaaaggtataattagaaactttgctagttt

SEQ ID NO: 515774 - DNA, 429 bp, Homo sapiens
tttttagcatagggagcagatatgcaacttgtacgggcgagagaacacccgacgcaatgttttcattaggtaccaaacacatatttttatggcaataaagaggccaacatttgatagttaggaaacacatttctagcctctaaaagaaatacagaaggtcgagcaactctagcccagcatttcctcatcaacagaaactgtaacacagtctcttagattaagcatgtattctacagtctgacacaatccccaccactccatattatcctatactcaagtaacacactttacattatccagccttgaattggcatctctgcattatagtcttcaaagatcagcagcaaatctgtctggcctagaaatgtatttcctctttcaccaatttgatcataatgctgacttgttgagatggcggcttttctctta

SEQ ID NO: 515775 - DNA, 195 bp, Homo sapiens
gacagaagcaccgggccataaagtccaccatttctaatatgttgatcgtagaagtagtattagattatagcaccatagtccgtgagctcatggactatggagtatatattcgtaatgaagaacttctatgaccaggatagtggggaggaagagttcactcagaggtgcgttgctgatcgggggatcctctacagt

SEQ ID NO: 515776 - DNA, 223 bp, Homo sapiens
atcgagctggtacccagcaggctgggcccagattaagatgtcaggtgatagttggagaacacttgggctaagcacccaggagactggctgtgcagcaagggcccagagcttctctgagaaattgggctgcctcctgaggaacacaaggaagaaccacaaggaattgctcagggcctccctggaggaagccccttcatttccttggacactgtagggccactac

SEQ ID NO: 515777 - DNA, 437 bp, Homo sapiens
atcccaacgaggaactggtgctaataagccaacacttttgtgactgttggattaggtcaagtatcggagggccttgatccgatgtacggactcagtcccgtgggtccagttctggatttcgtaattgtgccactaggtattcgcagtctaagcccggttccacgccagcgagccgggcttctgacccatcctatggtgtgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagagtttcctctggcttcgccc

SEQ ID NO: 515778 - DNA, 389 bp, Homo sapiens
aactagatcctcctactaatgtatacatacttgtaccatttgccacatgtactgacttattaattacactactctaaaaacacttaagttcacttagttgatcagggcatatacagaagggtttgtctcgactccatgtatcattttacaactttctgccctggttaaatttttctcccccaaagtaatcactgtgttggtgtgtctgatggaaatttcgaggtggacccacaaaaatattctatgtagtgtgccttcaaagagaaccatttatttctcttcacttatcgtcccacaaagtcacatttggtggtggtcagccaagtcgcatctggtctagttttactcttctcgataagggccaataacaaaaatgttggaaagtcgag

SEQ ID NO: 515779 - DNA, 692 bp, Homo sapiens
gttggtgcagtgggatggctgctgctcttcttcaggctgtcagtagattcagatctgctccatgcatcttcccatcccagtcatacagccaggaacagcaggtgtgagattcaaacttaggtcttcttcactgaaatttccattctattcagttcctcttttattatgttttgagaagatgtgtgctgagctatgagttgggggcttccttccaagacttgagaagtcttctggcctgtgtggcctgaggcaagtctccagtaacacagaattgaggcaagggaatggttagctaccaggagaccttggttcttagatgggaggacacagctgattaagtcactggcttaagatgagtcgtatatgtgaagcaggactgatggcagctaccctgccacccgctcagagattcagaggggccgtggagagagaatatacgtaaaaattctttgtaaactgtttaacatcattcaaatagatgacaatgttgttggttctctttagaaggaaatgggaacaaacctaactgccattttccctcaacagaggttctgcctgaaaaggcaatcctgtcccctaaaatgtttgttttgagggttctaggacacggcaaagaatatcacgcctataaccttttttgtagtagagagtacaacagagaatttcagactcacttttagaaaactcagggc

SEQ ID NO: 515780 - DNA, 872 bp, Homo sapiens
gagcggggtggtggctgagtgcggttccggaggttctagtgtcggagttgggtgcagagcaggtgccatggtgcccgcttgaggcacactgagggtgacgcggtggctgggccatggcctggcgctcgggcctgcgccgccgcatgcctcgtgcggggtcctacgtgcactcttcagtgcaagcagccgactcagtgagctggtggcttgggtgagctgctggaggagttctcccggactcagtacctgggccaaggatggcagccgggaccggctggctctacacggttgagcgcattgagacagagatagtcttggagctgttttggccgagactacttgtttcagcgtgattccaaaacacagacatggggatatctcgttgtgcactatccccggcaacatacggtgttcctggagtattgagagtactgacgaagggatgaaaagaacagtttgaagaagtacgcgtaacaggtgagcaagttgcgaagaactccattcacggagacaagatgggccaggtggcagaaggaagggttgtacttgaccagtaaatctgttacaggggcaaggcacattttgcagggtcggcacaggttggtgggatgggggaagacggtgaacttggacgcctcaagggtacagaactaatttaatgattcagggagggttgcaagaatggatggcctgtggccgaattgtgggaagggacggttaagaggatgaaaggacttgtgggctacttacgaaagatgggtggacaaagcaattataagaagaataaaggtaagaagggttaatggacattaaagattggttcgataacttgtcagacaataagtatgtgacctggatggggaaacaaagag

SEQ ID NO: 515781 - DNA, 2250 bp, Homo sapiens
  misc_feature (412)..(412): n is a, c, g, or t
  misc_feature (995)..(995): n is a, c, g, or t
aaacagtaatggcggaggctgcaatctccctggaacaacagccacaacatcaggagcaggagcgggcagcggagacgtgcgtgcatgcatgtctcccctcatcccctgatccccacatgtcatcctgcctcctgttcccctgtgtggtggccgtggctgtgatgtgtgtgtgctgtgctgtgcatgctgatctgtgtcacgccgtgctgggcgagccttgggcacgtacacacccacgtgctcgacccgttgacaagcgctactctctctacttgccacttgcgcgcggctactctggctagacgcgcaccacgcgcaagcacccagaaccttgctatcgtgacctaacccatcatgccccatgttgcaacgcccatttcgattctattgatagcctactgcataccactgnactaaccttaacgcgctcggcatcacgccttggctagcgcgacaaccgctcactactctgtccaaaggcccgtcagcgcagcgtctatacactgtgcataacattctcgttaacgtatggcgccatcggcaacccacctgtgtctctttggccctcaccggcaactttacctttgcataccccaacttaacgcgccgaatcacaaccgcccaacttcttgtcatattactcaacggcgctaacaccgtacaccgtccgataaccatatgactttaaacctacggctaacctgtcctataacgagccctttaaaccgcacgacagatcgcgtttccaactatctccctcccgtttttctgcgccctatttcggcgctttttatcccctgttaccgacaaactgcgtatacctcacctttttccatatttcccgggacacttaacgcgctttcatggcgggaaagcacgcctaaaccagtaatctaggcttctgcttgtgccaccatactcacctttctgtgcacgcacatttttaaaccccgcaacggggtggaccactgcgtaaatcgaagtggctccctctnatggtgcaaactggctcttttaccctgacaagtgctacatcaatcaacttttttgcccacacagaacgccccttatttcctgtgtgatccacaaagaaccaccctcttgtgactataacagccggtgaaactcgctcccaaggagcgcgcacttcttcccgtcgtctgccaatcggtgcgtgtgcaaccctcctttggtgggtcgtgcggccctttgtcgtaccaccatcgatattgtgcccgcctcttacacgctttctcgtggtggtcagccggtcttatccgtagcgcgcgggcttctcattccccccctttttttttgttggtgtgttcgtctaataatgcgtcccctcccgattttaaactcctttatgggtattttggctcgtgccgccccccgtggtctgtcaatccccagctttgggcgctgctgtgccctccacattttttatctcccactgcattttgggactccagcacgtgtttttgtgtattactaggtggtcagccagcaagtgcgccctccccactcttatttgttgcagccctaatgtcgtgcgggtgcctcgccgttattccgtaaggcagctgttgggacacaccctcccacatcaggtgtgcggggcacgtacaactgcagcaaaacaactactttttcccgtaagtgctaaataggtcgaccaacaactaagctacctggtagacaacgtggcccgaattagctagataatcctcctcgcgtgtggtccctcgccgctgtgtgttgtttgtgtgcgttagccacgcttcgtactcctgcagacaccatacacgggttgaaaatacataagggtcgcctacctaatgaggcgtctcgattattgtgcacttatgtgtggccccctcgcatttctcccctttaaaacctggttgttgtcgccgtttgtggcgccagcaactaactcctaggacgtagccgcgtcacaaactgcagtaacaagctgggctatgttgtcccccccgcctcgagtggcatacgtatataccactccgctcggtcagtcgatgtcaactgtgcagcttaacatactacctccgctgtttggtggcatgtagtgactctcggtgcactcattcacttctcgctgctttccccgcccaatcaaccgtgcgtcgtgcctagcctgccaacaatatttatttccccactatgtcgttgggctactctgctcgcacaccccaggctttttgtggcttttcggtttcgttgcgctgc

SEQ ID NO: 515782 - DNA, 284 bp, Homo sapiens
  misc_feature (72)..(72): n is a, c, g, or t
  misc_feature (146)..(146): n is a, c, g, or t
  misc_feature (215)..(215): n is a, c, g, or t
aggaggacagagtccctgggcatccaccttcctgcccaggggacgtggcgctgtcggtgtttggagctgctncccctgctttggcgccatggccctcagcgtctcccatgctgggctcactacatggccagcccttgctctcctgncggtaggcttggcgcctaggttgtgttgagagggggatccctggcctgcctcactgtgacctgctcctnccacgtgcagcacctgtcaccttttctagaaataaaatcaccctgactgtggggtgcatcggtctccgg

SEQ ID NO: 515783 - DNA, 141 bp, Homo sapiens
tcaccgagtgagaacttggatatgccattgagcttttctgcagtttccattctctcgtctcataaaatagcaaattttcagcacaacatttgctccacctcacctcaccacagctcattgtgcagcaaatccaatgcagca

SEQ ID NO: 515784 - DNA, 533 bp, Homo sapiens
acggcaggttgtactccacaggcaggttagtactccaccggacaggttgtactccaccggcaggttagtactccaccggcagattgtactccaccggcagtttgtactaccaccggcagattgtactccagcggcaggttgtactccagcggcaggttgtactccaccggaaggttgtactccaccgggaggttagtactccaccggcaggttgtactctcctgggccttgtactaagtgcggcaaagaaggccactggaacgggggcaatgtctccacccatgagttgccgaaaagcccttgcatagtctgccagaagatgggccctgaaaattctgattgtcctctcaacagatgggcagcacagcatgctcctcaagagccaccatcccttcaaaaagacaaaaagtgaagaatcacttgcactcccatagctcattggcctagccattgaagcctgatgaggccaggacccctgggcccgggttcccggcccccattgccatcattggttcggagcccagggaaactct

SEQ ID NO: 515785 - DNA, 1347 bp, Homo sapiens
ggacggaggcgggtacaagagtagaacaaggaggttgccagggctcgatgacccatcaataccctcgtctcacggacaacaggccgaaagggacttccgcctagacgtcgaccagatcatggtcgcctcgtagtacagcataggttctgacccaaggaggatcgctgcaagcccggtagacggatggagagcttgagtctcactcagagaagcaaccgcaataattcgcaccgggaactatacaggctagagttggtaccaggaagacatcgcccattccgatggtgtgctgagggctaggtaacgaagagacgctgtgccacgtggtactgattcgctgcctcagaacccggattgtgggtgtattgtgcttgactcaaatggcgcacgcgtcgtcctagctgggggttgtggaggcccccatagaaggttatcggaacccgggctgctcctgtcaggtcgttactatgcagaccctttttcgatccagtagtgcatttctagttagggaaagcgcatgtaattgcccgaaacggctcagacttactgcgactttgcggactataccacgaggtgacctcgtaagggaatttagtgacaagcccgcattagtcctattgccccttggagggagtcagccccgctagatacctcgcaccactagagcctagggatagaaacggtacctgggtgtagggagagggtgcgatgtatggggaatgaaaagggcgaattgaagtaaagacggtaaagtaggcatagtcgtgagaaggattaaaagccttttagggataaaagttaacaaagtggtccttagtgctcaatattaacaggaagatagccatttctcgggatgggggggcgactgaagaaattccattgaagaaaatcctaataaatcgttgggagccatagctggggcttacccatccaaggagaaagcttcatccatatgtggcgtagtcccccctgtgtaaccccttgggtgcttttctttgggaacgcacaggctgcgcacaatgaaccgattcaattcgaacacaatgatagatccttcagataggtacaagctgcaggagggagacctaggctaggtcgtatcctatggcgcacgaggactccgaggtccttccaacttggtgtggccttctaaggttatacagcttccaaggttaaccaccggcctctgagagtttgttcaataccccccacatggaagtgaaattttgccccgagagtaccaaacgctagagagtaaaggagcactgagtttgtacaaggccgatagaaccctcgaaggggccaattactttggacacgaaagtcctcacaaggtgttttggccgg

SEQ ID NO: 515786 - DNA, 238 bp, Homo sapiens
aacacccaaccgcaaggctcaggaccaggacttttactgggccccatctacaagacactgactcttctggaacactttcaaccacagggcactctaccaactatgtcattctttggaaatcccccaccaatcgcccccggcgacactgattaaagcgtggtgtggccctcatctgtgccctggactactagactcagacagaagggctggggccattaaagctgaattttctaagcaa

SEQ ID NO: 515787 - DNA, 791 bp, Homo sapiens
cataaaatggaaatgccttccaaatcctcattaagttagaaggcttttactgacatttagaaagcaagtttatggtcagagcaaataaaaacagtgcagatgtcttcataaggctgattccagaagatcagctgtttgtaaaggtaagtgattgcatctattacatatggattacccattctttcccaaattttttccccaaagagatgaatttttaccaaagattatagttatgtgtgtgtggttttcctttttttttttttccaaaggaaagcagtggtcttcatgcttaaaagtcagggctggtttatacttggcaagaaacaaaaagcatattttttggttggtggcttccccaaaagacattccttttagaaggcctgggaactatgtctatcatatcactctttaaaaaaaaacaagaagaatatatcttattgggaaagagactggatataatcaactcatggttactttactgatgctgagtctttaaatgtgtactggtcaattgtattagccatagggactttctgaattccggtaggcactaggtggggtcactacgccggggggtgcggttccatgggcagactgagcctctatggtctaactgttttccctctcgactcagatttaatggttacttatatttcggggggttctctggaccggttgtacttgcgttgggggctctaaggtccaggtccccttgggggggttccggggtgcgtaacgggtatgtaacacgtttcttctgaaaaaatgcggcctcgcgggttttttcttcg

SEQ ID NO: 515788 - DNA, 854 bp, Homo sapiens
  misc_feature (540)..(540): n is a, c, g, or t
tcaccaggcctggctaactttgtatttttgtagagatagggtttcgccacatggccaggcgtggtctcgaacacctgacctcagataatccacctgcctcagactcccaaagtgctgggattacaacatgagccactgcgcctggccttaagtgtttttttttggttggttggttggtgggtgttggaaacagcgtctcactctgtcacccaggctggagtgcagcagtggcgcgatctgggctcattgcaacctccgcctcccaggttcaagcgattcttctgcctcaacctcccgagtagctgggactacaggcatccaccaccagcccggctaatttttggtatttttttggcagagacggggtttctccatgttagccaggatggtctcgatctcctgatctgtgtgatccagcctcctcagcctcccaaagtggcgggaattataggcttgagccatgtgcctggcttaagtttaatttttaaaaattcccagtaacacgggggagtaattaagcctggatgtgttgcaatattngttcattttgccttagctttaagttgcaggactatgtgctctatcttataaagttctgatatttcactctatttcaataggttcgccaataggaatagaatctttggtaagttcataacatatcagccgaatgagccagaattacacatttctttggttaacttgaacaaataggggagcgcctccacttgggcccctcccgggccggaaggaggttcaccatacggggcgcacctctccagatggcccgggggggaggtcacacgatgcaggggtgaataacgggggaaaggcctcgcagcaccccgttggcg

SEQ ID NO: 515789 - DNA, 141 bp, Homo sapiens
tctttttgttgactttgttgaatttcaggtgcctgttggtgtgcatccttgtctctgcgttctttggtcgttgtctttgttgtgttgtctgcacgtggatctttggttgtctgggtagcattgattgaactgcatctgatt

SEQ ID NO: 515790 - DNA, 398 bp, Homo sapiens
gacactagcaggatccctctaatatagcaacaatctattttgacgaactctggaatataataattcattagtatacttgctttcattcatacattcatccatccttccatccatccatccttccatctatccatccatgcatacacccttccattctattgcttcttctgaccaacattataatgattagttgtgtgctgtgctgtgtgcaaatacaaagatggttattaaattttgactttgtcctcgaggacctccacaatctattaggatatactcttccgtcatgtcaataaatgttttgcacagagtaaatgatttcaaaggtgaatcttaaggaggagtaaacatcagtcatgtgaaaccattctgcagaggggatgtgggttactttgacg

SEQ ID NO: 515791 - DNA, 519 bp, Homo sapiens
tggtccctggtgatagcacaagagtgaacgtcgtctcacagtacaagtcggggcgtgatggctcacactggtaatcccagcacttgggcaggccagacggttggatcaggaggtcaggagttcaaaaccagccgggcctaagatggtgaaacccggtctctactaaaaatacaaatataagtggggcttggtggcatgcacctgtaatctcacctactcagaggtctggatgcaggagatatggctggaaacccaggagggagagtgttccttggagccgagattggaccatggcactctaagcctggggcgacagagcaagaactcaatctcgaaaagaaagagagagaaaggaaatcccccgagggaatgtcacctgggctggatttctataaaaaggtcacggaaggcaagcagaggctatgtggaggcatcccccaagctcatggaagctatttgggccgggggcgtcggaaataaataattccagagtcacccttttgatgaccttagcagtgc

SEQ ID NO: 515792 - DNA, 137 bp, Homo sapiens
tgaagaggtggagtctcccagctgtcagatgggtcgaaatccatgtatcaggagcctagaccctccagagccaggtgctacacgatgagcgaagtcattgagcacatcacccaaagcagtggccatcatcgcggacc

SEQ ID NO: 515793 - DNA, 2749 bp, Homo sapiens
acgcgcgccctgcggagcccgcccaactccggcgagccgggcctgcgcctactcctcctcctcctctcccggcggcggctgcggcggaggcgccgactcggccttgcgcccgccctcaggcccgcgcgggcggcgcagcgaggccccgggcggcgggtggtggctgccaggcggctcggccgcgggcgctgcccggccccggcgagcggagggcggagcgcggcgccggagccgagggcgcgccgcggagggggtgctgggccgcgctgtgcccggccgggcggcggctgcaagaggaggccggaggcgagcgcggggccggcggtgggcgcgcagggcggctcgcagctcgcagccggggccgggccaggcgttcaggcaggtgatcggtgtggcggcggcggcggcggcggccccagactccctccggagttcttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccggctgcggcgcgcactccctgtttctcctcctcctggctggcgctgcctgcctctccgcactcactgctcgccgggcgccgtccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacggatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcagggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgttttttttttttttttttttttttacaccataaagtgattattaagcttccttttactctttggctagctttttttttttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttgatccaaaattaaaaaaaaaaataccaccaacaaaaaaa

SEQ ID NO: 515794 - DNA, 2807 bp, Homo sapiens
acgcgcgccctgcggagcccgcccaactccggcgagccgggcctgcgcctactcctcctcctcctctcccggcggcggctgcggcggaggcgccgactcggccttgcgcccgccctcaggcccgcgcgggcggcgcagcgaggccccgggcggcgggtggtggctgccaggcggctcggccgcgggcgctgcccggccccggcgagcggagggcggagcgcggcgccggagccgagggcgcgccgcggagggggtgctgggccgcgctgtgcccggccgggcggcggctgcaagaggaggccggaggcgagcgcggggccggcggtgggcgcgcagggcggctcgcagctcgcagccggggccgggccaggcgttcaggcaggtgatcggtgtggcggcggcggcggcggcggccccagactccctccggagttcttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccggctgcggcgcgcactccctgtttctcctcctcctggctggcgctgcctgcctctccgcactcactgctcgccgggcgccgtccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaaagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcagggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgttttttttttttttttttttttttacaccataaagtgattattaagcttccttttactctttggctagctttttttttttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttgatccaaaattaaaaaaaaaaataccaccaacaaaaaaa

SEQ ID NO: 515795 - DNA, 312 bp, Homo sapiens
tacgggctatgccttcaccaccgacaaatccgctatccctcaggagaacgggatgacagcttcattcgtttttcgagttgccccatatgtcatccagaaagctgttcaggattgaaggcgtctggtttttcatagtcttgtgtgttcacagacctctagggctcaggatgagaaatacttccgtgtccttggggatggtgtaccctcagaagctggtgtgttgggtgacaatgtggggcacacccatggggagaaggtcagcaaatctctgaatttcacggatgactgcctctgtgtatggcattttggctc

SEQ ID NO: 515796 - DNA, 2784 bp, Homo sapiens
acgcgcgccctgcggagcccgcccaactccggcgagccgggcctgcgcctactcctcctcctcctctcccggcggcggctgcggcggaggcgccgactcggccttgcgcccgccctcaggcccgcgcgggcggcgcagcgaggccccgggcggcgggtggtggctgccaggcggctcggccgcgggcgctgcccggccccggcgagcggagggcggagcgcggcgccggagccgagggcgcgccgcggagggggtgctgggccgcgctgtgcccggccgggcggcggctgcaagaggaggccggaggcgagcgcggggccggcggtgggcgcgcagggcggctcgcagctcgcagccggggccgggccaggcgttcaggcaggtgatcggtgtggcggcggcggcggcggcggccccagactccctccggagttcttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccggctgcggcgcgcactccctgtttctcctcctcctggctggcgctgcctgcctctccgcactcactgctcgccgggcgccgtccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaaagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcagggcccgcaggaagcaggaatgtcttggaaaccgccacgcgaactttagaaaccacacctcctcgctgtagtatttaagcccatacagaaaccttcctgagagccttaagtggttttttttttttttgttttttttttttttttttttttttacaccataaagtgattattaagcttccttttactctttggctagctttttttttttttttttttttttttttttttaattatctcttggatgacatttacaccgataacacacaggctgctgtaactgtcaggacagtgcgacggtatttttcctagcaagatgcaaactaatgagatgtattaaaataaacatggtatacctacctatgcatcatttcctaaatgtttctggctttgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttgatccaaaattaaaaaaaaaaataccaccaacaaaaaaa

SEQ ID NO: 515797 - DNA, 2753 bp, Homo sapiens
acgcgcgccctgcggagcccgcccaactccggcgagccgggcctgcgcctactcctcctcctcctctcccggcggcggctgcggcggaggcgccgactcggccttgcgcccgccctcaggcccgcgcgggcggcgcagcgaggccccgggcggcgggtggtggctgccaggcggctcggccgcgggcgctgcccggccccggcgagcggagggcggagcgcggcgccggagccgagggcgcgccgcggagggggtgctgggccgcgctgtgcccggccgggcggcggctgcaagaggaggccggaggcgagcgcggggccggcggtgggcgcgcagggcggctcgcagctcgcagccggggccgggccaggcgttcaggcaggtgatcggtgtggcggcggcggcggcggcggccccagactccctccggagttcttcttggggctgatgtccgcaaatatgcagaattaccggccgggtcgctcctgaagccagcgcggggagcgagcgcggcggcggccagcaccgggaacgcaccgaggaagaagcccagcccccgccctccgccccttccgtccccaccccctacccggcggcccaggaggctccccggctgcggcgcgcactccctgtttctcctcctcctggctggcgctgcctgcctctccgcactcactgctcgccgggcgccgtccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgatgaggaccttggcttgcctgctgctcctcggctgcggatacctcgcccatgttctggccgaggaagccgagatcccccgcgaggtgatcgagaggctggcccgcagtcagatccacagcatccgggacctccagcgactcctggagatagactccgtagggagtgaggattctttggacaccagcctgagagctcacggggtccatgccactaagcatgtgcccgagaagcggcccctgcccattcggaggaagagaagcatcgaggaagctgtccccgctgtctgcaagaccaggacggtcatttacgagattcctcggagtcaggtcgaccccacgtccgccaacttcctgatctggcccccgtgcgtggaggtgaaacgctgcaccggctgctgcaacacgagcagtgtcaagtgccagccctcccgcgtccaccaccgcagcgtcaaggtggccaaggtggaatacgtcaggaagaagccaaaattaaaagaagtccaggtgaggttagaggagcatttggagtgcgcctgcgcgaccacaagcctgaatccggattatcgggaagaggacacgggaaggcctagggagtcaggtaaaaaacggaaaagaaaaaggttaaaacccacctaaagatgtgaggtgaggatgagccgcagccctttcctgggacatggatgtacatggcgtgttacattcctgaacctactatgtacggtgctttattgccagtgtgcggtctttgttctcctccgtgaaaaactgtgtccgagaacactcgggagaacaaagagacagtgcacatttgtttaatgtgacatcaaagcaagtattgtagcactcggtgaagcagtaagaagcttccttgtcaaaaagagagagagagagagagagagagaaaacaaaaccacaaatgacaaaaacaaaacggactcacaaaaatatctaaactcgatgagatggagggtcgccccgtgggatggaagtgcagaggtctcagcagactggatttctgtccgggtggtcacaggtgcttttttgccgaggatgcagagcctgctttgggaacgactccagaggggtgctggtgggctctgcagggcccgcaggaagcaggaatgtcttggaaaccgccacgcgaactttagaaaccacacctcctcgctgtagtatttaagcccatacagaaaccttcctgagagccttaagtggtttttttttttgtttttgttttgttttttttttttttgttttttttttttttttttttttttacaccataaagtgattattaagcttccttttactctttggctagctttttttttttttttttttttttttttttttaattatctcttggatgacatttacaccgataacacacaggctgctgtaactgtcaggacagtgcgacggtatttttcctagcaagatgcaaactaatgagatgtattgtgtttctcccttaccctgctttatttgttaatttaagccattttgaaagaactatgcgtcaaccaatcgtacgccgtccctgcggcacctgccccagagcccgtttgtggctgagtgacaacttgttccccgcagtgcacacctagaatgctgtgttcccacgcggcacgtgagatgcattgccgcttctgtctgtgttgttggtgtgccctggtgccgtggtggcggtcactccctctgctgccagtgtttggacagaacccaaattctttatttttggtaagatattgtgctttacctgtattaacagaaatgtgtgtgtgtggtttgtttttttgtaaaggtgaagtttgtatgtttacctaatattacctgttttgtatacctgagagcctgctatgttctttttttgttgatccaaaattaaaaaaaaaaataccaccaacaaaaaaa

SEQ ID NO: 515798 - DNA, 581 bp, Homo sapiens
gtataatggccagcagatgaatccggcttccctcgtgctagtgccctccaggtgtggggtggcggcggcgtgcctccgttttctacgttcagttcagccctcacttggtggcatgacactgtttgaatgcaacttcgctttcagattgaacttgtcaaggaagtaaacgagggctgatttcagcaaatgctaaagtgtaaatttcaaatatgcaaatagggtactgcagttggttatgcaatattatatcaccaacccagtatcacaaaaactcatagaagatatcatgtaggccctgagctattaggggggttcccaaacatggtatgcagaaatgtgatggttacaggtcagtacaacctcagtccttagaacccttccacacttcagctctgaacccactattcctgtcatatatttatataaggactgaagtaattaaaagtatcgagagccttacgaagctaaatttatatactaacttagtacctttattctaaaattaccaaagatattacacaaaggtccattatgtactctgtaatatgctatatctgatgaagccaaatatcctctaattg

SEQ ID NO: 515799 - DNA, 431 bp, Homo sapiens
  misc_feature (144)..(144): n is a, c, g, or t
ataaaaaaaagggggggggggggggttctttttaccaacccccccccggaaagggggttttttcccgggtccctccccaaaaaaaaaaaaaaaaaaaaacttttggattttgggggggggccccttttaggggggggggaaatnaaaaaaaggggtccccccatttttataaagggggggggggggccggccgggttttttttaaaaaaaaacgggttttttaggggcggaccccctggggcccatttaaaccccccgcccccaaagccggggtgtgttttcccggtttttttaaaacttaaaggtttcccccccccctggttttttttttttgggggggcccctttggttaaaaccggggttttttttttttttggggaaaaaaggtttttgggttttcccaaaaatttttttccccgataacccgggga

SEQ ID NO: 515800 - DNA, 485 bp, Homo sapiens
tccggcggctgagtgccaacgaagtaaggagcgctcccttctgcatggggacttcacagcgttttccgttgggcctggctcttctcctatatccgcccctggggccagaattagcgttttctggtagtgcttaactttggggatgtgggcctctcggctggaatgcaggcctccgacctgccttccagggccagccttccaaccaagggtgacctcctgttcagcacccagccaggccgttaggaggggtcccctttttagttggaacgccttaaactggagcctcccgaaggggtgttggtccgctttccctacgcgggctgattttagcctgaaatgggacccctacccttttcctttccttcccagggcctttgggttttgatttttttttttttttaaaaccaaccaaccaactgtttccgattttgagttaaccccccaatagggtgttttttgccttcaaataaaagtcccccctgcca

SEQ ID NO: 515801 - DNA, 223 bp, Homo sapiens
caccagaaaagctgaagtccaatttaaggaaaaaaaaaaatacaagttatgaggggagaaatcttcagtgaaatagatagcatacataaaacaatcataactttaggaaataaagaacacagagaaaaacacactgaaaagcctcaacaatagaattgaacaagcagaagaaataacttcagagcttgaagacaagattttgacttagccaaatccaacaaag

SEQ ID NO: 515802 - DNA, 362 bp, Homo sapiens
  misc_feature (362)..(362): n is a, c, g, or t
ggcacgagagcaaacccactctacattactatcagacaaccttagacaaaccatatacccaaataaagtgtaggcgatagaaattgagacctgtggcactagatataggaccgcaagggaaagatgattataaccaagcataatatagcaaggactaacccctataccttctggataatggattaactagaaataactttgcaaggagaggcaaagctatagacaccccgaaaccagacgagctacctaagagacagcttaaagagcgacacccgtctatgtagcagctggttgtgcaagatagaatcttagttcaactttaaatttggccacagaaccctctaaatcccttggtttctggn

SEQ ID NO: 515803 - DNA, 234 bp, Homo sapiens
gctgtcgtcgataagcagaatctctattttgttcagaatccacccactcccccgtagctgtgtacctggccaggccctcaggtacatttccgatgaccggtgatttccccaggatgagcccaggacacaaagatagccaataagacgtggtagggggagacagaagcaagggttggaacgtcctcactcctaagaggaagccacagaagggactctcccacacttcccaggagg

SEQ ID NO: 515804 - DNA, 137 bp, Homo sapiens
aaggtcccgaatagtgatatagaggcaggagatcgcttgaacctgggaggtagaggctgcagtgagccgagattgcgcctactgcacttccagcctgtgctgacaaagtgatgactccatctcaataaaaagaaaca

SEQ ID NO: 515805 - DNA, 351 bp, Homo sapiens
ctgttgcgctctgaatcgtcggcctcagcgccaatccgcgctggagcgcgacgccggcctggattggaagagcggccggtcgaactcttcgcacaggagcggttcatcggcgcggggacctatgacgtcacccgggtcgaaccgaagaccatcgagaacaatcgcgtgaagtccgtcttctataccgacctgaccgccgccgtgcgcctgaaggatggctatcgcttcttcctgacggtcaacaatctgttcgatcgcgccccgccgctggcgccgaacggtacgctcttcacgttcatccccaccaatccgctgctctacgatgtgactggacgccagttcacggcggga

SEQ ID NO: 515806 - DNA, 130 bp, Homo sapiens
gctgagccaggcgttgtggggcagatgatcgaggcagctggaagagcgcccgttgctacgtgggtagtctatattctaactataggccttcctgtgttcctaggtaatcctgattcttgcttgttctcga

SEQ ID NO: 515807 - DNA, 178 bp, Homo sapiens
atgtcgccggcgagcacgacactgtaagtatatgctattgcttgggttctcacttgtttaagacggaaaccttgcttatctggccttccagctggcgcggtaaatctgtgagtacccctggttctcctcctgtgaatctctgatctgcttgtgtccccctaaccacttaccctgacct

SEQ ID NO: 515808 - DNA, 477 bp, Homo sapiens
acctaacaacccagcacacaatataaaaactggaaatacatgtaaagatcactaccatctgattaatgaggtcaaagaagtgcacagcattataaggaataagaatcgactaccagccgggcacggtctgtaataccagcacttggggaggctgaggcaggcggctcatgaagtcaggagttcgagagtcgcccggccaacatggtgacatcccaactccactaaaaatacaaaactgttctggtagtcctatcattcatgcacagagaggtgacaataacgcatcgtggtggcttctcccttgtgagtacacaaacacatatcaccaggcgtgggaagaaactttcttaacaagaaaaagatcaaaagaagcaaagggacctcaaaagaagcagaaattccaaccatggacaaaagtatgataaatatgctgggagagatgagaggagatttggcacctgtgaaacagtgctatta

SEQ ID NO: 515809 - DNA, 249 bp, Homo sapiens
acagggtctggataaaacctaaccatctttccatctgggctacagctttgacagctggagcatattggagagcaatgaccctggcctttggccctcaaatagtttttaccacaggccctacccaagtttgactttattcacctccaactgtgcccaaattcgacctcaaaagattaaaagcctatttgtcttttaaaggccagcctttatgaagctgacccagcccaaaccctggtgggtccctggttt

SEQ ID NO: 515810 - DNA, 120 bp, Homo sapiens
ttcattagagtgattatgaattagtgtctacaccattactcaattcttaaaacttagaaatgctgtcgcagtatcactataacttaacactacgagagacttaacaaacagttactgcac

SEQ ID NO: 515811 - DNA, 1025 bp, Homo sapiens
cacgcgtcggctggagatgcatctccgagatgaaatttgcaatgagatggtataacagatgcgacagcgggaacagtggtgcagctaggtaacattgtggatcacccaaaaggaactattggaggaaatgtatgatgaaaaactatactatcctcaaaggagtcactgacaacattcatgaccaagagagagattcaggagcgggatgaaaagattgaatgagctagaacgctctcttgcgggaagccaagacaaccagttcagatggtcccagtacagcaaatctagggtctgcaataggccctacggcggtcacaaaggttggcagcttctgcctccacgccaagcagcttcgaggaggttaaagctaaattacatgcaggtgcaaatgcatgagcataagacctcttagccactgaagagttgctataagtatcagtaaaatgttagaaccaccacccttctagatcatagtccacttcaccatgtgatgtggacaagaaggttcgaagagggccagtaagaatataaggctgttggcgtgacagatcgcttcagaaacttggtgagtctcatccaagtcagcaagagagagcttgttgccacagtcactggggcaggaaaacttgcggtaaagccttgagccactggtgatgacatcttatcaaacaggaccagactctggtctgaaactgcagaacaacgagggggctagggaaactgtaacttcggaagaagggcagcatgtatagctgagcagtatcatactgtgttcgcactccagcccagtttctgccacaaagcgctggtccacccgggaatcaggaacactccaacaacaccggggagaacctcctcgaattctcccaaacactgcaagctcaaggatggccttgccatcaacgcaagggtccctaccaattggttggaagccacgggggaaaaaactgccaggccacggaaacttgcctgaatacggaccacctccgaccccccggtttatgcgatcaaagccaggaaaaaac

SEQ ID NO: 515812 - DNA, 339 bp, Homo sapiens
gcaatgtacagcaacagagggtaccttttgggtttatagtatttacattctcttttagggtaggaggaggccaattttacctttaatttcacatgggttaggaattttaaaggcaaggttcattacccaaaggatagggtgtttggtaattgttgaaggaaggtaggtcttggcttcatgttttacatctccacctaaaattcccatactatctccttgggatttgggagagccacaaaataaagctgattgtcatgtgattaaatatctgatcaacaggtatgaatatacctcaaatcagcatatttttgccatggtaataaatgtcctataaactat

SEQ ID NO: 515813 - DNA, 222 bp, Homo sapiens
cggcgcacctgactgtaaacaatgaagattgacgcagcccgcagtgagacccgggcagagaagaaacgcatgggcatagaaataagagcagaaggccctgggcaccctgggcatacgacaatgaaaagggccaggtcgtgaccaaagacagcactcctgaagcatatagaagagctgatcgaggagcctggcctcacgtgctgcatctgcaaggaacccacg

SEQ ID NO: 515814 - DNA, 341 bp, Homo sapiens
ctccttgatggatcccccccatgcctttgtcacaggctacgaaagtctagtgacaaggaagcccactgagtggccaaatccaagtgttcattttattctttgaacggtatcaagaaaagagatgtacccgggcacagtgtctcatgcctgtaatcccagtgctttgggaggccgagacgggcggatcatgaagtcaggagattgagaccatcctggctaacacggtgaaaccccgtctctactaaaaatacaaaaacaaaaattagccgggcatggtggcgggcgcctgtagtcccagctactcgggaggctgaggcaggagaatggcgggaacccaggag

SEQ ID NO: 515815 - DNA, 118 bp, Homo sapiens
gaggaactctaccgagtataatagataggagcagtgacgaaagtaatttgatgtcctccacgagcaaacagagccacggagagcagcaacaaaaacaaaattcacaactggatttgga

SEQ ID NO: 515816 - DNA, 165 bp, Homo sapiens
tggaaatggagtttggctctgttgcccaggttggcttgcagtgctgcaatctgggctgactgcaatttccacctcccgtgtctcacacaagtctttggcctcagcctcgggatatagcggggattacagggcacgtgccaccatgcctagctaattttggtgttt

SEQ ID NO: 515817 - DNA, 185 bp, Homo sapiens
caatcatagcatacagcctatcagccaggggcagactgcagactagaccagatagtgtccaaatatagacaaaggttagagctagtaagccaatacagcctaatatccaatagccactatcactaaattctgtataatacaactcctagcttgccccactgtatgctagggtggcaggtctcata

SEQ ID NO: 515818 - DNA, 128 bp, Homo sapiens
gaagagatagcgttgatagggttgtaggtagtttgtcagctcaggctcggcagggcaagaagctgtcggaaatcatggagaaggggcagctggttccactggagacagtgttggacatgctccgggat

SEQ ID NO: 515819 - DNA, 1228 bp, Homo sapiens
catacactataagctcctgctaggcaaggactactaataagtgctgtgttaacactttcctgtagagagcttactttatctaactaaagataccagagcaggaattgcagtcccgtctctatggtagaaccatcagtaagtcaccctctggcttctttcgtctttagcgcagatacacgaaattgaccgagaacatcagaacattctatgaagcatcatctagaactatggtcatttacaaacttcaagacggtccagagaaaaaacagaagcttctgaactcacgtcgaacccgcatactatagctcactattttctcagtggccttacttctactattaatacccactgcagggatcatagacactctgcccaggaatttcgcaccagtatcacaggccaacacgctgcacgtctccaacctttgcagaactgtacacgagtataaccttggtgactctactagtctctacagcaccactctgcccagaatcctggagtgttacaacagcggacaacctaaattacacatatacgctctagactggcttcagtggaccaggtaccacacccagcacaaacccctcacatcctgtacgttagcacaacccttcattactaagccgcaaactacttactcacacacactttaaaattatttttaccgcagagtcaggcgacccaccacccttcaacacaggctctacttgaacacctctcctgtgacattaccatttccaagagtatacatatgctcacaacatctaccatgggtgctgaatggcgatcggaacgtaggtaagcctttgcgagaacgcttaatatcggcatgccaatggcgatgcacacatcagcgcacaacaacacagccgaaacagaagagactaccagaaaccatccccccagaaacaggatacagaccccataaagacgtgcctacaggagatacccaccctaccaacctgacgccaagcgcgcaccaaaaacgaaacagagaaaatacagaaaggcacaacaggggaacagcaactgacgcaccctcccgttggcacgtggagccttcagctccacagaagaaagacatagacagaggcgaaccacaatacataggcacacgacgaacgaggcaacggaaagaccagtcccaaaccaggtgcgtagcacgacagacggcagacggaacgaacaaggacagaagagggaaaacgacagcgagaaccgcaggcgc

SEQ ID NO: 515820 - DNA, 232 bp, Homo sapiens
  misc_feature (50)..(50): n is a, c, g, or t
  misc_feature (185)..(185): n is a, c, g, or t
  misc_feature (193)..(193): n is a, c, g, or t
cttggacaagatctgggataattctctggattacctggcagagacttttnttctcttcccttactgtctcccaaataaacagtctctcactctgttgtgagccacctgaagctgtgatatttccaacgactgtaggaggaaaaaattaaggggagagaggaaaacaaaaccaaccaacccctaanatcatttntttattgtacataacgacctcattctcctgtatatgcgg

SEQ ID NO: 515821 - DNA, 125 bp, Homo sapiens
cgttaaaacgggctgtggtcagcagtgtggacgtgcagtcagtggagcctgtggattagaggacccgggacgccctgcaacgcagcgtcagctgtccatcgagatcaccaccatagtcccagtga

SEQ ID NO: 515822 - DNA, 599 bp, Homo sapiens
accgtaagaaaaaaacagaactatgccaaataatatggaacgatttccatatgatctctaaaagtcttattgaaggatgatatcctttagtttcttttgagatggagtctcgctctgtcatccaggctggaatgcagtggtgcagtctatggctagctgcaacctctgcctcctgagttcaagcaattctcctgcctcagcctcctgagtagtggggattgcaggcacctgccatcattcatttttgtataattagtagagatggggtttcatcatgttggccaggctggtctcaaactcctgacctcaggtaatccacccgtctcggcctcccaaagtgttgggattataggcgtgagccactgtgcccagcctgaagtataattttcctttcataaaattcagctatagtaagtgagtatcaggacatttataacggctgtgcaactgtcaccacaattccgttttagaacactttcatcatctgtagggaggtttttgatcactacttaatagaataaaatagggctattttatccaatagggctgtttcacttcccagtttaatttgtgtcagattggtactgtgttttcgaggt

SEQ ID NO: 515823 - DNA, 387 bp, Homo sapiens
gcatgtaactgaataaaaggaagaattacatgcctcactttccctgctaaaagcacacattcacgtcgcatacctttgatatcacatgaattctgatcaaatcatttaattataaatgaaatagctcatggccaaaataaacaccttgtcataagacgtaattatatggtatggagtatcttataataaaactatgaggctacgcacatgtggctcacacctgttagcacaacaccttgagaggctgaggtcagaagattgagttcaggaattcaagactaacctgtgcaacatagtgagacctcatctctactaaaaattaagaaattagctgggcgtggtggcacaatttcagctcactgaaacctccagctcccaggttcaagc

SEQ ID NO: 515824 - DNA, 961 bp, Homo sapiens
  misc_feature (76)..(76): n is a, c, g, or t
ctatcatacgcagtagtgcccagttcacgtgccggtgataataatacatcaagtattctgcatctagttcttatgntagtatatgaacaattttcatatacattggtgcgtctctacatttattcactgactggtttgaagcaagttatttcattccaagtttatttgtcttcctgctagtagctgtgttgtaatttgatcctattgtcctattcagatcaacttcacattagaaattaaatggtcaagtcctcttattctgacttctatagaattacatgtatcttccaagcaagtaagatatcacttctgattttaagtctaggaaaacctaaattgtggctatggatccataagctgtcttgttgcttgtgaagtatcacatagttttcaaacacgtgatcttgtattgtaacaagttcccagctacgattgttaccattatgttatttatttccatatctctttaggtctttgataatcgtgaagtgttttctctcatcgtttttggtcttccaaagtgcatttggttacggtgaaattgaagaagaaactattgccatcaaagaattacattgtgttagcacaagaggatagactcttagctttatagagatggtcgtgtatctaatagtgaatatcccagcgtttaagaaacagaagtaaagtggaatacagaacagtgccattgaaggaccagttatttaccgtagtaacagaatcggtttactttgacaacaaaggcttgggtctggcgtctgtgtgtgtgtgatgtggtgagtgccactacaagaacaggagcgcagaagacagtgtgccgtcgaaaaacgccaagcaacacgttccacccaaacaacaggcgctgccgcagatggacagcaaacatgggaatacgcattaaggaattcatcatgtcccaccagcccggggaccacacagcggaaaaagactaacccgctcc

SEQ ID NO: 515825 - DNA, 229 bp, Homo sapiens
gccgcagcggataatccgggcatagtctccccgtgtccgatttgtagcgtactcgtatctacacagtcccttttattcagggaagaacaggttcggggaaggacatgtacatctttgcgggagcatatttctggctagcagaatcagataagtgcagtggtcttatttcttccttcatgtaatcttaggtctaacaaagcatagtcattttcttctaatcattaaattg

SEQ ID NO: 515826 - DNA, 195 bp, Homo sapiens
  misc_feature (162)..(162): n is a, c, g, or t
ctgcgtgtggtttacttttgtgaacacacagtcagctaaaataaacagaatttaggcaaaggagcaggaggcacttgttttgggaaccgagcgcacagtgtcagacaccgagtcgaagctgggttccttcgagctccttctggctgtgggtgtggccgaggnccttcaccaggtggccagggccgcagtacccag

SEQ ID NO: 515827 - DNA, 542 bp, Homo sapiens
  misc_feature (68)..(68): n is a, c, g, or t
  misc_feature (89)..(89): n is a, c, g, or t
  misc_feature (112)..(112): n is a, c, g, or t
  misc_feature (139)..(139): n is a, c, g, or t
  misc_feature (173)..(173): n is a, c, g, or t
  misc_feature (230)..(230): n is a, c, g, or t
  misc_feature (280)..(280): n is a, c, g, or t
  misc_feature (287)..(287): n is a, c, g, or t
  misc_feature (309)..(311): n is a, c, g, or t
  misc_feature (315)..(315): n is a, c, g, or t
  misc_feature (319)..(319): n is a, c, g, or t
  misc_feature (323)..(324): n is a, c, g, or t
  misc_feature (339)..(339): n is a, c, g, or t
aacgaacgtacacacatacacacacacacacacacacacacgagggaaactccatctcaaaaaagaanagcccgcaaacagcgaaatgntacttaattacatataaacgaanagagaatactagttgagaaagtgaaanagtcacaaaccctaacttcaactcacagaagatngtggcaaacacccattaacttttctacacaactaccatttcaactgatgagctgaanggaacaatatcaactagcgatttaaatctaaaactaggccaggtgcggtngctcacncctgtaatcccagcactttggnnngccnaggngggnngatcacgaggtcagnagatcgagaccatcctggctaacatgatgaaaccccacctctactaaaaatacaaaaattagctatacgtggtggagcgtgcgtgataatccccagctactacaggtggctgaggcaggagaatcgcttgaatatgggacggcggaggatacagtgaacccacatggcgccagtgcactccagcttgggtgatagagtgagac

SEQ ID NO: 515828 - DNA, 923 bp, Homo sapiens
  misc_feature (492)..(492): n is a, c, g, or t
agcgggccgggcccggggagtaggaaggagccggggctgtagccggagtggagcggctgccagccagaggtagcaggcgcgggcgcgggcgccatattgcggccctcagcagtgccgcagagcgagctcatgggctgagaccgtacgacttcctcttcaaattccatggtgagttggcagtgtcacggaactgtgctaaagtcgactgtctcacttcatcagttcacttgagtaactacagtttcacaagcacggactccaagcacacacagagtcgtgccgttgtgagggttggagtccccggggtggttcaacgatggggtggggaatgacctgtgaaggtctaccgatgtgtgggacacggggatgggccaggcagcggttatcggatcaggtgacgcgggaggtctataatccgatggggcggtctggagccctgctggtgtagcgatcattcaccaggccgggggactataacaatctcaccttggnctgacctggttttgacggaatgcccgcatcgctctgagccatgcctccaaacattcgttggtccttcctctgatggcagatcgatagagatctgggaccctgatgctgggaggtcactttccttggatggtcctcccgcttatgccgcagggatgagtgagctgattgttccttggagaccagcgctctcacaggcgatgaccgtggaggaggcgttcctccaagtgtgcccgtatatacgtcaatgaagaattgactcggggcgaactggacccggagagggatgggctctggcttgcagtacggggatggggtggctcccgtgcagttcggagagccatggagtgcccggcggtggccctagcgtgttgtggtgagtgtgtggggccgtaactgtctccaggaccgctgtggggcggccagtcgagaga

SEQ ID NO: 515829 - DNA, 691 bp, Homo sapiens
  misc_feature (195)..(195): n is a, c, g, or t
  misc_feature (226)..(226): n is a, c, g, or t
  misc_feature (281)..(281): n is a, c, g, or t
  misc_feature (294)..(294): n is a, c, g, or t
  misc_feature (321)..(321): n is a, c, g, or t
  misc_feature (351)..(351): n is a, c, g, or t
  misc_feature (481)..(481): n is a, c, g, or t
gctcaaacaccaacaaccagtaaagtcccccccctgcttgagtcacctatagccaccgggagttttatgttcaaactctcagtgagttccagcgttggtagggtgctgttgttgggggatcttgcacgccaaagatctctaccccaccctgcctttgttacagagtaagctgagtgccgtagcttgcggggaatnggcagtcccagcacagatgccagtgccagtnatgtcccggcaatttcgccttcgagggcattggaaatgaggatctgtaatctccnctgcttggatgtntgccctctaccccagaggaatttacanaaacttgccctgtgcctgtgtcccccatgntaggggcggaggggtcttttcctttttttttccaaccaacccctttttttttggccaggggcctggtatcctacctttccttgtcccctggggtgggtgcccagaggattgcccctttttttttcaaagntggccctcgatgccaaattagcatttagtattttgcccaaagtttaagggcccatggctgcctcccttggggaggaaccatatttccctttgggccgcttttggccttttggagccatgggccaaaggccaaggggatgggcaaaggtttgtgtttggtttggcccagttccccatcattaaactcagcctgactgctgcctaaaaaaaa

SEQ ID NO: 515830 - DNA, 191 bp, Homo sapiens
  misc_feature (67)..(67): n is a, c, g, or t
  misc_feature (83)..(83): n is a, c, g, or t
  misc_feature (108)..(108): n is a, c, g, or t
  misc_feature (144)..(144): n is a, c, g, or t
agaccatctgactctacaccctgtgtctcaaagcatcagacacacaccacagacaccgtccccagcnttcctgtctgcttcangagtcatgtaggtttggggaaacangctgggtcccggaaggtctgagggaggagacggcanggcttaattcctggaggccttgaaggtttaactggacccatctttgg

SEQ ID NO: 515831 - DNA, 965 bp, Homo sapiens
  misc_feature (737)..(737): n is a, c, g, or t
cgccagacgcccctgggtcagtggactctaagagtgtcgctccggcatccagtgtccttaaagatgaacgtgagaagggtggaaagcatctcggctcagctggaggaggcgagctccacaggcgacagcgtggaagatgagctggagatggctactgtcaggcatcggcctgaagccctggagctgctggaggcccagagcaaattcaccaagaaagagcttcagattctttacagaggatttaagaatgaatgccccagtggtgttgttaatgaagaaactttcaaggagatttactcacagttctttccacagggagactccaccacatatgcacattttctcttcaatgcattcgacacggaccacaatggagctgtgagctttgaggatttcatcaaaggtctttccattttgcttcgagggacagtacaagaaaaactcaactgggcatttaatttgtatgacataaacaaagatggctacatcactaaagaagaaatgctggacataatgaaagcaatctacgacatgatggggaaatgcacatacccggtcctcaaggaagatgctccccgacagcatgtggagacgttcttccagaagatggacaaaataaagatggtgtcgttaccatagatgagttcattgaaagttgccaaaagatgaaaacattattgcgctccatgcagtctttgaaatgtggtcttgactggcaggcctcctcgacgagaggncgatgggaacgactacacccaagttgggagcccccctggttgctaatgctcacttctggggcggtatgcgccggttgtttatttaggggccccccgccccataggttcgtcactggccggccggcgcagtggcttttttcaggggctggagtgcctccgttgcgtgaccgcaacccggtctcggttccccgcgtgacctcgcccacgcgcgggagatagacccccggt

SEQ ID NO: 515832 - DNA, 960 bp, Homo sapiens
ggtcagactgccttacgcggtgaatggggtaaaatgcggacatgccactcagtccggccgcgaacagtgctccagaatctcagagagtattccagacgggtggagatcgcgttccctggccgccgaggtcccatcgcttccctgtctgggacagacagatgaggcgctttagccgtctcgcacggccagccgctccctcataacccgagattcttgtgggctcttagtccactatctgccgtttggaggtggtgtagaccttgctaatccaggacggccagtaggcagagctcatttgtgattcctgtctgcaatcgtgcaggagaacgcctcgttatggaaaagccaggagcgccaggagtcagcaaaacacgactaaagattgggcagtcactggggagaacactcagcccgctgcagccaggtgaaatatacagccttgtggcctcacaacaaagcctgttgggggtttcttcacacggatgcatgtgacattggtgctgaagaaccaggacaggaggacctccttgggagagcagagccctgttgtcgacctcaatccgtgaggagatccacctatgatctcaggtcctcagaccaacagtcgaaggaacatcttgcaatttcacctcggatcggagtgtcaggctctgagttcaagctaagcccatcaaattccctgtgagctgcacgtgtacatccagatgactgaaggaactgaagatcacaaagaagtgaaagagcttactgatggccttcgccatgtgattgtcctggccaggtagtgatacaattttttccccgctgaatgtatttgaacttatcgaggtttaaatagggatctacacttgggttcttttgatcagcgctggccggtaataacggcggggcaaaaaaccgggttctggtggcacagcgggccggacgtttcacttggagggccaggtaaacggaatacag

SEQ ID NO: 515833 - DNA, 1153 bp, Homo sapiens
  misc_feature (534)..(534): n is a, c, g, or t
  misc_feature (648)..(648): n is a, c, g, or t
agcaaggctgatggagaagctgcagcaggtagacccggaagctctagctaagatcatagatgagcgagacgacagcaagcatacggaaactagttaaaagataaaaacaatcctaacggaagaataggaagggaagacagcgagaggacaattaagggtctgagtatagggaaacaaaaactgaatcaacgagggcagcagaatgaatgcagaggcacggaatagaagatttatagaagtagtctagggtagactagtttcagctagaaggcctactccgtacaatttaccattttttgttaatttatcgttatggcctcggaaaagagaattaatgaagtagattacgaactacgaaaccagtatatcaagattataaaacatgaacaaagaacaaataatgaaattcattcgggtagaatatgctaaataaaaatcaaaactaatatttatttgccgaattcataatatatgggaactagcataatgaaatatctgaagaaggatcggctaaaagaatcgatgttgctaccngagctgactgcagacgagatacctatcgagaagatacggagaaaatgccgcgacaggctctagatgaaatgattgccggaaatgaatgtaattgttaaaataacaatgacggtnaaatgaaatttctatctgatagcgatgctcgatcaataccacgttaaatagggaacataaaagaaaatagggataaattttgcttaaagatttgtactataaactcgtaattatatcaactatttcacaccgataatttgttagtctcggaaaaatcaagataggttgatttgggcaggagcaatagaccattcaaaccattatattgggattctaagataatagaatataatggggggattatctttatcgggaaatttattagatcattaagatatggaaataatccttacatttatgaaaaacacgatttaccacaaatttagattgataaaatagacaacattctaaaaaactacttgatacgttcaaataactaacttttaccgggggaaagggttccaaattataagaaaatggtttggaaattatgaagctcaattggaatattgagattattccaggataagagttgcgggtgggatgggaaggtaggggcacaggg

SEQ ID NO: 515834 - DNA, 283 bp, Homo sapiens
  misc_feature (163)..(163): n is a, c, g, or t
  misc_feature (265)..(265): n is a, c, g, or t
  misc_feature (274)..(274): n is a, c, g, or t
gctgccgggcatggcatgttatgttctttaatgggtcagcagttgttttgcaagatgaaaaagttctggagattggttgtacaacaatggcgacatacttaacactactgaatgtctacttaaaaatgattcagatagtcaacttctattactctgtatttcnccacaaaacatttcttaaacgtacgcaacgacaataaataaaacttgtaaaaaccctgactgttacgtggcctactgtagggaacatggactactcatatanctccccaancaggacagt

SEQ ID NO: 515835 - DNA, 1071 bp, Homo sapiens
cccacgcgtccggaaggggaagggagggacatgctcacatggttccttctagcatgtacctcatgtggttaaaaatggaaactgttctcctccccagccccactccctgttccctacccatataggccctacatatgggaaaaatcactattaatttctgaatcctttgcctgtggagtagtgaatggagaactggctgcacaggtgagactaggatgtgagatcaccaggatgcatggagaacagtgcgtatacatgtgatttgacctggtggagtcatccagctcttctctggctgattgtgccttccctcccttcctctcccaccatgcgatgaggcatccttttcaggccaggtgtactgcagagcctcagttaccaggatatcggcttgctgatgtgcctatctgtgctctatcctacccatctgacagggacttactcgtttgctactgaaggcctccgcatatcgccacagtaacacatccagactccttataccacctgggctattccctatggactatcctgcacagctaatttggggcaagaatctcactgaccacacatatgacctaagaaggcctgataccgtctggacttgcgcggaagtaaactcatggaagggatacctcactcgtaaatatacccacacccttagctggtccacgacgggaaacgtgaccggggccacacagagacaagaaaaggggagacacaaaacaacacatacttccccgaaagaagcgaaacgcacacgacaaaacgggcgatggcacatggcggcggaaagcaaacatgcggcacaaacccggacggaatactgcaaacatacgccgagagagaacgcgggacgacgcccccaggcacacagcggaagcacccacaagatgaccaaccaccactcagtcacagggaggaatcagaggaaccaccccccacgacagaagagagcctctacacaagagccgccgcaaccacccggtggagatggcaccacacagggtggtcgtccacagggacgacgaccatacagacaacaaacggtgcgggcgaaacgaaacgccaacg

SEQ ID NO: 515836 - DNA, 500 bp, Homo sapiens
atgaaatctactatgccctaatatgtatggactgggacccagtagaaagcctctgccccgaatgagactttcaacatagggtataagcttcattgaatgaggtgcagcctttcatttcagggactctcttattttgcaaggtcttaagaggcagaagtaccatggattgtaagtacacatctctgtgacctcagtttcctgaaaatatacacctactgggttctaagattctcccttaccagtgactgtatgcatctatttcacagccaccagaatctggacggtacactataaacattatgaaaaatacagatactgctgcagaattggcgtacgtggcacgcatgttcaagtactacgcatcctggcgggattgcttggacaaactggacaaattgtcagcctgcgaatccagtgctgagagtgcttctcctcgtagtaacacttcttcaatattggccaccatgatcctctgcacatcttgcaactctgcggtgatg

SEQ ID NO: 515837 - DNA, 415 bp, Homo sapiens
  misc_feature (10)..(10): n is a, c, g, or t
  misc_feature (45)..(45): n is a, c, g, or t
  misc_feature (51)..(51): n is a, c, g, or t
  misc_feature (75)..(75): n is a, c, g, or t
  misc_feature (87)..(87): n is a, c, g, or t
  misc_feature (91)..(91): n is a, c, g, or t
  misc_feature (125)..(125): n is a, c, g, or t
  misc_feature (143)..(143): n is a, c, g, or t
gggcgctgcncagcctcctgaggagccttccccgcagggcccggngcagcnccggcttcgggcctgaatccagcncggaacggccgncggnccaaccgcctggggccgtcccttgcgcccaaccncggggcgcctggcgcgtnacgctcgtgcagcaagcagcggctgggcccaagggtgcgcccgagcgggctgccgagctgggagtcaacttcggtcggagccgccaggccagcgcacgggggaccaacacgcacaggtacaaggcatccgtgcaagagtttcaagtataactccctgctccttaagcaccagcgcatccacaaggccaacaaaccttacgcatgccacgagtgcgaccagcgctagccacggctggccggcctccagccagcaccaccgcatccagacgggc

SEQ ID NO: 515838 - DNA, 414 bp, Homo sapiens
ggggggcgggttttcacaatcccctggcccggcttctttgggccctttgggcaccttttcaaaaatggcgggacggggggggttcgggggatttctcccccccgtccccccccggccgccctgggtttttttttttttttttttttgggcgggggaaggccctccgcggggggggcttttttgttttttttttaaaaaaccccccaaaaaaccctttgggtcccccgcgggcccaaccaggggctttttttaatttttttttacacgggggggggcggggggggggccgggagaaaccccccaaggttttttggggggccttttggggggccccccttgggggggccccggtttttttttgtttttcttttcttttccccggccccggaaaaagggggttttgaacaagtttta

SEQ ID NO: 515839 - DNA, 355 bp, Homo sapiens
  misc_feature (342)..(344): n is a, c, g, or t
  misc_feature (346)..(346): n is a, c, g, or t
  misc_feature (348)..(348): n is a, c, g, or t
gaggctggagaggcctcagaatcatggtggaaggcaaagaaggagcaaaaaggtatgtcttccatggcagcaggcaagagagcacgtgcagggaaactgccctttataaaaccatcagatttagtgagatgtattcactatcacgagaacagtatgggaaaaacctgcccccatgattcgattacctcctaccgggtccctcccacgacacatggggattatgggaactacaattcaagatgaaatttgggtggggacgcagccaaaccatatcgggtagcaacaacctagggtcagttttgcaggtggtaaagccatttaccaagatagttgtgacatggnnnangnccgacta

SEQ ID NO: 515840 - DNA, 177 bp, Homo sapiens
ccccgcgctagcggcattatgtgaacgtatacacacacacacatacatatctgaatcactttgctgtacacacctgaaactaacacaatattttaaatcaactatactccaacatgaaaaaaaaattaaatttaaaaaatagtcatttatctagccgttcacttaatgccgctagcg

SEQ ID NO: 515841 - DNA, 168 bp, Homo sapiens
tgaggacccccgaacatgtcgaggctaacattagtcgttgctcaagcgcttcttggtcatcagacagtctttgggcaattgtcctacagttgctgatgaaactagattgctacgtaggaagatgtgtggcgcctgtttgaagaatgcatcttaatcgagcatcagctc

SEQ ID NO: 515842 - DNA, 505 bp, Homo sapiens
  misc_feature (367)..(367): n is a, c, g, or t
ttagaacaaattagctggaggccaccttatcccacctccagccccctctgcaacacccttcatagctaattacctgcttttcattccaaattttctatgacaaggtgttcctacctcaacaggtgatcaccatggcaacgaggtagtctgttctatttttggagtatgaaagtagtgccttcttaaatctaataataaatgagagttccagaaaaccagtgcttcaaacaaatttgatttacttgaatttttttttattttaaatcacactttgggaggctgaggcagaaggatcacttgagcccaggagtttgacaccagcctgggcaacatggtgacactctgtctatacaagaaatataaaaanttagccaggcatgggtgggcacacgcctttggtcccagctgctcaaaaggattgcctgagcctgggaggttgaggctccagtgagctatgattgtgcccctgcccaccagcctgggtgacagagtgagcccttgttta

SEQ ID NO: 515843 - DNA, 220 bp, Homo sapiens
aacaattcttatgaggtataattatcacatgcattcattggcgatcgactaaaggagctctgatcgcttgttggctagtcttcgatcagcgacatagaccgcggagacagagccattctcatacaaaccccctgaagcttcaccggcgcagtcattctcataatcgcccacggatttacatcctcattactattctgctattgaaacttctaaaactagg

SEQ ID NO: 515844 - DNA, 352 bp, Homo sapiens
ttttttttttgagatggagtcttgctctgttgcccaggctggagtgcagtggtgtgatctcggctcactgcaacctccgcctcctgggttcaagcaattcttctgcctcagcctcccgagtagacctgggactacaggcgcgtgtcaccacgcccggctaatttttttctatttttaatagagacgggggttcactgtgttagccaggatggtctccatctcctgacctcatgatccgccccccgtggcttcccaaagtgctgggtaagggctttttttaaaagtgatatcaaggaaataactgtcatgaataaaagaaatgtcagacacaaatactcttgatgccctatga

SEQ ID NO: 515845 - DNA, 101 bp, Homo sapiens
cacacgtccagggtggcgcctgtgaggtggtgacgttgacttccaggcagagcccctccaggaaccagctgttggcctgggccacatactgcctggtggcc

SEQ ID NO: 515846 - DNA, 227 bp, Homo sapiens
ctacttgcctcggcggctgaacgtcttttcgtgtgcttgtttgccacgcgttatgctctttggtgaagtgtctattcatgtcttttgcctgcttttcacttgggctgtttgttttcttactatccggtttgagagttctttgtacatcctggacacaaaccttttgtcagatacacgatttgcaaatattttctcccagtctgtgacttgtctattgggaactgaca

SEQ ID NO: 515847 - DNA, 192 bp, Homo sapiens
ctctagagcctcccctttggaggctgaggtgcgtggtcacctcagtcgagagtttgagaccgcctggccacatggtgaaccccatctccagtaaatataataattgccaggcctggtggcgggagcctgtagtcccagctactacggctactagggaggctgcggcaggagactcgctcgaacctcttcggt

SEQ ID NO: 515848 - DNA, 232 bp, Homo sapiens
ataatatattagagatttcaccttaaattatttagtaactagttctagaacatgttttccaattgattattttgctaatggagacatatattgacctagtgtttatgcatatatgttctctacacagtgaaactttttttagaaagaataggaaagaaaatgcgggagctctggctctccaaggcagagtcatatatgtcacgtgtggggggggggtggggggggacctttt

SEQ ID NO: 515849 - DNA, 177 bp, Homo sapiens
cacggcctaagcccacatgacaaatggaacagatagaagacgacacaatcattgaaaacgggaaagacaaaggctcagtgaaagtgacttagatacacagtatcttggtattggggcctcatcaaggtgaggcttcaagctacaacatagcttattcaacaaggtgacagacgaact

SEQ ID NO: 515850 - DNA, 330 bp, Homo sapiens
cattgagccccttgatgcccagagagccctcacctaggaacccaatctgccaacaccttgcatcttggacttccccagcgctcctggaacccctgctccataatttctggcctgggctcagtggctcacacctgtcttcctagcactttgagaggccgaggcagtactgtattgctggaacctcaggagttcgagaccagcctggtgctatcacagttgaaaccccatctctactacaatagcacaaaaataagccaggtgtggtggtacgtgcctgtagtcccagctactcgggaggctgaggcaggagaatcgctcggacctgggagg

SEQ ID NO: 515851 - DNA, 1409 bp, Homo sapiens
gagagcggctgtgcagccctggtagcacctcaatcaggcatcggaccttgtaggtggatctcgacgcctcgttatagacctcgcgtccaagctcacgaggtcgagggccggaacttgcggaatggtaactgactatccggtcctccgcctcgcaacgctcgaatatacgaagtttctcggggcatgatgccaaacgcggccagggcccttcgacagtgtgtcgtcacgatgacactctctctcgtggccccggtcatatggctcgcctcagcaactgttgggagggcggtcgcactcggaatggggaactctaacgtgtggttggtattgggatgaggccaatggcgctctatgacacgtgaacttatgtattgtagtgcgagtcggagcgaagggctgccgaggagacagagtacgcagccgagaatgcgctaacgacacgctgcacagggtatgcgccgcacatgcgtggggccatgacaggcaattcgaatatgaaactatactctgggtgaatacggaatgcactgcccacgaaacacagttcctagggcctgaggcattgcatccctctccctaacccatatgtggagagccttgccagtttggcttagcgccatacaccacggaaaaggaggaagggcggacccacacttggtaggccattaggtcagtcgaaacaccgggaaggtggaacacgcttcgcaatggggacaagcacactctaccaatgggggcgacattcgccggtcgggaaagtagaccgtaatttgaatcctcgcaaagggagatcctgaatgggttacttgtaagaactcgtaggttcgagaagcaacgcgacaacacaaagaaagctcgagataggatatactgacgatgacatgcggatacatacactctaagggaggcgtttgggttgcctttaaggttacgccccttaggagaatactggctcaggatggccattcgagtaccctaaggataagcacacatgcgggttatgcgggctaatgtcaaggcgtcgaattttcggaggaacattatcaccgaggccgattaggcagcccgcggtgtgaggatcctcaacaccgtaaaagccacaacgaagtaggctagtgaccacgcacgcaagagtttcaattaaagttcgaaaccggagattggggattaattttgcacacaccagtaacagcgccccccacagttggtccccaaactaccgtgtggccattgggttttcatttttgagagagcacgcctgtagagatcgttttgggacaccacggtgtgggaaatccgctttgcgcagaagtgtggaatctattaggccccattcacaattgtgcagagagaatgtcccttttatcaaagaccacgagaatggctggccagggggaagtaatcacagg

SEQ ID NO: 515852 - DNA, 940 bp, Homo sapiens
tagcacgctgcgccgcgcagtagacccggggcccacaaggacaaggtggcgcgacaggggaactgccagggggggacgagagctgacgtaagtggcaagggggtgcgccgcaacgtgtcgtggggggacaacaaatggcggcccgcccgcgggaaaaactcgggggggcaggcaccacagtgctgatatccggtaacgggggataagagccctgaaaccaacacccgggggggtttcggctaggaaaaaacgcacgtctacgctggcgggggcgggccgccccaacagccggcgccaccacgagggtagcggcagcgttgccgcccaacgcaaaagaggtccaggcagtctgcaaaggggtttaccttgtgtgggaaaaacaaggaagtggggcttctggatccgttaggtcgtccccgaaagatggtgtaacacactcgggacgatgttggagaatatacaaggaagtgaattagacaaaccttgtttaaagaacccccctagagttgtgccggaaaaatcaaacaacgcactaccgcggcggggtgcggtgactccacccaggagagaccatagcccgctatggcaacagtgttatttagtctcggaagggggagaaaaccagacaaacgcttccagatacaccgtgaggggcagctggtttttttaagacaaatagataatacgggaggaataaataatagacttctgtgcctgtttagcaataggcgtagcaatttaaagagcttttcgcacacctccactcatcgtggttccataaatccgagtgagaccgacgccacgatgatccacggcccctcctttcatggcgtttatacacatttactgcacgaagatggttcaccatacccaacatttggagcggcccctgcgggcgcgtttctcccaaaatactcgaaccccaaaccgcaaacatgac

SEQ ID NO: 515853 - DNA, 1274 bp, Homo sapiens
acaatgcagatcttctgtgaagactctgactggctaagacctatcatcgctcgatggtggagcccagtgagactcgatcggagaatgtcaaggcaagagatccaatgataaggaaggctatccctccgtgagtcagcagaggttgatctttgctgggaaaagcagctgtgaagatgggcagcaccgctgtctgatcgtacgaacatccacgaaagagtccgaccctggacctggtgctcgcgtctagagcaggtggggattgcaaatcttcgtagaatgactcgtcactgcaaagtgaccaatcgagcactcgtacgttggagcccgaggtgagctagccagtcgaccacatgtcgagggcaaagatccgatggattagtgacggcggtcccgtgcctggagcgagacacatgaggggtcgactctttgctggtaagacagtttgggaagatgggtggcaccctgatgtgactagaatattctagaaaagtagtcgaaagcatgggaacatgagttgcttgcggttctaaagtatgtgatgagaatggaggatcatgcagtgaaagacagggtgaaccggcgtaaggaaccgcacagaccccatacagactggtggtaactcaaagcgtggagccagcaggtccagacgaacaggccaacgagcggacaagacaccccacaagacggacacgatgtgcaactaaccgtcctggacaaccaagcaaacagcgattggaacgaatggacggacaacaacaagagtgggggaaacaacggggaacggcaccaaccatgccactggactacgccaaagacaacgacagaaaccacgaaggtcaaaccaagaacaccagtgaacaacccggcaaccacgcgaagcgcacccgaagcaacacactcggcatacaaccagaacgcgacgcaaataaaccaaagagacctcccagagagcagcacaagtaacaatcccgagaagccacgccaaagcccaagagaaaagacaggagcaccggataagaagaagaatgaaaaatgagggcgacagcgaggagaagggcgcccagcggaaaataaagcaacaaagaccacgccagaaagccagacaaaaggggcagaaaaagagcagacgagaagcgaaagacaagagcaggagccagagaagaagagaacaaagaagagcgccgaaagccggacgagcacacggcgcagcctaacaccgtgcgggaacgacggaaaatgcacacacacaggaaaaaaccagctagaagacaaga

SEQ ID NO: 515854 - DNA, 292 bp, Homo sapiens
  misc_feature (211)..(211): n is a, c, g, or t
gcacctgtttcggatggatacatggataatgggtcaatgggtagatggacagaagaatgtatagacaggatggatggatggatggataaatgatggtgagggatgatcaaatggaagatggatggatgggccgatcatgggtggaggatacatgacgggatggatagatggatgacggatggatcctccttcagcttctcctccaactttnacttacttttcaccaattcatcttcttttggtgaaatacttgtccgcctgggcctccagggatttcactgtctgtcccttt

SEQ ID NO: 515855 - DNA, 132 bp, Homo sapiens
ccaccaaccaggtcaaatctggaattttgccagcacccagaagccctctcatgtttcttctcaataccagtctcctcacttctccacacaaagggtaaccccttgccccagaatttttattggcattcactt

SEQ ID NO: 515856 - DNA, 718 bp, Homo sapiens
gcggagggggccgcgagctcccggctgtgcagacgggcgcgcggcgggagggcgcggacacgtccccagcccggcccgggcggaaggcgacggagcgcggcggcgggcagcagacggagacggtgcccggcgcccacggggctgccctgatggggcctggcaatgactgacaggccagccccaaggacaaggaagagaaggcatcttgacggagggcaacgaaggtgacgcccggtggtaaatgactgccctgggagggtgcttccttgggccctggcagggttgctgacccttaccctgcaaaacacaaagagcaggactccagactcttcttgtgaatggtcccctgcctggagtccaccatgaggcttctcgtggccccactcttgctagcttgggtggctggtgccactgccgctgtgcccgtgtaccctggcatgttccctgccccctcagtgtgcctgccagatccggcctggtatacggccccgctcgtcctacaggaggctaccactgtggactggaatgactattcctgacggagtcccaccggaactccccgaggcacaacaggaccatgctctgagagcaacagcattgtccgtgtggaacaagtgagctgggctactggcaatctcacagagctggactgtccagaaagctttcggatgccaagactgggatttccatgcctggccactgtgactgacctaaggaa

SEQ ID NO: 515857 - DNA, 789 bp, Homo sapiens
gctcccggtacctgcttgctgctccctggggcttcgtggaaatgctgagagtctgagccggggaggagtgaaccctgagcagcggcggcggcggcctgcggcggcgggagccccccaagaggagtgaccgggatccatgtgtctttcctgggtgactaggatgtcgtcggaggagaacaagtgcgtggagcagccgcagccaccagcagaggaaggtatgcgaggaggggaccaggaacacagaaggaggggcagaacggcaggacaggagaagaccactggggccaggaccgtcgagcgaatggcggctaaacaggcttgacaaaggacgaagacccgaggcagaggacaacaatccaggacgcgcaaggagtgaacacagcgaggggaggaacaagagagacgagggcaggagaaggagtcaggaagcagaaaagacgcaagagagagggagtgggggcgactcgtggaccaacgggaaatgggggccagtggacaatttacgaacgccagagggaagaaaggagggaaacggaagagaagaaaccaacaacccaacaaaacgcagaacgcaggatacgcacaagttgatgagcagagcgtgagagcgagtcgacgcagcaagacgaggaggagaaggacgaagaaaagtcgacaagaagcgacaggagagacataggagagagagacgggagggaaggccagcaggcagaagaaagagcaaaagagaactaacaagaagtggccagaacagaagggagggaaagacagatgatagacaggaaagaa

SEQ ID NO: 515858 - DNA, 149 bp, Homo sapiens
  misc_feature (30)..(30): n is a, c, g, or t
  misc_feature (57)..(57): n is a, c, g, or t
  misc_feature (121)..(121): n is a, c, g, or t
  misc_feature (136)..(136): n is a, c, g, or t
aattcactatgcgtggccgccacagctatncttgtcctcctggatcctgaaccttgnaagctgcactaatgagttcaacgggagtgctctgggcccaggtgtcagctgtagcaatgccccngctgcaactgaaggngccagcaatgcta

SEQ ID NO: 515859 - DNA, 261 bp, Homo sapiens
tagaagttctcatagcaagggagtatgtgtacacaaggaatctccttccttatagagtgtgtatcgcctttgtcccaatggggaaccgtaaatctagttttaagtggcacagacacatggactaaaagtcatttggtatctgccaggtgtggtactttccttggttaatgggctattgaaagttctaagagtaggtgctgattgaaagttctagaactaggcattgctgcctggggtttcgtcgatctagggctattgaaa

SEQ ID NO: 515860 - DNA, 413 bp, Homo sapiens
taccttacaagctaaatttatggcgatttcagttttaaaaatcggattggtgatttgttccagttcctatgttccaaaaatagactcagatgaaattttaaatgtttccagtaagcatggtattagagtttcccatttgatctggctggtttggatcaagagaattttgagttgtttctgtctagatgcatttttatgttgtgttgttgttgttgtagtggggggggtgtggggggagtagtttttttctagatgcatttttaaagcttacggtaggggaggtggtatggcacgttgtgaggttgattggccagtatttgcaccaacaacaaaaggatccactgtaacatgaaattggggtctgatgacaatcccatgtcatgttacaggggcatcgataaacaccgggtacc

SEQ ID NO: 515861 - DNA, 132 bp, Homo sapiens
acacaaaacaaatgacgggcttcataacgactgccgtgctatatgattattgtaaataaattaacataattatattaacaagggcacgcatgaagaattgaatgaattcatcctcggtaacttaagctacgt

SEQ ID NO: 515862 - DNA, 362 bp, Homo sapiens
ggggctcaagcaatccttctgcctcagcctcccaagtagctgggaccacaggtgtgcacccccactcctggctaatttttttattttttgtaaagaaggggtcttgctatgtttcccaggttagtcttaaactcctggtgtcaagcgatcctcctgcctcagactcccaaagcactgcgattacaggtgtgagccaccaaggccagccccagcaccacttttaactagctgcataatccttgggaaactactaacctttccaaagaacatcttttaaattaagactaacacaccagggctttttctaaggattagatgagaaaatgtatgttaagcacttaaccacactgtgtctgacaata

SEQ ID NO: 515863 - DNA, 123 bp, Homo sapiens
cgggacatacgcctaacggacggaactgacgcactacggacgggactgacgcactaacggacgggactgacgcctaacggacgggactgacgcctaacggacggggactcctctacgacgtcg

SEQ ID NO: 515864 - DNA, 459 bp, Homo sapiens
gctgaatcagaaataatgtggatgcctgacaaccagtgactggccgtgtgggtagaagagtgacatctttgctttctcatggttcaatgtatacaaactttgtttcatacacaaaataaataaaatcattgctataaaattaccttcaagccatgtgtaaggtaaatggatacaccataaatggatttcctgtttagacttgggtcttatccccaacatatctcattatgtgtatgcaaatactcaaatacaaaaaattagccgggtgtaggtgttgggcgataagtgatgttatcgcccaacacggtagtggtggagatgatgggtgtcacggttgtactctttgtgctggtgggtgtaggagttggtgtcatcgtagtggtggtggtgatgagtaccgtggtaggagactgtgtgccggtgggtgtcgggatagaagtcaccgagaagtaggaggtg

SEQ ID NO: 515865 - DNA, 184 bp, Homo sapiens
  misc_feature (45)..(45): n is a, c, g, or t
  misc_feature (178)..(178): n is a, c, g, or t
ggcacgaaggtggcgttcaggcctgcagatcgcgtcgcgcaggtngaagcgctgttggccagcaccacgatgctgcggcttccggcgtttcgtccgccagcgaggccagctgcgcggcgtccgccagctcttgctctttcacgcccggcgccggcaggaactccgaagcctggcggtngcccag

SEQ ID NO: 515866 - DNA, 152 bp, Homo sapiens
gttgcgtaaggatgagtgctttgaggactgggaactgagatgtagatttgggcgtgatgagcatgaagaccaaaatccatgcaaataaatgtattggcacgacctgagccccaaatcttacatctcaattcccatcctaaaaagcactcata

SEQ ID NO: 515867 - DNA, 247 bp, Homo sapiens
  misc_feature (209)..(209): n is a, c, g, or t
gacctgggggaccaggcgaaaacccctttcaaaaaaaaaaaaaaaaaaaaaaaaaaaatggatacagcacaagtagttctaaaagcgaagtataaagcgttgagctcaacgctttatacttcattagctctagaggtccatgcatacttaatattatacttgaattcatacggaagtataaagcgttgaggaagtataaagcgttgagnaagtataagcgtgaggggatcctctaggtcaccgcgca

SEQ ID NO: 515868 - DNA, 1111 bp, Homo sapiens
accaattctattgtacgtctacccacaggcaactttgaatttacttctctagtgctaaataaacatttcagcgatttaatcccccaacttgggggatgcattatgaaaaggttttcctggagtcaaggggtttttctttctcgctagttttgtgaacaaaatttttatatcaataggcaaatcattataactttttaggggttgatggtttcttaagtatatctggaaattgtggtgtctaaggcatgatgttcagctgaacgacacacaggcgcatcccactttcacgaaacctagccattgcttctgcgctccacactttcatactgctatgctaactcctacgtctccacacaatgtgctcatcttgcacgaccaccaggtctgcctactatacatggaagtctcaaactctgaacttttcatccatctcaatatgaccatttctctctgcttgtcgacgctgcacacagacttcacgtcctctatcctgccacggtcggcgaacatcatcccgcgtctcatcctcttcctgctccactccgcaactctaactctacccacccattcactcaacacgcgtccacgatgctcgactacctaccccgctaccgcttgcgccttcatccattaacagcacatatttcccactacaccactggcttcccactcctggtccctttacctctcactttacctgcagcccaactggtccggcgactcctccgctgcccttcccctgcccctcgctctttccccaagccgcctctccccgcactccccgcggtccctcctccccccggttctccaccccttggctctaccccgcgccccctccggtcgccactctcgccttccccccccctctctctccctcctccctaaacctctacccctctttccccactttgcccaacctcgcaccctcacacaaccccccccggcccaacccccgcccccccaccacccgccaccccaccaccccacccgccccccacgccccgccccccacacccccagcgccccaccacgaccgccagccacccgatgcccccacacaccccccccaccccacccaccccccactcccacccgacacacacgatccccc

SEQ ID NO: 515869 - DNA, 293 bp, Homo sapiens
cattatcaatatatttagtatagttatttttaaactcttccaaacttactaaagaaatgtaagagtcatgttcatcatcataaagattatcgcatggatttttcttataacttgacttgatatttagcatatttttttgtgctaagttatcaaagaatttcaaagttctacatgatttaatttgttgacagtgagaacaataacgtgaattgctttctaatagcttatctttagcatcatctgtatatactgcgactacgccatttgttctgttattctttctatcatccaag

SEQ ID NO: 515870 - DNA, 211 bp, Homo sapiens
  misc_feature (173)..(173): n is a, c, g, or t
tatgcgcatgcggacgccctcgacgccggaaccctcctacgctttagagttccatgcatacttaatgtctcaacgctttatacttcattagctctagaggtccatgcatacttaatattatacttgaattcatacggaagtataaagcgttgaggaagtataaagcgttgagnaagtataagcgtgaggggatcctctaggtcaccgcgca

SEQ ID NO: 515871 - DNA, 370 bp, Homo sapiens
cggccatgctgcatcagtgctgacatgccgggcgcatatcagctgtggctgacgatctcggcgtcggccggcgcttcctgagggtggagatgaagaactgggaggctttcatgggcgtgctgcaaaacgaaggccgggtgaaaacccggccaagtcacgacaaaacggggagaactcttcgggttagcgagggcgctgccgcaatcgcgggccgatgcaataatcgaaccaactatagattcgaggttgattatgctcgaccgtgaaggcttccgccccaacgtcggcatcatcctgctcaaccagcgcaacgaggtgttctggggcaagcgcatcaggacgcattcttggcagttcccgcaagggggca

SEQ ID NO: 515872 - DNA, 967 bp, Homo sapiens
  misc_feature (1)..(1): n is a, c, g, or t
  misc_feature (174)..(174): n is a, c, g, or t
  misc_feature (330)..(330): n is a, c, g, or t
  misc_feature (379)..(379): n is a, c, g, or t
  misc_feature (486)..(486): n is a, c, g, or t
  misc_feature (499)..(499): n is a, c, g, or t
  misc_feature (502)..(502): n is a, c, g, or t
  misc_feature (508)..(508): n is a, c, g, or t
  misc_feature (526)..(526): n is a, c, g, or t
  misc_feature (535)..(535): n is a, c, g, or t
  misc_feature (547)..(547): n is a, c, g, or t
  misc_feature (565)..(566): n is a, c, g, or t
  misc_feature (575)..(575): n is a, c, g, or t
  misc_feature (587)..(587): n is a, c, g, or t
  misc_feature (693)..(693): n is a, c, g, or t
  misc_feature (731)..(731): n is a, c, g, or t
  misc_feature (735)..(735): n is a, c, g, or t
  misc_feature (785)..(785): n is a, c, g, or t
  misc_feature (818)..(818): n is a, c, g, or t
  misc_feature (821)..(822): n is a, c, g, or t
  misc_feature (879)..(880): n is a, c, g, or t
  misc_feature (902)..(902): n is a, c, g, or t
  misc_feature (967)..(967): n is a, c, g, or t
nggccgggcgccccccccccccctcccctcctccccctctcttctttcacttcctaccattaaccatactccctatccttttccgcccataaccacattcacccacttcttatatttcattttcacaaaaccatcattcattccactccgcgtttctccaacaccctataatcnaccgcttttttttcaacattaatcaacaaattcctccatctccaaaactcaccctatcccattcaatacacccaacatcataaaatacaaatctcattaccgtctactcaatcttcacattcattcactacaatacacaccgcgaaacgcgcaaanctttccccttctcaaaccgtctctatcattttttacaacaccttctcanaccctcaaacatctctcactctcctaacaccccttacaaacctattttataccatctatcctcactcacctaccgacttaccaccgaccctccgatccacatggggnaaacatacccctncangatctngttgttattaaagggtgncctttgggnagtctcaaactngtaaccacaaaagggggnncccactgcnattcatactatnatacacacatagctgaactgcctttctaccagtaacatttaaaataaacacacttaatactgccagtcacatgtagtagagtgttcactctgtaactgtgtgtggnaaaccaagatatcctaccattccaataaaaaaaaggcnaggnaatagctttaacacaccattgatgtatgctattacacttttccagtggangataacaaagcccatataaaatttaaagacagnggnnaaactcgattttcagccacttgtacctctctaagttttcatgccctgctatctgggnnacttccccacttccctgccagnagtgctctagctctgcattaaggatcttgttgtccctgactgacacccacatatggaacatttgn

SEQ ID NO: 515873 - DNA, 197 bp, Homo sapiens
  misc_feature (159)..(159): n is a, c, g, or t
acctagtaggatccccctcaacgctttatactatcctctaactgctttatatttctcaacgctttatacttcattagctctagaggtccatgcatacttaatattatacttgaattcatacggaagtataaagcgttgaggaagtataaagcgttgagnaagtataagcgtgaggggatcctctaggtcaccgcgca

SEQ ID NO: 515874 - DNA, 967 bp, Homo sapiens
ggtgctgcatgcagcgtgtcctgcgtgctgcgcagctgtttctggtaactgctttgcctccctggctcccgcaggaggatgctggtggtggagtgtgtgctgaactgtgcctgctccctgtgtgttggtgtgagcctgatgcctgtgtgcatgtgcctctcctgtgtgagctgcctttggtgttgtaggtggtggcctgcactggtagtgctgccctgccccgcgtggccccgccagaactctgctgcctgtggcctccctgctgctgcttgattgccctgaatgaggcgctggctcttggccgagatcggtgcctgtgactctggtcagctgccccgctgtccagactctcgtgcaccacagcctggccctgacatccttcaagcgccagcaagaggagagcttccagtgagcagagcgccttggcagctgaggcccgggagaccctgtcgtcaggatgctccttggagaagattacggagggccaggctgctaagaatgcagaaactagaacatggcttcagtggtgccagctcaatgccagtgagtgccggctcgatgccagtgctgccaaagaggatgagaccagtgatggccaggcttcggggagagcaggaggaagctggcccctcgtcttcccaagcaggagcctcaaatggggtagcccccttgcccagatctgctctccttgtccagcttggccactgccaggcctcgaccggtcaggccaggcacctggacttggcgtgtccagtctaaagactggcccacgcccggcctgcctgcccacgagctgcgctacagtatctacagagaacctgtgggagcgaggcttcttcctccagtgcggctggcaagtcggaggtgacttcctggtctatcctggtgacccctcggatacacgccattatatcgtccatgctgggcctaagaacatccaatcaagactgttgtgtgacgctgaaca

SEQ ID NO: 515875 - DNA, 245 bp, Homo sapiens
gccccctgggtaaggaaaagccttttgaaattttaccttgggccccccccttttagctttttcccccccaatgggggggttattaaccttccattggtgaaaccgtttttggctttccaaaaaccctttttttttagaacccccctaagttttgtgggtggaaaggtggtaaaaatggttttgggtatattaaataagctcctggtttttgggggggggttaataaaagtttaaatttttttcca

SEQ ID NO: 515876 - DNA, 460 bp, Homo sapiens
gaatacatgggtcttcctaaacttaatgcaagattaaaggatgaaactctgcagccattctttgaaggattattaccccgagataatccaagaaacactcggtttgccatcaacttctttacttctataggtcttggaggtttaacggatgaactgcgggagcatctcaaaaataccccaaaggtcattgtggcgcagaaaccagatgttgagcaaaataaatcctccccatcctcttcctcttcagcgtcctcctctcaagagtttgactcatccgccttttattttgacaagcagtgaaaccagttcagagtcttccagtgaaaagagcgcctcttcatccaccagtagtcatagctctgcctcagctaatgatgtaaaaaaaaagggccatgggaagcccaaaagtaaaaaggtagataaattgctcagaaaccagccaccaaatgatagggcccca

SEQ ID NO: 515877 - DNA, 777 bp, Homo sapiens
agcggctcgttgcccagacggaccccagacctctgccaggttcggtccgccatcctcgtcccgtcctccgccggtccctgtcccgatgcccgagggatcctccagtctcctttcagcgccgcgccctccgttcgctccggacaccatggacaagtttaggtggcacgcagcctaggggactctagcctcgtgccgctgagcctggcgcagatcgatttgaatataacctgaccgctttgcaggtgtattccgacgtggagaatacaatgtgtcgtcgtacagcaatctcatcgtgactggaggctcgctgaaccatctggcataggcattatcaattagactaccttgcccacagagtggcccatgcatggacgaaagctctggagcatcgagattctagatgacctagacgacggtaatgggttcagtgagcaagggccacgtggttgattgccccggtatccatcaccaaggtcacatactgtgcagccaaacaagcactaggggggtgtaacgatcctccacatccgagatgacctacccgagtatgcagcagcgatgatcgcttccacatgcttcagctccacctggaagaacgatgtgtacatacagtcactggacctagcccaatggccttttgaattggcacccatgttacccattaactagttgatctaagccggtgatgggcaccccgcgtatgctccacgacctgggagcaattacagacccggaagtcctttgaagaaagtctatccccagccgatgcttactgat

SEQ ID NO: 515878 - DNA, 366 bp, Homo sapiens
tcttggaactccactgtcactgtctgccagtggataatgactggcaacatatgggagtattgatttgagggtcacaaacagatcttaggtgatgggcctatttacgaataccgaatctggctgtaatgaggactgactgtataatgctttaatagtctcaagtatgttttttttctcattaagccggggcttaagatgcaggccagattgatgctgttggtttggtgcaaaagtaattgcagtgcttcccatttaaaagtaatggcacacactgcaattaacttttgctccaacttaatacttggctttattgacttttagcatcagtgcagtttggtttatgataaaattttccaaagcagtgtc

SEQ ID NO: 515879 - DNA, 911 bp, Homo sapiens
caggatgctccctcgctggaagggatccagctgcaaagtgaagtcaaggcgtgtaccagatgacagacggaaagtgacgagagcagtccaccatcagcctccctgctgaatctggggccacagcgtgatcccagctttaaaggagattgcaggagaaaatacggcatcgctagaagccggcaggagtgactcctcggcatggaggacccatctcctagcacacgtgcccaactgaagtggcaccaacagaagtttggcgttgaagctaaaggacattgaaggttggatacttgtaggacataatgttgtagtatgttggaaagaatggtatagtagtgttgacctatgagagttctgatttgatattacaaaggatctaagagtatgttcgttcgttgaagagacttttcgattagtcctcatatatttatctactaaaatagagtgtttaccatgaaacagtgtgttgcttcagactatgtacagaagacaatctggggcaggtactctaatataaaggaacaggtggtgtttctggaataattggcatgctatggttctgtaaaaaccagttaattctattgtggtacaaggtttttggcaaagcacatcaatgttagacctaggtgtaagtggaattgtataaagtcaagttcgagtatattgatgctacatgaggctttccctggaggaaaggttttttttgttgttttttttttaagaacgtgaaacttgtaaactgagatgtctgtagcttttgttgccacatgctgtagtgtagtgtgaagatttcaaaacctgagagcacttgttctattgtttagtatctatgagaaaggcactagatgactatagatctgcacttttgcccattattgctcatttataacacgcgggttgggcatgcggga

SEQ ID NO: 515880 - DNA, 1331 bp, Homo sapiens
  misc_feature (501)..(501): n is a, c, g, or t
  misc_feature (691)..(691): n is a, c, g, or t
agcggcgaatcgccctggactcacgggcgagaaccttgaagctctctgtgatcccaccggtcctgcgtgggacaggccatcgccttgatccgcaccctcagttcctgcacagcgccactccgcccgtaggggccctcgggggaagaccgaaggtctcctctggaccgccagcgtgcccactttcgggagcaccagctgcgacaaactgggcccacgtggagttcgcagccagactcgacccgaggggcacgagccccccatcactgccgcatcgccaagctctggtcatggcccgaggccttatcatcggattcgacgagccggtggtcatctacgctccagcattgccattgcgcttccatgtccccacagcatctgggccatcacatcatctgagcatctgccgaaggcaatcacattgccaagttcggattgggaagtgatttaatgcgagagcatggaagaagatagatgctctcgtatgcggttgtgccactcganatcctcgcagtgggactttcggttctttagggatctcccgatgtaggactcacatcttgtccctttggaagggccaggggtcgcttttctctcacaatgggactatacagtcaatgcgatctcccctcagtctggggtatgtccatcgccaccgtcgaagtccccgggaccgcctcgcggcgatcccccntttgtgaagctagacgattagctagagcttggttggctcagaatttggaaggttcgcaatcgcggatagggcagttagagccccgactgaacaaggtataggtgccccctccccttggcgaagaagtgcattgggagaaaccaccgggcgtcccttagccaatttttccagcgtcgaactctaatacggtatgtaatcgttccacacaacgattcaaggacaacacaaatttggtttgggcaccgcgggttagttttatggaaccaatttcccgccattggaatgaaccttccgatgattttaatcccggaaattttatgcaccactggttcttaccccaaaagagcgccgaggaaaagcggggtacgcggcacattccggcctaggggcgtacatggggtggaagtcccccttgaggttcacagttgaaagtcgggcttttcccaacttgtgcaaatacccccgcgcttccgaggtcgttgaattatccaacaactttttctatatcggtgacgttggctatatttcacttcgtggaacactcaggcaagcatctgttcacaaatggtagtaccatcccaggcgttggatatacctgtttagaccccacatattgttcgcatatttgcctcccacggga

SEQ ID NO: 515881 - DNA, 880 bp, Homo sapiens
aacggtggcgcgcgcggtgccctgtgacacagcgtctttggtgctgactctcaccagtgggccccagggtcttttacgatacaggtttgtcccagagggccatattgattagcgctaacgtgcataataccggttccctcggaggtcaacagtgggaccttccgagccctttggctcacaaggctgcctgcgcaagattctcagaggattgggcgtaaccgttctccagagcttttcgggtacttctcggacacacagactgcgtccccccctcttgggggacaagccttttttctgtctgttgcagcacacccgagccatttgcggctgccccgcccttcatggataaaccttgtgccgcccgcgcgcttgttaccacccggggcatcccgcaccctttggggaaaggccggtggggcctacttccatgtggcccgcggagtttagcacctcccttcggttcaacccccgcgataacgcccgttttgttgatcagggtaggtcgcacatcaccatctttcgggccctatatgcgcgaaccgtgcccagtttgcccctatctacttacgggttgggccccgggaatccccccttcacccgggagcgtggggtttcccccgatgttcagtgatggggacccttctttccactcgccgggcccctgacatgtatcgtcgtcctccgcttatccacctcgagagtgatgtcgcacttccggagttgctctcctttgcggcagcctcacaacgagcggtacaggtacgataggtcactcttaccctctgcaatagggcccttgctggccccaccaagtgcggtgccgaccccccgggcccttcgcgagcccgtgccaccaactcgaacatacattattggcgcc

SEQ ID NO: 515882 - DNA, 363 bp, Homo sapiens
gaggggggtcataataaacagcgatgacagctaggtcgggcgctgacttgagagtgactggatagatgtggcgggttttaggaggctcttatgagtgaagagtattatggcgtcagcaaagggttgtagtaacccgtaggaacctacaacgttggggcctttgcgtaataatatatagcctagaattttacgttcggtaagcattaaggaatgccatagcgattagaatgggtacaatgaggagtaggagagttggaccatggagtactgttgttaagaagcaggaattgaacctctgactgtacaagttttaaagttatatgcgattaccgggctctgccatcttaacaaaccctgcgtacg

SEQ ID NO: 515883 - DNA, 129 bp, Homo sapiens
ggcgtttgccgtgtcacttactggtgaaaaacaaagatgaatcctagggctcagagcactgcagcagatcatttcatattgcttccgtgagtgaccacgcaacactccgggctaccgagctctgaattc

SEQ ID NO: 515884 - DNA, 313 bp, Homo sapiens
ttcccaggcatcaagactgtgagtgcagaacctggagccgttgttctgaagcagtacatcaacaacctcagtgaggcagctggacagcatctgtggggtgaactggggcctgccatggactcagagctagaaaaacatgcaggacctggatggaagacttcaagaacaagtctgaggatgacatcaacaagcgtaccactgctgagcaatgagtttgtgatgctgaagaaggatgtagcatgctagcctacattgaaccaggtgcagctggaggccaaaggtagatgcccatgggaagggtaacgagctcgaa

SEQ ID NO: 515885 - DNA, 145 bp, Homo sapiens
acagaaaacaacaggaagagaattcacatcagctacagccagtggaatcagatatacacagcatgcaactatgcacatgactagggcagaagagaacctagtctattaccaataagcacaggctccctatacagggacaactaaa

SEQ ID NO: 515886 - DNA, 151 bp, Homo sapiens
aactgagcttaacaattacggtcgttgagggctatgccagccccaagcgtcaataggttgaggagtgggtgtcgctgcttgaagtcacgaggagaccacctggtgctcagtgtagcccaggatgcccttcagggggccctccgtacgcctg

SEQ ID NO: 515887 - DNA, 115 bp, Homo sapiens
actgtactctcacaaacagagtgctaccatccaccaacagagtgctacctcctgtattgccaggtgcaatgtggaggttgcccactgtttgtggagtctgtcagtgcagttagca

SEQ ID NO: 515888 - DNA, 172 bp, Homo sapiens
attattcaagcctgagtaaagagcagaacacagagattttccgtgtgttggtttttactctagttccccctctcatcccccttcctcagggtgtcccctaattgcaaggccccattcctgtccccagccccaggtctccttgtgcagtgtcccagcccccagcccagccctt

SEQ ID NO: 515889 - DNA, 980 bp, Homo sapiens
gtgggtctcagcagctctgggctggcgtagatgtgagtggcagcgtggcaaggcagcccagtttcgcgaaggctgtcggcgcgccgctagcccgcagtgcacccggcacgcgccttccccgacaggcaccctggcacgcgccttccccgatcgccacggatgcccaagaggaaggtcagctcctgccgaaggcgccgccaatggaagagcccaagaggagatcggcgcggattgtcagctaaacctcctgcaaaagtggaagcgaagccgaaaaaggcagcagcgaaggcataaatcttcagacaaacaaagtgcaaagcaacagaagggaacacacggggagcaaacgggaaacacagtgccgaagtggctaacgcaagaaacctagaagaagacttacctgcggacaaaaccgggggaaaacggaaagactgaggcagagtccaggcctctgattgaaggcagcgagcaggaaacgaagccgaagtcttgattaactaacccatattaccatagtactatatcgagtggtcccatgttatcccttttcttgtacaaaatcccagaagggaatatttatgtatatcacagcctaattgaggtcaagatgccaaggattacatacaggtaagccgtctagaacaaccatttttctaccgcaaagggcagcggcacttccgcaaccgtcaatcacccagtatgtattataaggctgttacacgtggcattatcgtcactctaaagagcaagctgctggaaacattccagttttgccttgggaataagtaagaaataaagtagatcggggaaacaagagcagagaaaagagattaaggtgggtggaggaattaatttagacaatttaagtggaggaacgggctttcgtatgagattggtattccgtgggattgtcacaggtttaaaaccaattttcgcaacaggaattgggtggggttaaaatatagaataattccgtaata

SEQ ID NO: 515890 - DNA, 171 bp, Homo sapiens
  misc_feature (103)..(103): n is a, c, g, or t
cagacctaaccccacgtggtgtaagcagaggaggaattggttcacttaactcccagcaaacatcctcctgccacttaggaggaaacacctccctatggtaccnatttatagtttctcagtaaccagacagaatcatgtgcctatgccttgtgcccatgcaagatagattgg

SEQ ID NO: 515891 - DNA, 169 bp, Homo sapiens
cggacgtcatctctctcttacaatactgtaagtagagctgctttcaagtctttctcatcaggacacacagagaaaatagtatatgcaaagcccacaagaatacagacatagccaggtgcagtggctcacacctgtcatcccagcaccttggtaggcccgaaggctgtga

SEQ ID NO: 515892 - DNA, 394 bp, Homo sapiens
gcacgagtgaggatactgtggtcgccatgtgccgccgccccgcccgttgttaccgctattgtgagagcaagccgtacccaaagtgtcgcttctgtcgaggtgtccctgatgcgcaagatatcgcatttttgacctgtggcggaaaaaggcgtggatgaatttccgctttgtggccacatggtgtcagatgaatatgaacagctgtgctctgaagccctggaggctgtccgaatttgtgcgcaataagtacatggtagtcattcgcattaacaagatgttggcctgtgctggggctgacaggcttcaaacaggcatgccagggcctttgggccccaaggcactgtggccagggttcacattggccaagttatcatgtgcattcgcaccgctgtag

SEQ ID NO: 515893 - DNA, 1552 bp, Homo sapiens
  misc_feature (1350)..(1350): n is a, c, g, or t
gccggcgcggagcggggacgcggtgcaggctgaggtctccgatgcggctcgccattggcttggccctgcagcaagcaagccccgctttaccgtgcaagccatggccggatgcatgactggcggtcccaggttcctgtgaacagtattggaacgcactttatgagcggcagcacgggaaattggcgtatactcgagagggtcaaagatgcttagaaaaacttttattccaagaagtctgtgcatgaaaggcgagagcgaacagggctcgtggccatgattggtcaagagaagttgacaaatttgtgggagaaaaaggattgacagggagtttacattgcgagaaaggtaattgcatagagaaatcttcgacgaatgcgcgacaaaattctggagacatggcacagacagctggggcggcaagaattccgcgtgcacaaaacccggagaaggagcacacctttccctttcgtggtagcttatcaggggcaggcaccgttggggcctcccaagggcgcccgcgggaggttacactggcccaggggcattatggggcggcgcaaagtgtaagcggaacagcaggcacgacgtgcaggtgcgcattacaattcggaaacgcccaagagttgacgtcttcgaaagggggaattcccctgtgtttcaagaacccggtggcgttgaaaaagccactggggccaggacagcccgggtgccgcggcataccgaagttgaagggccccagaaaaagtctttcccaaaggggaaaatataccagcctacaaaaaagcccaattatcataagcggggacttggtttttggaccttttgcaacaccggggggggcaattggcggccacaaactttgtgggtccccttccttctaggaaatgcatttgttcacgccggaactcgtacccctatggccccgtgtgctcccgcaagtggaacaaaaacgccttttcccggttggcgttatcacaattttcttcacacggggggccaatttgaacacgctataggaccccatcaaggaacgggagaggtatatataaaccgggccggaactccgttcccaccaattttttacaacggcaccacgaagggggcacttataggaaacgggcgggggcctaaccatttgtggagccaacagcaatttgaaggctgtgggaattgcccccttttttttgcacacgggggactccttttgttccggcacaggcaaacaagaccacacccacaacaacacaagggggggcagggcgccggtaccagtaaaaaaaagtataattccccgtgggaggggggggccacccccagaggtattaaatcggcaggtataacccccgagantttctgtggttgatcaaacaaacacggtgggctcccccccatatatatggtgagcggctcgacatttaaataagccttatagggcacgcgcggggaccgcgcgtgttctaaacacacagtgcttggtagacgtggtgaaaccactggtgtatagtgtgtgagaccttcgtggtcgaagagcaaccatactctcttggtgggg

SEQ ID NO: 515894 - DNA, 154 bp, Homo sapiens
ggatggctgttaacccgtcagcgcggagtttgcctcagtaacggcagaggaaaggaggggtctcgggacatctccagaccctaccaactgggagggtcccctcctccttccctactcctgggacggcagcaaggacatgggggctgctgttagc

SEQ ID NO: 515895 - DNA, 731 bp, Homo sapiens
gggcgccggtggcgggagtctggggaaaatggctgcgtcttcgaggtggtgagaaggagaaggagcggctgggaggcggtcagggagtggggtggtggtaacagcgacagcgagaggtcggtagtgtcttggacttgtgggaccatgggaggtcactgatcatagggcacttcatagaagatgctggcgattgtcgaggaaatcatagagtggttaacaggctggagaggaaaaccaggtccgggagctagtttaattcaccgagatggggactttctcagaaactagtgaagacttggtcatcgtaatcagggccaagaattcatcgatgaaatgcaagtgtttagaagaagagaagtagagaagcgagacagtgctattcagtcagctactaaaacagctccaggacgcagaacgaatactggcaacaagcgtgtttacccaaagcgaaggagaaactcaaggtcaatagaaagcatgcaacgaaggaggtgctatctccgtctgaagaaataattaagtatgcacattaggatcaggtgcactgtaagtgctgtgatgtgctccactgatcctgggttccaaggggaccccgcggagaacctagccagatgatttgagagatgagaacgtgggtaacctgggtcaagatgaacaatcccttccacctaatggcgtgaatgcgccattacccaggagatgctcttgcagcaggaaagattgcggaatgc

SEQ ID NO: 515896 - DNA, 481 bp, Homo sapiens
  misc_feature (60)..(60): n is a, c, g, or t
  misc_feature (276)..(276): n is a, c, g, or t
  misc_feature (298)..(298): n is a, c, g, or t
  misc_feature (355)..(355): n is a, c, g, or t
  misc_feature (357)..(358): n is a, c, g, or t
  misc_feature (360)..(361): n is a, c, g, or t
  misc_feature (444)..(444): n is a, c, g, or t
  misc_feature (448)..(448): n is a, c, g, or t
ggttaaattttggtatttttagtaggagacaggttttaccaatattggtcaggctggtcntgaaactcctgacctttgtgatctgcccaaccttggcctcccaaaaagtgctgggattacaaagtgtaagccactgcgcctgtcctccctcaaggaagatttcaagtaaagtggatgccaagactttagcagggacagagaccagagaccagcccagagacacctgtcccttcaccccacactgcccaaatggggagcccgggcagcaagcttgcncagcaccccgtgtgcctggagntgggacctttgcttctgggcctcggaacggttaacacccctggctctcctcccctcncnncnnctgggcctttgacccctcccagcctctctccttccctccaccgacacctttgcccagtgacgttggtctgtccttacgcaganctgncggaggctggggctcttccggggctgccatgtt

SEQ ID NO: 515897 - DNA, 177 bp, Homo sapiens
gctgtcaggcggcgcgttggcgaccctgggacggtgtgccgcagcagatcgaccaccggccagccaggccgcggccacgcatgttgtccagcgccgccgcgttcacgatgtgtcgctgtcccggcccgcagcacggagaggaacgcctcgcgcgacttggacgtgccggtccggaag

SEQ ID NO: 515898 - DNA, 289 bp, Homo sapiens
agcgggaggctgaggcaggataattgctggaacccgggaggcggaggttgaatagagcaaagattgtgccactgtgctctaacctgggtcacaagagcgaaactccgtcttaataataacagcaacaaaaataacccaggagtggctcaagagtccagagtgggatgaaaatataaacagaggaagacaacttatgtcactggggaggctgggggagctatacaaaattcacactggaggggcagggattgaaacaatatgggcccctgggtctggccaaactttggga

SEQ ID NO: 515899 - DNA, 751 bp, Homo sapiens
gctctacaaggcgcctctgtcgaagagcctgtctgctggtccccagtgccctctccctcctgctcgccctcctcctgcctcactgccagaagctcttgtgtatgaccttcacgcagtcaagaacgagcttccagagttggaggttgatatgtggaagaataatttgtctgtgattatgaaagatacgtttctagcagtgagctctggcgttgatttgataattgttaggatatttgaaagaagatatggagagcggagagaaagtttgcatcgctgttgtgcgtgggttccgtgggtgttgtcaagccttatttgactatctcctcatggaagctatgcagtatatctttgggatcactgacagactagtaattatgccttctggattcctggcacctgtgtatgctctgtcttgtaccaatttaacatgctgccataccaagagtccagagtggagacaaattctgggtccgttgtccatcacgaaacaagacattgatttatatatggggactgcaggtttgtcatcctctggttcctacatactggattgtagccataagtggacttatgtccggtctgtgctacgacagacaaaatgttccaggtgcatcaggtgctctgaatccccaggtggatggcaaaattcttttctctggacacttgaacccatcttctcttctgcagaagccaccagcgaagccagaattgggatgggagccacgctggacatccagagacgagcagagaa

SEQ ID NO: 515900 - DNA, 205 bp, Homo sapiens
  misc_feature (10)..(10): n is a, c, g, or t
  misc_feature (18)..(18): n is a, c, g, or t
  misc_feature (20)..(21): n is a, c, g, or t
  misc_feature (26)..(26): n is a, c, g, or t
  misc_feature (48)..(48): n is a, c, g, or t
  misc_feature (64)..(64): n is a, c, g, or t
  misc_feature (80)..(80): n is a, c, g, or t
  misc_feature (130)..(130): n is a, c, g, or t
  misc_feature (152)..(152): n is a, c, g, or t
  misc_feature (174)..(174): n is a, c, g, or t
taaataaaancaggtatncnnttganggtagggaagggttggaaaaanggaaaagcaataaaanctgcccaattcacatnagttatccgtctgcttttttttgaaagcttggggaaggggttaacggggntggaaacatcaacaccttggcntgcatgaatgttaagccagganggccagcgaccaccttgatagcttcttcact

SEQ ID NO: 515901 - DNA, 658 bp, Homo sapiens
  misc_feature (5)..(5): n is a, c, g, or t
  misc_feature (142)..(142): n is a, c, g, or t
  misc_feature (156)..(156): n is a, c, g, or t
  misc_feature (167)..(167): n is a, c, g, or t
  misc_feature (173)..(173): n is a, c, g, or t
  misc_feature (175)..(175): n is a, c, g, or t
  misc_feature (226)..(226): n is a, c, g, or t
  misc_feature (242)..(242): n is a, c, g, or t
  misc_feature (253)..(253): n is a, c, g, or t
  misc_feature (443)..(443): n is a, c, g, or t
  misc_feature (445)..(445): n is a, c, g, or t
  misc_feature (488)..(488): n is a, c, g, or t
  misc_feature (493)..(494): n is a, c, g, or t
agcgnagtgtcgctgcctcttcgcacagcccgggtttccgcttccctccgggcgcgagaagaggggagccaggccgagccccggccctaccgccgccgccgccatgtggcccccagaccccgacccgaccctggtaacccgnagcctgccggcggntcccgtcccgngccccngnggtccccgggctccgagccactgcttgccggcgcgggcttttccatctgcntctctcaaaggccgcnctcctgctggnccgagtcgggtctcttcattcatcacttttatctgctatgtggcgtcctcagcatctgccttcctcacagcgcctctgctggagttcctgctggccttgtacttcctctttgctgatgccatgcagactgaatgacaagtggcagggcttgtgctggcccatgatggacttcctgcgctgtgtcaccgcngncctcatctactttgctatctccatcacggacatcgcaagtacntcgcnntggggctatccaaagccgcatggaggcagtcggcatccttgataccatcgtgtatgccactgactgtctacccagatcttcaacgacgtgcgccacactccgtcacacacgggagactctgcccgctgagcacccaaagcccaccaagacacgaagcaaccagc

SEQ ID NO: 515902 - DNA, 612 bp, Homo sapiens
  misc_feature (5)..(5): n is a, c, g, or t
  misc_feature (397)..(397): n is a, c, g, or t
  misc_feature (399)..(399): n is a, c, g, or t
  misc_feature (442)..(442): n is a, c, g, or t
  misc_feature (447)..(448): n is a, c, g, or t
agcgnagtgtcgctgcctcttcgcacagcccgggtttccgcttccctccgggcgcgagaagaggggagccaggccgagccccggccctaccgccgccgccgccatgtggcccccagaccccgacccgacaggaccgagctgccggggtccgtccggcccgggcccgggctcggctgtgcggcgcgttctctgccccaagcgcctgtggcgagtcgggtctcttcattcatcacttttatctgctatgtggcgtcctcagcatctgccttcctcacagcgcctctgctggagttcctgctggccttgtacttcctctttgctgatgccatgcagactgaatgacaagtggcagggcttgtgctggcccatgatggacttcctgcgctgtgtcaccgcngncctcatctactttgctatctccatcacggacatcgcaagtacntcgcnntggggctatccaaagccgcatggaggcagtcggcatccttgataccatcgtgtatgccactgactgtctacccagatcttcaacgacgtgcgccacactccgtcacacacgggagactctgcccgctgagcacccaaagcccaccaagacacgaagcaaccagc

SEQ ID NO: 515903 - DNA, 140 bp, Homo sapiens
ttcattttgttcgtagccatacacgatccccatagcctgtgtcgcccagattcttgtgtcgccatcgacttcctcctgatgctcctttttgaggagagctaggtctttattctgttcttcaatttgactctcctccatct

SEQ ID NO: 515904 - DNA, 852 bp, Homo sapiens
tcgtttccgcgatgctgactctgctagctgcatgcaggtgccccgtgtgctgggctcctccgtcgccggactccgagctgccagagcccgactcacctttccggcagttcctgaagcctggcaccccggactgtgcacccggacctatcgggctgtatcagcgtgcagcgcaggttccgagcggcggcagggcctcctgcggtctctcggacacctgccgcttgtggctgtgagcttgctggcatctgcgtgcaccaccgacgagtagacaaatgcttttgttgagtttaccatgactgatgaaatcaatggaggaaagacaaacatacaggaagcataaaaccctccctaagatgtctggaggttgggagctggaactgaatgggacagaagcgaaattagtgcggaaagttgccggggcaaaaaatcacggtcactttcaacattaacaagcagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcagttatccagaggattgaggttggacaagaagacgaggttgagagtgacatctttctctatcagggaagttagctttcagcgccactgggggcgaagatctgaatggaaggatactaattatacactcaaacacagaattccttggactgtgccttatatgacccacctaaatggatttcctttgccgaccgagggggtggaccacccttttgcagatgacctggtggaactcagacaggcctggacgac

SEQ ID NO: 515905 - DNA, 182 bp, Homo sapiens
atgctaacccagctttggtagtgagacacgcataatcagatgaacaagttgacggctgttttgcaggtcagcatgttgggttaggacagttgtcagcactggcaggctatgacctagaatggcgagaagacagccaggtacgagcagtcagcccgagacaggacgagaccctccttgagatt

SEQ ID NO: 515906 - DNA, 406 bp, Homo sapiens
  misc_feature (39)..(39): n is a, c, g, or t
  misc_feature (41)..(42): n is a, c, g, or t
  misc_feature (47)..(48): n is a, c, g, or t
  misc_feature (54)..(58): n is a, c, g, or t
  misc_feature (61)..(61): n is a, c, g, or t
  misc_feature (75)..(75): n is a, c, g, or t
  misc_feature (143)..(143): n is a, c, g, or t
  misc_feature (145)..(145): n is a, c, g, or t
agcacccctgtctgtacatagtgctgctgtcctgcgacntnncagcnnggaggnnnnngancagtggtgggggcncctagaggtcagttcttcaagagggcgaggcagaggcagaggtgaatgtggtttctaccaaagaagtntngatgaagtagagggtgtttttggtcgaggaggtggcagagaactgcatagatcgcagagctgggaggaaaggggtgacagacgttttgaaaaaccaggacgaaaagatgtagggagaccaaatttagaggaaggtggaccaacatcagtagggagaaagcatgactttatacgctcagaacgtgcaaattggcgcatctttagagaggaacaaactggagccgatgacgctggcggttggcgactagctgaatcatctcaa

SEQ ID NO: 515907 - DNA, 146 bp, Homo sapiens
ctgtccccattcttccagtcctcggctgccacgcgcagtatgctggtcaccgcgaaggtggtggtgccctgcttgggctcctgccgtgatgcccaagtcaggtacttctcgcaggccagttcctgtgacccctgtagccagcgaac

SEQ ID NO: 515908 - DNA, 877 bp, Homo sapiens
gcgcgtggggttcaatatgaagaccaagccgcccttctagaaagtcaccaacaaacggggggcgcccacaaggcggttgaaagcccccctgggtgcccctagacggatcctatgaaccacgacacgcccagcaaagggggggggggcgtgccttcttcgacaatgggtcccgtcgcccccgaagctacttgcgccgaccatagaagatagttggttgtgccccccccgcccacaagagcgcccggccctgctcctagtcgcaacgagtagaagggaggctggtgggtcaagtcgtgtcagagggcacacaaatatcgcggggatggcgcttccttcctcgaatagtaggcctgatggtgcggaacgctctctcccagccgtcagacatccgcaaccagtggggtcccccccttatcggggtgagatgtgtcgtgtgtctcccctttagagacagcggctgcaaacatgtgtggccctcgaactctcgctctcgaaggaatggggtaattcccactctcccctttatttgaggtgcagtgtacgacgatatatgcgagacacaccctgttgggtttaccacacagtgggagcgttggtgaaaagctcctgcggtgagaggtaccatcttataggaggatgatttgaggcaccgccggcccctttgagtacacaatacatagttggttgcccgcgtacagcagcgcgagcgttacaaaaaaacacggggtagaagacccccccttctattgtgtctatgttatataaataaggttcttagaccgcccctccgggtaccttttccacagggttatacttcagcgccgtgtgcgcacccggggcaaaccgccttccaaagttactcctccaaacatagaca

SEQ ID NO: 515909 - DNA, 113 bp, Homo sapiens
gccatggctgggaccaattgactcatgaactctaagaaatgtccatactaatgaaagaggtaaattaacaggagagagggtgggcatggtggctcacacctgtaatcccagca

SEQ ID NO: 515910 - DNA, 100 bp, Homo sapiens
gctgtgttagtgttttttccctctcctgtcttgttgttgaaggagtaaactaagggtgtccatgccccattccctctctactcttggcagcaggttgagt

SEQ ID NO: 515911 - DNA, 158 bp, Homo sapiens
ttcctatactatgtcggttaaaagccttcatagaatataggcaccaaaaataaactaaccccacaccctcaccaaccaaaggaggcacaatccaacgaaactgatgaaaagtcgaggtaacgactctgcagaccgtactcatttctaaaccaaaagtc

SEQ ID NO: 515912 - DNA, 179 bp, Homo sapiens
  misc_feature (95)..(95): n is a, c, g, or t
ggatgatatgaaagagcagtatgacgacggtgatagacaatatgcacatttttgcttaacatttttccatttctaaaccatccttaaaggaacanatccatatatggggtcacaccatcctcaacggtagtccaatagagcaaccatgcatcggatcgtttcacataagaacggtagtt

SEQ ID NO: 515913 - DNA, 430 bp, Homo sapiens
  misc_feature (12)..(12): n is a, c, g, or t
  misc_feature (21)..(22): n is a, c, g, or t
  misc_feature (33)..(34): n is a, c, g, or t
  misc_feature (56)..(56): n is a, c, g, or t
  misc_feature (69)..(69): n is a, c, g, or t
  misc_feature (108)..(108): n is a, c, g, or t
ttaagtgaaatngttgtaggnnggtgggggggnnagatttcacaaccaagggcaantttgttcggaacncggcgccgcagctgccggggaggcacaccccccaaaccncgcagaacaaaccacaaccctttaaaagatcaaacgctcccctcacaacagaccaccgcacaccaacaaagaaaaagaaagagagaaggaaagaaagacctgaagagaaagaaataaccagattttagctcaaagagtatagcctgggattaattttttaagatttgtttgccaattttttttttctcagccggggaataaagagcttaatacagggatacaaaaaggaagccctcgagatgttttcaccaggatgaaatgggattagctttgtagttcctataatcttcttcacagaagaatgcaatttcagtttcactgg

SEQ ID NO: 515914 - DNA, 828 bp, Homo sapiens
tcgctctctcccttgggagggccctgtcggttattatttggcgcgccctttttgtgtatattttttgagagcccgttttgttgcaaaaggtgggaaatgtcttttgtggtgataaagaaggggggttttcctcccccgtgggttttcccccgggggcacaaccccgcttcgttggggaagttataaaattttgccccccctccccccctcttttattgtgaaatttttagcttttctcccccccgtttagttcccccaagtgttttctaccccatgctccccccaagagtgtgttcccgccgcgaaatacaatatggtcaaacgcgcttccccaatttctccctcaatagaagaagaataagtatctgttcccccccagagtccacaccacttgggctttttcccacaccccccccccattacacctcctctccggagaaaattcttcccctccctataaatctaatattaaagaactcctcccctttccgtgtgttcttttccaattatgtgcgccccgcaacaaccacctgtcgtacgatatttccacacaatcctcccctctgtcggggagaaatcatctttctaggcgactctcacgggataaagaagaggggcaatattcttcttcccctccctctctaacagggcgcgccccactccttggtacaataaaataatagaaaaataccccttttaacccacatttcccttaataaagaatatataggcggttaaaaagggggggataaaaagcccctttggcaatgcccccacacttatgacaccacacgcttatttatccggcacaacaataaacagaacaaa

SEQ ID NO: 515915 - DNA, 471 bp, Homo sapiens
tggagatgtggtcatcgaagcttttgcaacaaatagccgagctgacacaggatgtgctaaacaattgacaccgctgagcatcagagaagaaactgacacatgagaccaaatctggctagagagggcatatgtcactatgctggagtgcagttcctcggagagtctgtgagctggactgatcagaatggctggagcaccgatctgtatagtcaccaaggagaggggctgacagatgaacagtgtcagcacaggtaatgctgattcgatgagtgtagatacatgatcatgatgcattactggtacaagatgcactgagcaatcgcgagtacgctatgcataccctaagccaggccatcgtaattgatccctggtacgctctctgctgatttgacagtgcctctagctgaggtgcgcatccccagcattagccacgatcaggatcttgaggtagttacatgttgtataggtttg

SEQ ID NO: 515916 - DNA, 394 bp, Homo sapiens
ttggaacactcagacatgaggtataagaaccgtgtcggatgcagtatctccggcactgaaggatgccaagaagccctgacctgcagacgtaaatgtggtgtgatggtgtacataataacccagctgttcggtgtgatgatctcagaggacatgggcagggatgagctgcaggagatccgtaatggcatgaccaatgaggccctctgagagcaccagatggcccgcagtggtggctggcagacagatctgtgtcacctgcggcaagtgcaggaaaaagaactgcacctacacacaggtgcagacccgcagctctgatgagcccatgaccaccttcgttgtctgcaacgagtgtggaaaccgctggaagttctgctgacccctcgtgtagatgtgc

SEQ ID NO: 515917 - DNA, 2948 bp, Homo sapiens
aattcgggcacgagggtcctccctccgcagcagccgagccggacctgcctccccgggcgtgctccgccggccccgccgccggcccgcagcgacagacaggcgctccccgcagctccgcacgggacccaggccgccggaccccagcgccggaccaccgtccgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgggagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttca

SEQ ID NO: 515918 - DNA, 891 bp, Homo sapiens
ggagagtgtatatcatcttgtggatgtggtctaaatacttaggttagtggtgtattgtgctcccaggagctagctgtcccctatgtactctaacaatgcaggatagcatgtcgcagaggacgccgtatatacggaagacctgcgtcactctacggcttctacatgggacgcctaaggatgactagatgatgtcatgatgggcaggctgtgctccagacacagtttatgtgaggagttgtcgttcatgcacaagtagggctgcacatgccaacataggagcgtgtgggttcatcctgatgggagcctagctgtgctgatgcctgttggtggcatctgaagcaatcgaacgccaagtgataacttcaggtggtctccgtcgcgaccattgaacatgagcctctccgttatgctacgtgcttcatgtgtgacaagtcatggccagggcaaactgctatgagtactcagtgaggtaattcctcatttaggtttaattgtgacagctttcatgtattgatggtaacaagtgaatcagagtagtttacttttataccagtggttctccctaagtcccatacatcgttttgggggaggcgaccctaagacagagtaaacatcatggaccattgttttccgcatattttaatgctcttcaaggaagcatttaagagtaataccccgcaggaaattaattgacaactgagtagctgttaatctaaccacgaggactcgaatgatggcccgagctatgtgcagaaatggacagggcactttagagggccatctgtgtcgataattcacctccattcattagcatggggaagccagtacttaacatcatggaccttttgtgaacgaaagaggaggtacgaattcgctaagaataggcctgaa

SEQ ID NO: 515919 - DNA, 3196 bp, Homo sapiens
aattcgggcacgagggtcctccctccgcagcagccgagccggacctgcctccccgggcgtgctccgccggccccgccgccggcccgcagcgacagacaggcgctccccgcagctccgcacgggacccaggccgccggaccccagcgccggaccaccgtccgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgggagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacgtaacggagcaccacccttccacccaaccccaccatcagctgtcccggccaaatgagctcctccccagaccccagacaccctgcggcccaggccactccccagtgttcgggctcgctgggaggctctgacggggtcggggggcctctgccttggaagaccagcgccatccactcggccccagcccctccccatggagccctggctactgtcctgcgtggtccttcactgcccactctcctgttctttcaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttca

SEQ ID NO: 515920 - DNA, 859 bp, Homo sapiens
  misc_feature (18)..(18): n is a, c, g, or t
  misc_feature (67)..(67): n is a, c, g, or t
  misc_feature (72)..(75): n is a, c, g, or t
  misc_feature (77)..(77): n is a, c, g, or t
  misc_feature (82)..(82): n is a, c, g, or t
  misc_feature (89)..(89): n is a, c, g, or t
  misc_feature (94)..(98): n is a, c, g, or t
  misc_feature (102)..(102): n is a, c, g, or t
  misc_feature (104)..(104): n is a, c, g, or t
  misc_feature (106)..(106): n is a, c, g, or t
  misc_feature (109)..(109): n is a, c, g, or t
  misc_feature (120)..(120): n is a, c, g, or t
  misc_feature (137)..(137): n is a, c, g, or t
  misc_feature (144)..(144): n is a, c, g, or t
  misc_feature (168)..(168): n is a, c, g, or t
  misc_feature (171)..(171): n is a, c, g, or t
  misc_feature (175)..(175): n is a, c, g, or t
  misc_feature (177)..(177): n is a, c, g, or t
  misc_feature (197)..(197): n is a, c, g, or t
  misc_feature (203)..(203): n is a, c, g, or t
  misc_feature (206)..(206): n is a, c, g, or t
  misc_feature (211)..(211): n is a, c, g, or t
  misc_feature (215)..(216): n is a, c, g, or t
  misc_feature (219)..(219): n is a, c, g, or t
  misc_feature (221)..(221): n is a, c, g, or t
  misc_feature (225)..(225): n is a, c, g, or t
  misc_feature (247)..(247): n is a, c, g, or t
  misc_feature (263)..(263): n is a, c, g, or t
  misc_feature (268)..(268): n is a, c, g, or t
  misc_feature (273)..(273): n is a, c, g, or t
  misc_feature (335)..(335): n is a, c, g, or t
  misc_feature (567)..(567): n is a, c, g, or t
  misc_feature (592)..(592): n is a, c, g, or t
  misc_feature (728)..(728): n is a, c, g, or t
  misc_feature (837)..(837): n is a, c, g, or t
tactttaaaatgtcttancatattgaatggagcatacgctacaatttatccatccttatttatatanaaaannnnantctcnctctganacccnnnnnggantncngtngcgccatttcngctcacagctgcctctncccaggntcaagggatcctcctacctcagcntcncggntngctgggaccacaggggtgcnccaccnggnccggntatnnttntntttntttttggtagagacggggtttnatcatgttggccaggntggtnccgancgcctgagctcaaccgatccgcccgcctcagcctcccaacgtgctgggattataggcatganccaccacgcccggcctatccatccttattcatattatgtaggaatcagagctctccataatgtccactattataaatgaacagcataattcccttggtcataacttccattccaaattcttgctcagctctcggccccgtgtgacacctgggggtaagaaccaactacgtatgcgctcagaaactcacctggggtctcctaggctgccgtagactgagtaccaggggcctangcagagggagcaaccgagagaaganaaggcaagaccaggcccagccccttcatcggccctcgccagatcactctctctcaaggggtcaggattcagactttcgtgtttctctccaaatctgaagtttacaaaagtagccgagctgctcatcagggatatgnagtctgctttctgcagcagagaacagaagtgaaagggagaagggatgagcaagaaagtctctggatttcaggagaagggagacagccccaagggcaggaggaacacttntgaagggtccattgaagagaca

SEQ ID NO: 515921 - DNA, 3219 bp, Homo sapiens
  misc_feature (2954)..(2954): n is a, c, g, or t
  misc_feature (3219)..(3219): n is a, c, g, or t
aattcgggcacgagggtcctccctccgcagcagccgagccggacctgcctccccgggcgtgctccgccggccccgccgccggcccgcagcgacagacaggcgctccccgcagctccgcacgggacccaggccgccggaccccagcgccggaccaccgtccgtccgccccgaggagtttgccgcctgccggagcacctgcgcacagatggagctggaccaccggaccagcggcgggctccacgcctaccccgggccgcggggcgggcaggtggccaagcccaacgtgatcctgcagatcgggaagtgccgggccgagatgctggagcacgtgcggcggacgcaccggcacctgctggccgaggtgtccaagcaggtggagcgcgagctgaaggggctgcaccggtcggtcgggaagctggagagcaacctggacggctacgtgcccacgagcgactcgcagcgctggaagaagtccatcaaggcctgcctgtgccgctgccaggagaccatcgccaacctggagcgctgggtcaagcgcgagatgcacgtgtggcgcgaggtgttctaccgcctggagcgctgggccgaccgcctggagtccacgggcggcaagtacccggtgggcagcgagtcagcccgccacaccgtttccgtgggcgtggggggtcccgagagctactgccacgaggcagacggctacgactacaccgtcagcccctacgccatcaccccgcccccagccgctggcgagctgcccgggcaggagcccgccgaggcccagcagtaccagccgtgggtccccggcgaggacgggcagcccagccccggcgtggacacgcagatcttcgaggaccctcgagagttcctgagccacctagaggagtacttgcggcaggtgggcggctctgaggagtactggctgtcccagatccagaatcacatgaacgggccggccaagaagtggtgggagttcaagcagggctccgtgaagaactgggtggagttcaagaaggagttcctgcagtacagcgagggcacgctgtcccgagaggccatccagcgggagctggacctgccgcagaagcagggcgagccgctggaccagttcctgtggcgcaagcgggacctgtaccagacgctctacgtggacgcggacgaggaggagatcatccagtacgtggtgggcaccctgcagcccaagctcaagcgtttcctgcgccaccccctgcccaagaccctggagcagctcatccagaggggcatggaggtgcaggatgacctggagcaggcggccgagccggccggcccccacctcccggtggaggatgaggcggagaccctcacgcccgcccccaacagcgagtccgtggccagtgaccggacccagcccgagtagagggcatcccggagcccccagcctgcccactacatccagcctgtggctttgcccaccaggacttttgagctggggctgactcctgcaggggaagccctggtccagctgggtgccccctcgagctccgggcggactcgcacacactcgtgtcatccagatgtgagcaccgcacccagcggcaaagagccctcccccctgcagggctccacccatcaccctccctccgtctgtctttccggcctggaccccaccctccacactctcaggccatcacagaacaccccagcttcctcattctgctacaacacccaggccctctggacatccagaaaaccaagtgtccggatggcaggggccagcggccaccaagctcatgggacacccagagcagaagctagggcagagccaatgctgagggagcctcgacttccggcgccgccgccctctcccggcatccgcagagccagctgacgccctccctgcctcccagggcagctggccagcctcgggcagcgcggccccctcctcccaggggagagtagaagtcgcacacgcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttcaaaaaanaaaaaatcagggctaatgtgggggggaaagggtaaaggggcagggccaacgggggccggcccctctttggcaaagggggagacccggccccaagggggcgaaaccgagtcggccatgagcggtacaggacgcagaagaagaagaagaagaaagacgaaagaaagagaagaaacagcgcagaaagaagcaggagacgagcagagaggacagacaataagctgagaagataacaaacaagcgcgaagacagagcgctctgcgcgggn

SEQ ID NO: 515922 - DNA, 286 bp, Homo sapiens
tccgatctactacgcggctgatctgtgggtgggtgatgggagaagtcaggttttgagctgttagtattggatttggaaagtatagcaggagtggccgaaagaagggtggttacggagaatgaagaaatgcctgacctattaggaatctcaggaccatttctcattgcgatggctgaaggttgtctaagtttctaagtatattgaaatcgaaagtgccgttatcgggccattgctagccattgtccaattggtattgaggccatgcagtagccgcgtagtcagatcg

SEQ ID NO: 515923 - DNA, 1102 bp, Homo sapiens
actcaactgacctcacacagagacagatggacagacactcgaggacaagcgacagagaacccctcctcacacaggaggagaataaaaagatcagacaacaacagcagcagagcagacctgatgtcccggtgcttcctggcccctcagctccagtgattcacgcccgcctggagaagaatcagagctcagctcatgactcacccatggcaggcggagggtcccagaggggctgagtcctcaaatccggctgaggcagcagctggcaccatcagagccaggagagtgacaacaggtctcaaggttcccacaaagtctttgctgctgtgctgggcaccacccacccctcaccttgcaggctgcctgcgtgggaggcgaagtcccaggacagcccagaggggggctacagagaggagtcggctgcagcagagggcaggagccccagcttagccctgagcgccagcgcgaggaccagggcctgccactaagcccgccccgctggccgccagctgcccgtccccagagccactgcagcaggagtcgggccctgcctccctcccagcagggaaaccccgcccgctgccaggccatcctctctgccagaggctttcatgagccccaaggctggggccacagctcctacccctgcccagcagccctgagctcagctgcaggaaggacatcccagaagccatggctcctggggcgcttccaggcattctgccctgccccgacaccagaaccctggtgctggtgggccactagcgtctgcagcctaagcaggtgctggctcagggttcatcgttctgccttgtccactgggggaccagccctgcagaccactctgacaagtcttcagcccacaccctgccagccccacagattttatttttgcacataagccataaccaatcctcaaggctggcacaggctttggggaagccctggagcctgtgaagaccctggaaacctcatgaggctgtggccaacccctgccccttgccccacacagaccaggccttaaatgtcggtccaggccctgtgcaccttaccccagagacagactctttttgtaagattttgttaataaaacactgaaacttca

SEQ ID NO: 515924 - DNA, 337 bp, Homo sapiens
  misc_feature (120)..(120): n is a, c, g, or t
  misc_feature (288)..(288): n is a, c, g, or t
gcccaggctggagtgcagtggcataatctcagctcattgcaacctccgcctcccaggttcaagtgattctcctgcctcagcctcccgagtagctgggattacaggtgcgtgccaccacgnctggctaatttttttgaatttttagtagagatggggtttcaccgtgttagccagggtggtctctatctcctgaccacgtgatccgcccgccgtggcctcccacagtgctaggattacaggtgtgagtcaccgtgcctgggcaaattatactctttgtcctggatgaanccataatctatcttcattctatctatctattatactaaactctacatgg

SEQ ID NO: 515925 - DNA, 980 bp, Homo sapiens
gggagccacacaggtttccccgataccggcttcttttgactaccaagccctgttcctcccctcttctgcttagttagtggccacttcccttcttcacacgtaccactctggatggttcctctgtggggttgaagacttaatataagtgtagatgtgaccactgtcatcactatgtttcgattgagtgttgctggtccacatagtgtgggagtggccccaacaagtttgtgtacaccaggcttgtgcctaaacgaaacggcgctgcttattctctgtcttcaaccaaaggtactgatacaaaggggataacattttccctggtgaccacgtgtcaggcaaatacattaatacacagggccctcttcttacgcccctcggggggcgccccctaaagagaggcgtctccccgaaacggccggcgaagacatgtgctcccgcagaccgtcttctctaaaacagacaagatatagctggtccccccccccccagatccgtggtgggcgttacaaaaatccccccccccgctgcgatacataaaaaccaagtggaggagacccgcctgtaggggcgctccaagcagcgccccccgacaacttcgccccgctcgctgctgtcgtgatcgatcacaacccggagctcgcttcagctagcgcggcacgcaaccagaacgggtgggcgcgtatttgctcttctctagatgagtgccgcggctccacccactaacacaatcaaattatgtcgccgttccccagatataataggctgaaccaaaccattggtcgccgcagcaaggactgaatagagcgagttataaatgggacagccgccccgggccaccatttgtgcaacagagcaaaccaggacttctctccccattccctcgctggcttgttatatctatactgttcgggagatcgccctccttcgaaacaaaagaagtactttcgtgggaccaaaaaaaaaacgcctccccaaaaaac

SEQ ID NO: 515926 - DNA, 504 bp, Homo sapiens
ccagttactacgctgagagtcggaggcactcttgtgccagaggtatggtgcccataggatggagcaggcagtgcaagcaggagggtcttctaaggaggcaactggggacttcttaactgactgattgttttggatatttggggtctcaagcacctccaccaggtctttccaggatgctaagaaaaatgaaaggctcttacctccctccttgaacctatctcacccattctgagaaaggcctcaccgtgtaattgggatttcctggctggatacgtagttcggccaaaatccaaatgccgttagtaagcttcagggattggtacagcatgtcttgcccttccacattcctcttggcaatagtataaacattgttgttttgcaacttgctggaaacagtgtctagaaacacagattcaaagttcaacacctttagttaaaataccaaacaaatgtaccatgagccatgtgtgcccaagtagctgttgtaactgggggtaccgagct

SEQ ID NO: 515927 - DNA, 374 bp, Homo sapiens
acacggagagaaattcctcttgaaagcatcatgagaaaaacaacacatgatctatcacggaacaataattcatatgactactgatttctcataaaccaccactggaggccagaagacactgaaacaacctctttgaaatgctggggcgggggggagaactgtccactgaaaattctgtatccagctagagtatcttgcagagatcaaggataactaaagacattttcagaagaaggaaaactaaaagaacttattaccagcagacttgcactaagagaaatgctgaaggaagttctttacacggaagggaaaaagagtaatacatattatactaacactattcacaaacgtaaccctagcctccccactcgtac

SEQ ID NO: 515928 - DNA, 293 bp, Homo sapiens
ctgcccggcgcggccacgcgtgcaggtcgatgtccttggtttcgcgggtccagcgcaggccggtggtgatgctcaagggctcgctgacctgccaggtggtgctgccgaagattgcgaaactgtcggtggtctggtcaatcgaggtcttgccgtaatcggcgacgccgaacgcctggttgtagtcggccgggagcaaggcactgctggaagcgctgtccaggtgttcgtggaacaggtgggtaccgacgatccagctcaccgcctggttcttcgccgaggacaggcgcagttcc

SEQ ID NO: 515929 - DNA, 172 bp, Homo sapiens
cacaactctgaaatccaaatgctccaaagtctgaaactttttgagtgccaacatgacactcaaaggaaatgcttattaggagcatcgcagactcaggtgtttgaattcgagatgctcaaccgagtaagcaatagtgcaatatattacagaaatctgagaacacagtcccaag

SEQ ID NO: 515930 - DNA, 359 bp, Homo sapiens
  misc_feature (73)..(73): n is a, c, g, or t
ctcccactcgccccctccccagtgttcccttatcagttatgtcagctcttttcttttaagtgctcaggactanaaccatggactcttccatgactcttcattttcataaactacatccaattctcagaaaatcctagtaactttactggggggaaaaattgtaacctacatacttcctacccttcccctgctaatccctcagccaggcaatcactaattcttgtcttgtctatgagagcaatttctcttcttccattcttgcctcccctacctttggttaaatgtaagtcagaccatgcactcttctgcttagtgtctgccatgccataccatcaccctgaaaataaaaaccatttgag

SEQ ID NO: 515931 - DNA, 420 bp, Homo sapiens
caagcagttaatacatgacccaggtcaagaacctggtctccgggcgtggtggctcctgtctgtaatcccagtactttgggaggcaaggcaggtagatcacctgaggtcaggagttcgagaccagcctggccaacatggagaaaccccgtatctaccaaaaatacaaaaactaatcgggcgtggtggcacggggcatacagtcccagctacatgggaggccgaggcaggagaatcacctgaactgggaggcagaggtttgcagcgagccgagatcgcaccactgcactccagcctgggtgacagagcgagactctgtctcagaaaaaaaaaacagtggctagagtggccctatggctatttacctgatcttagaggaaaagcattcagctgtccaccgtaaaagtctgtattacctgcttg

SEQ ID NO: 515932 - DNA, 104 bp, Homo sapiens
agactggccgcagattgtatataatgatgtcacgtgatcgattccccatgtattttctgtcgcaggatccacatgatatttagtgtcatactccttagctcttg

SEQ ID NO: 515933 - DNA, 117 bp, Homo sapiens
gcagatcatcaccgagctgcactacagcctggtcaacagagcagggactccatctcaaaaaaagtgactgctatagatggaacaaagcaaatacacaagtagaggagcaccaccaat

SEQ ID NO: 515934 - DNA, 509 bp, Homo sapiens
acgagttaggacccagctggggctctccttggagttcttccatcccccaggggtacctcaggacccagggctgcaaacacaggctggggctgcaagggctcctgccccattctcagccttccttccctctccttgtctcatgttgaccggagggtaggggtctgtccctggtcttcctgggagggtttgtacacatatattgctactggggggatccatttatttttattgggggggggtatacaacaaggtgcgaacgggctgccggggactaattttgacttgcactgccattttgaggggagaagaaacaattaggggcaaacattaaaaaaagcaattttttgcagacccaaaggataattttaaaaaatggcaaatttctaaaagacacatcttttggaaaaaagaaaaagaagtgggcaggcgcaaggggtcaagcctggaaacccaagcactttggggagggccgaggcgggcggggtaacgaggggcaagaaaagggaaaa

SEQ ID NO: 515935 - DNA, 827 bp, Homo sapiens
  misc_feature (145)..(145): n is a, c, g, or t
  misc_feature (363)..(363): n is a, c, g, or t
gggagcgcagtgcagcgcagccgcgggagccgaggagcgcgcgagccggcatggcaagtcagtttccaaacagttcataatgaggtcctgaagggcccaaaatgagtccgggcagaagcacggtgtccccccgagtgaagctctngaagaactcaaacgggaggctcaacagagtatcctggaggccgtggccaagcaacggaggatcctcaagcaaccagccgggagtccagccggtggccccaggtgtgggggggagaaccttgggcattggcattccataatgatccagaccagggaaaagggagggtggttgcataagcatggcgtccaggcgaccacatcaaagcaacgtataaattntcccaggaaggcgttggttttcacccttcgggggacctggacccacctttcagcgggccatggtttatggcaaagacaccacccaaagaaagttattgcggcgtggagaggaaacgggcgtcccggcaatggttgacgggggtccctctttttggtgggtgggcccagattaatttcccccaggcggggggaaagtggggtgtgtcccaaagttagagcggggttttcttgtcaggaaaggaaaaaaaagcggttctgtggccgcggccggaagagaactgttaccggttgggtctacacgcggtttaagggggagacagggggggggcaggacctttaacagcaacggggtggacttttgaaggtggggcctaagaaaccaccaaaaaatctggggtgggggatgtttggtccccgtggtgggagtggagatggtgccgtagagtaggtgagatgcctttgtg

SEQ ID NO: 515936 - DNA, 607 bp, Homo sapiens
cgtttaggacccccccagcctctgacagccactaatttgtctttatacagtcacctattctggacattcatataaatgaaaacatacaatgtgttcttttgtgactgattttttcacttagcataatttttcagggttcgtctatattgcatcatgcatcagtacaacttctgttcttggtacttttttttggtatatttcatgatactgccaacacccagataattgtgttattgtcccactgttgttggaaaggatagaagtccgaaaagaatcatcatctatctaagtacttctgctactaagtaccataagaacctgccataaacattttattcccacatgtatttcttgcccttatcagtcctgacaatgggtaatcatgaaggctgaatgatgagtgatttgctttaatttaatggggtataggatgattgacttggaaaacagttctgtcctacttgaaggcatatgatggtttgctctggatttaaaaactgaaggatatgagacttcagttgtaagagtgaactttgtgtcgagaaattaggttaatgtttaataatgtatttaatgctgagtaaagttatataggaagacatttcaa

SEQ ID NO: 515937 - DNA, 878 bp, Homo sapiens
cgcagtggctcaagactgtaatctgggaggccaaggcaggcggatcatgaagtcaggagtttgagaccaacctggcaaaaatggtaaaacccatccctactaaatatacaaaaaattagcagggcgtggtggcgcgcacctgtagtcccagctactcgggaggctgaggcaggagaatcgcttgaaaccgggaggcggaggttgcagtgagctgagatcgcgccactgcactccagcctggacaacagagcaagactccatctcaaaaaaaaaaaaagggttaggaaatttcttggcctcttttataaatccccccattttttgccggttctaattggtccaccaccaacaccattcaaacgggaggggctcaacggggagaaaggaatgtggccctaaaacggggaacacgatcccggaattaaggtggtaattccagggcccatttctcagtgctaaatattattaataccgtgcattcccaagtagactgggaacaaattactcccgaaaatctttacaatttattcaattcattcaataccttatttcccccctcatagtctaaccagaacagctggtctggctttctacaatctcccggcagggtacatcaattgttcctttggaaccttggaggaggtgataattaggcagagcgaccctattcagttgtgggtcattaaccctcttggggggagcgacacggcagaattttgtgcctttcactccttaacacaggcccctggggaatcctggaactttaatcccaagaaatttcgggtacccagtcccattgactcatgtgggcaggttacacgctccacatttggacgtaaatccgttttaagacccggagtttcggcaacagggagaag

SEQ ID NO: 515938 - DNA, 844 bp, Homo sapiens
  misc_feature (233)..(233): n is a, c, g, or t
  misc_feature (396)..(396): n is a, c, g, or t
  misc_feature (408)..(408): n is a, c, g, or t
  misc_feature (414)..(414): n is a, c, g, or t
  misc_feature (426)..(426): n is a, c, g, or t
  misc_feature (435)..(435): n is a, c, g, or t
  misc_feature (462)..(462): n is a, c, g, or t
  misc_feature (468)..(468): n is a, c, g, or t
  misc_feature (488)..(488): n is a, c, g, or t
  misc_feature (501)..(501): n is a, c, g, or t
  misc_feature (517)..(517): n is a, c, g, or t
  misc_feature (523)..(523): n is a, c, g, or t
  misc_feature (529)..(529): n is a, c, g, or t
  misc_feature (537)..(538): n is a, c, g, or t
  misc_feature (541)..(541): n is a, c, g, or t
  misc_feature (546)..(546): n is a, c, g, or t
  misc_feature (556)..(556): n is a, c, g, or t
  misc_feature (561)..(561): n is a, c, g, or t
  misc_feature (570)..(570): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (591)..(591): n is a, c, g, or t
  misc_feature (597)..(597): n is a, c, g, or t
  misc_feature (609)..(609): n is a, c, g, or t
  misc_feature (616)..(616): n is a, c, g, or t
  misc_feature (632)..(632): n is a, c, g, or t
  misc_feature (641)..(641): n is a, c, g, or t
  misc_feature (658)..(658): n is a, c, g, or t
  misc_feature (770)..(770): n is a, c, g, or t
  misc_feature (834)..(834): n is a, c, g, or t
aagcagtggtatcaacgcagagttgccattatggccggggagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttnggctcttctgctgctgctgccccggcagcgcaggtctgagtggcccagatggcaaccactgcagctggcgtggctgtgggctctgctgtggggcacacattgggtcacgccattactgggggcttcagtggaggaagtaatgctgaggcctgcgaaggcctgngatcactgaccnggggcntcagggggcccngcgggcgcngcggcggcggcgttgcctcgtgtgagngcaggncggtttctggggtgtgcgcngggcgcagggtgncatcgaggctctgtgngggttncaatgnggtgctgnnacngtgcncgacttgcanacggnttggcctantgangangtncancctggggngatggnaaatcagctctnataactnagttaattagtataanaatagaatngatagtgagggtataangtgtaccatcagtaaaacctctcctgtcattcctagcttccttgcttcagaattgaaatggaagtgggggtgtccctactctgtagaatctgggactgggcaaatgtttgtntggcctccttaaactagctgtaatgtaatgattttattctttgtgagtaaattagaataaagtnattttcttcc

SEQ ID NO: 515939 - DNA, 867 bp, Homo sapiens
  misc_feature (233)..(233): n is a, c, g, or t
  misc_feature (540)..(540): n is a, c, g, or t
  misc_feature (546)..(546): n is a, c, g, or t
  misc_feature (552)..(552): n is a, c, g, or t
  misc_feature (560)..(561): n is a, c, g, or t
  misc_feature (564)..(564): n is a, c, g, or t
  misc_feature (569)..(569): n is a, c, g, or t
  misc_feature (579)..(579): n is a, c, g, or t
  misc_feature (584)..(584): n is a, c, g, or t
  misc_feature (593)..(593): n is a, c, g, or t
  misc_feature (597)..(597): n is a, c, g, or t
  misc_feature (600)..(600): n is a, c, g, or t
  misc_feature (603)..(603): n is a, c, g, or t
  misc_feature (606)..(606): n is a, c, g, or t
  misc_feature (614)..(614): n is a, c, g, or t
  misc_feature (620)..(620): n is a, c, g, or t
  misc_feature (632)..(632): n is a, c, g, or t
  misc_feature (639)..(639): n is a, c, g, or t
  misc_feature (655)..(655): n is a, c, g, or t
  misc_feature (664)..(664): n is a, c, g, or t
  misc_feature (681)..(681): n is a, c, g, or t
  misc_feature (793)..(793): n is a, c, g, or t
  misc_feature (857)..(857): n is a, c, g, or t
aagcagtggtatcaacgcagagttgccattatggccggggagaagtcgcttagctcttcggtggttgtcacacgtccggaggcctagccgtcgcgtacctaggatgccgcgtggaagccgaagccgcacctcccgcatggcccctccggccagccgggcccctcagatgagagctgcacccaggccagcaccagtcgctcagccaccagcagcggcacccccatctgcagttnggctcttctgctgctgctgccccggcagcgcaggtctgagtggcccagatggcaaccactgcagctggcgtggctgtgggctctgctgtggggcacacattgggtcacgccattactgggggcttcagtggaggaagtaatgctgaggcctgcgaaggcctggacatccacttttaacccaagaagcctccaaggtaacccacaggcacgagacacgagagagagagaagagctcgtgctctcatatagatctacaacacagtctcctggagtgtgcccagaaccaggtgaccatcaagctctgtgngggttncaatgnggtgctgnnacngtgcncgacttgcanacggnttggcctantgangangtncancctggggngatggnaaatcagctctnataactnagttaattagtataanaatagaatngatagtgagggtataangtgtaccatcagtaaaacctctcctgtcattcctagcttccttgcttcagaattgaaatggaagtgggggtgtccctactctgtagaatctgggactgggcaaatgtttgtntggcctccttaaactagctgtaatgtaatgattttattctttgtgagtaaattagaataaagtnattttcttcc

SEQ ID NO: 515940 - DNA, 468 bp, Homo sapiens
aaggacctccaaagtcacacaaagtgcctgctcctggtcccctcagctctgcctctgcagccactggctgcccagtgccatcaggatgagcagtcccgggcaagcataatgacagaaagaaggagacttcggggaagccctgactgtgcagagctaaggacacagtggagattctcttggcactctgaggtctctgtggcaggcctggtcaggctctccatgaggttagaaaggccaggtagtgttccagcagggtggtggccaagccaaccccatgattgatgtgtacgattcactcctttgagtctttgaatggcaactcagccccctgaactgaagaaagccagccctagcctctagggtgacctagagccgccttcagatgtgacccgagtaactttcaactgatgaacaaatctgcaccctacttcagatttcagtgggcattcacagcaacccccaaaccag

SEQ ID NO: 515941 - DNA, 379 bp, Homo sapiens
gtcaaccgcagtgcagcttgcattctgctggccgtactctacaggtatcccctgcggacccctatcctgccaaattccccccatttctttctgcttcaccctccctcttttgctataagggatcggcttaggcgcctttgtggtgttcattctccatgtcccgtacagcctgttactgcagtttctccaagtcccacggtccgtgcagtctactcccttttttgaaccgagcggtacctggcgcgaagtctgagccttctcctgaagtgggttgatttgtcccagggtcatcaccgcttgagggtggcctaagccagatctcacgtcacagagctggctctcctccatttgcctccctcgctcttgcctcctgtaggcc

SEQ ID NO: 515942 - DNA, 745 bp, Homo sapiens
  misc_feature (19)..(19): n is a, c, g, or t
  misc_feature (31)..(31): n is a, c, g, or t
  misc_feature (34)..(34): n is a, c, g, or t
  misc_feature (45)..(45): n is a, c, g, or t
  misc_feature (57)..(57): n is a, c, g, or t
  misc_feature (70)..(70): n is a, c, g, or t
  misc_feature (73)..(73): n is a, c, g, or t
  misc_feature (77)..(77): n is a, c, g, or t
  misc_feature (92)..(92): n is a, c, g, or t
  misc_feature (100)..(100): n is a, c, g, or t
  misc_feature (110)..(110): n is a, c, g, or t
  misc_feature (155)..(155): n is a, c, g, or t
  misc_feature (165)..(165): n is a, c, g, or t
  misc_feature (169)..(169): n is a, c, g, or t
  misc_feature (173)..(173): n is a, c, g, or t
  misc_feature (187)..(187): n is a, c, g, or t
  misc_feature (191)..(191): n is a, c, g, or t
  misc_feature (213)..(213): n is a, c, g, or t
  misc_feature (237)..(237): n is a, c, g, or t
  misc_feature (252)..(252): n is a, c, g, or t
  misc_feature (254)..(254): n is a, c, g, or t
  misc_feature (258)..(258): n is a, c, g, or t
  misc_feature (261)..(261): n is a, c, g, or t
  misc_feature (325)..(325): n is a, c, g, or t
  misc_feature (332)..(332): n is a, c, g, or t
  misc_feature (337)..(337): n is a, c, g, or t
  misc_feature (359)..(359): n is a, c, g, or t
  misc_feature (375)..(375): n is a, c, g, or t
  misc_feature (408)..(408): n is a, c, g, or t
  misc_feature (450)..(450): n is a, c, g, or t
  misc_feature (452)..(452): n is a, c, g, or t
  misc_feature (578)..(578): n is a, c, g, or t
  misc_feature (624)..(624): n is a, c, g, or t
  misc_feature (626)..(626): n is a, c, g, or t
  misc_feature (633)..(633): n is a, c, g, or t
  misc_feature (636)..(636): n is a, c, g, or t
  misc_feature (641)..(641): n is a, c, g, or t
  misc_feature (649)..(649): n is a, c, g, or t
  misc_feature (662)..(662): n is a, c, g, or t
  misc_feature (680)..(680): n is a, c, g, or t
  misc_feature (740)..(740): n is a, c, g, or t
tgaggggggaggggggggngatctttattgnggnggggggggggnggggggttcccncgtgagccctggngcnaaanagagccggccgtccnccaggggngagcgggggnggcttctgcggttctggagtcccggcgatggcgccagtcccccancaaacccccnccanagcngcccccggatgcanaaanaaggagggggcttgggagtaanttgaggctgtgacggggtcgcccncggtgtgggcaagtnantccnctntggccaaaaggtcaaattcgtccctgaggctgagtcgaacacaaacccgtggccctcaaaaaantaaacanaaaancacaaaaatggcgcaaccaaanagcattggcttcaaanaggcaggacacggggcccctcgtgtgacctgtnactttccacaaagggcaaggacctggcactgactccggccantngagaaggctgttcgcccacccggccataactcaaacccaaaggctgaaacacaaacggggccgcaggcagcagcccccgggctctcgtgaaaacttcagaaggaaaaaaacctaaggaacagaatnctgaatggagaaaacccaacttttttaaaaaagaaggaagtgtatnangggaatntanggggngggttttntttaagaggtganaacttggaatcttgcaanccctgggagtggactccggcggcggcgcaaagtgggagcagggagcgtcctcgggccacntgcct

SEQ ID NO: 515943 - DNA, 160 bp, Homo sapiens
ggagaagtttgatatcacagaggagatcatgtctggggcccgcactgcctccatcccacccctcgccagacggaggcggctcgagcctcaagcgaatggggagacgccccaggttgctgccatcgtccggccagactaccgttcacattcatcaatcatt

SEQ ID NO: 515944 - DNA, 379 bp, Homo sapiens
  misc_feature (162)..(162): n is a, c, g, or t
  misc_feature (192)..(192): n is a, c, g, or t
aaccggctgctctcgaggatccctcgaaagaggaagggtggtccggagtattgggacggggagacacggaaatgtgaaggcccactcacagactcaccgagtggacctggggaccctgcgctggtactacaaacaagaagcgaggcccggttctcacaccgntccagatggatgtactggctgcgacgtagnggtcggactaggcgcttcctcctgcgggtaccaccagtacgccgtacgacggctagtgattacatctgccctgacaagaggacctgcgctctatggacccgcggtcggactattggcagcttcagaacctaccaaggcacaaagtagggaaggcggccccatgttggcggacgcagtttgagaagcc

SEQ ID NO: 515945 - DNA, 481 bp, Homo sapiens
  misc_feature (7)..(7): n is a, c, g, or t
  misc_feature (13)..(13): n is a, c, g, or t
  misc_feature (110)..(110): n is a, c, g, or t
tttcctnctcgtnccctgcctcaatccggaaactcctgtcagatgttgggcccttttgggatagattctgtgaagtcccttcctttctaccctttgcttggtaagataanactttccttgaatcccaaacacacacactctctctgctttttaaaaaattagttttggggctggatgtagtggcttacacctgtagtccccaggcactttgggaggccgaggcaggcagatcgcttgaggtcaggagttccagaccagcctggccaacgtggtgaaaccctgtctctactaaaaatacaaaaagtagctgaatgtggtggtgtgcacctgtagtcccggctgctcaggaggctgaggcaggagactggcttgaacccgggtggcagaggttgcagtgagccgaaatcacaccactgtactccagcctggtgacagagccagactctgttttaaaataaataaaaataaaaaattggttttg

SEQ ID NO: 515946 - DNA, 339 bp, Homo sapiens
gagttcttcctgtccaatcaatttttcgttccaacttattaataccgggcaagatccctctttctcatgatttcagcaagacacttgtgttcacaagcggggtactgacctcacctgtgggcggctccacgcacttggcgggtataataggcttcgttgccctgggtcacagcccgtgccaggcatgtgggccgccacaacttcagcattttacccggcacgcagcacttggcccggcccaacactacacgtttggaggctgcagccccaacacccgccccagggcccgggcgggccttctccagaacatggcgacataccgccgtctaacactgagga

SEQ ID NO: 515947 - DNA, 579 bp, Homo sapiens
  misc_feature (65)..(65): n is a, c, g, or t
  misc_feature (327)..(327): n is a, c, g, or t
  misc_feature (333)..(333): n is a, c, g, or t
caggggacatgtcaacgtgcaaaactcacgtttttgctaccagaagaattccctggtcacccagnccggcagttgcccaagatctgatacaaggtcggggtgtctatgcaaaggaagctcagttttcttttattatgagctgcttgtttgagtggtgtaaaactatgtgctcttcaatatagtgctaaagaagccagctaattttatcaaagcagcagccaaagaagtcaggccaaatcttcaggacttgtgaaatgaactgaaagagcttgaagcagatggaattttaatagttacactatatatgctcttagtaggtttttttcntgtagnggaaacataactgttagcatatttcttaggatgttttttcttgtctttttaaattcttatttcactcatcctttactctcccctcaagtattctacactttaatttcctgaaataaatttaaggaaaagggaaatagtaaagaagtaggaatgggtgcagcacaccagcatggcacatgaatacacatgtaactaacctgcacattgtgcacatgtaccctaaaacttaaagttttattattatta

SEQ ID NO: 515948 - DNA, 977 bp, Homo sapiens
agcctaaggcctggtccacgattccataatgtaccacaacagatagtcaagaagcggccactggaccttcatccagcgaggagcagcatggcaagactgcgggctgacgccaacacgaaaatacagatgcaaagccagtgagacaacgggaaggttctatccgaactgcatccagatctttcattgagcctcatgaacgacacactgacacatctcgcaaaaatacctatgacgacaccacggttaattcggaactactagtaacgagctgtacataacgaccacgacaactcgcaccagactctggatatgtggaggtacggcctttgtcatgtattttacacaaaccgataaaaagagtcgttacaaaatacacttccacatacacgtgcgacaagtaatacatcccacaagtgaactaaattaacattggcgtcaaacattggattggacagtctacatacagaggcacctggaaaaaaacggtaagcattgacaatcacaaacaggttagtcaatacgttccgtaccagctgcatgttaggagacaaaccaacaatacccgtgtgacaaagagaatcacgttccttgtggaggagcaagaagaacaaacaagacgctaagatacggagaccacaggacgttcaacatggtgaaacctataaatggaaaaccctaacgcatagtccgttacttaccaccggacccataacagtaataaacagctggtcgccaagcacgtctactatggttcacaacaaaagtacaaatatagacaagaacacaaatagaggaagagaagaacacgacccatgacaaatacgagaccgattaaaaagaaaaccccagccgagaatacacgcaaataaacataggaaggaaagagtccaaagaaaggacataagaagaagaggaaaaaagaaaacgcgcccgaagaaagacacaaagacggacacagtaaaaagggacagaaaaaa

SEQ ID NO: 515949 - DNA, 224 bp, Homo sapiens
  misc_feature (68)..(68): n is a, c, g, or t
tctctggtctcccagagacctgccaggggtagtgccccactcggagggaaggtggggaggtgacccanacctgtgtactatttacagaagcctttattggggagaggtcagagttcatggatcacagggaggtgcaaataaagagttctgaggatgctgctgcggcggggacttgtggaggaggctgcatccctgccaggttgtacggaagccgcttttgtgtt

SEQ ID NO: 515950 - DNA, 797 bp, Homo sapiens
gggggccggatccccggatggcctggtctctggacctggagtactaccactcgcacgatgccaaggttcaggtgctcccaaagagcgccctgcggagcgtctcacccgctcccccatcctagtggccaccagctcgacagacagggtctggggagtcttcaggagcctcgggggagcaaggaccatctgtgcagcacgggatgcaagccttcggtccccaaaggctgcatgcccctggcggccgcctccagttcgtcctcttccagcggtgtcttgggtgaccggtgctcatgtgagctatgatcggttgcgttcaggaacttaatgccactcgaggtcggaacgatcgacagatgagaatcgattgtcgtcagttccctaaggtctgatgccaacggtggcttcgaggagaggcatgaagggaggaccagtcgtgagaggatacacgaaaaggagtccatgactctcctgtccagcctcctgtctcctggcctcccggaaggcttcgtgcgtctcagaccgctctggaggctggatagactgatgagtctcactctctgacttccgcgttcaaaatcgatcttccagccctcgtgggccagtctcagccaccggtgtgtgagctccacgaaatgagggctcgaccatcagccacacaggagctcgactggcaagggcagctagacaccatgctgtgggctgctgctagtgccgatctcagccgcggggtgttcccaccaggcaaaggcctctgtggctctgcaataagctattgtgtgcacctggtgacggtctgg

SEQ ID NO: 515951 - DNA, 987 bp, Homo sapiens
  misc_feature (102)..(102): n is a, c, g, or t
  misc_feature (130)..(130): n is a, c, g, or t
  misc_feature (135)..(136): n is a, c, g, or t
  misc_feature (146)..(146): n is a, c, g, or t
  misc_feature (158)..(159): n is a, c, g, or t
  misc_feature (252)..(252): n is a, c, g, or t
  misc_feature (258)..(258): n is a, c, g, or t
  misc_feature (269)..(269): n is a, c, g, or t
  misc_feature (295)..(296): n is a, c, g, or t
  misc_feature (310)..(311): n is a, c, g, or t
  misc_feature (346)..(346): n is a, c, g, or t
  misc_feature (349)..(350): n is a, c, g, or t
  misc_feature (363)..(363): n is a, c, g, or t
  misc_feature (406)..(406): n is a, c, g, or t
  misc_feature (416)..(417): n is a, c, g, or t
  misc_feature (429)..(429): n is a, c, g, or t
  misc_feature (441)..(441): n is a, c, g, or t
  misc_feature (443)..(443): n is a, c, g, or t
  misc_feature (449)..(449): n is a, c, g, or t
  misc_feature (454)..(454): n is a, c, g, or t
  misc_feature (464)..(465): n is a, c, g, or t
  misc_feature (476)..(478): n is a, c, g, or t
  misc_feature (510)..(510): n is a, c, g, or t
  misc_feature (518)..(518): n is a, c, g, or t
  misc_feature (522)..(522): n is a, c, g, or t
  misc_feature (533)..(533): n is a, c, g, or t
  misc_feature (539)..(539): n is a, c, g, or t
  misc_feature (544)..(544): n is a, c, g, or t
  misc_feature (553)..(553): n is a, c, g, or t
gcgggctggaacggtgtctccttcacttcgccctccagctgctgcagctgcagcccgaccgcgagcgtgccaagcggcttcagcagctagcggagcggtggnggcggccccctcaggacaccaccagatnccccnncttcccgcgngctcgccatggnngaccacggacagacttgcgcgcgtccaatgtgtattcctccatcatatgctgaccttggcaaagctgccagagatattttcaacaaaggattnggtttngggtcggtaanactggatgtgaaaacaaagtcttgcnngtggcgtggaattnncaacgtccggttcatctaatacagacactggtcangtnnctgggcacttggngaccaaatacaagtggtgtgagtatggtctgactttcacaganacacgtgganncactgataacantctgggaacagnanatcgcnattgnagaccagatnngtcaacggctnnnacacctgacactcgatactaccttctcaccanacacaggnccanacacgtggtanaatcangtctncttacaagnggggaagtgggtattaccacactttgagtaagtgccctggttccgcacatccgcatcactgcctgtggaaccctggcgaagtcgccaatgagacacacagccagggccacatcagcgatgaatgcacgggcctggccttagctgtgcctaccagcaactgagccacaggacccgcaggccgacaacccacaaagcgatgcacacaaggcgaaattaaccgtctacggacagccgtcacgacctaacccggtgaaacatgcgtggcccgatccccaaccgctagccacccccccaagtgttcacccgggcctggataacagcaaccttagggagctgaatacacgtgtagatcagccaacaagcttaggcgaacagacaccctgggaccaactctcggaaccaccccttggactgtgcgctcactcactggctcc

SEQ ID NO: 515952 - DNA, 869 bp, Homo sapiens
ttcgtgagtgatggcgtcccgggttgcttgccggtgtctggccgccgtcgggtagagcccggggcagagcatgaggtgctcattcagcagctgttggcccggaaggattgtgtggtcccgttcctgatcccggcctaaggtccctgtcttgcagctggatagcgggcaacataccatctttctccgactagttgcgaatcctgcctggatatttatgttcctggtttagtctaggctgtggagcaatgaatgaccttcgacgtaacccaggtggcatggaaatgcgcaaagcgacgagagcttgcagcccagctatgtcatgctggcccatgttacttaattgcagtggtccaaggcaagaaggcgggacaggatgtgctttggttcagtgcgggaagagcccttgattcactactggacgcaggagcttgagtctgtcagaaaatgtccatttccttggctggggagacatgaatctctagccgacatagtttggtggggagcccgtaatacccaattactgcaaagagtcccgccataccttgcctgagcgagctgaggtgccctgtgacagcatggttccagacacttgagtacctcaggaacccaatgtcaggcgagctgcatgcaaactgtagcgtgaaaacagacaacggtgtcctggcgtctccggggcgttaccgtccaaaaagcaagtgcgcagcccaagccgcgcatgaagtgaagggctgtcaaacgaatgagcctgaagaggaggacgctggtaaccctatttgaaggaagagattgcatagggtgtaatggtttggaaaaaggccaaaaggttgcccccctggagcccaaaaatcagttgcgaggcgaaaaaattt

SEQ ID NO: 515953 - DNA, 112 bp, Homo sapiens
cccgaccgctacgggggaagagttcattgacaaaagtgtcctaccaagactggtttacaccaagcagagaggacatgtcacgtgaattttgaaagggaacccgcgcagccag

SEQ ID NO: 515954 - DNA, 227 bp, Homo sapiens
cggcacgaggcagactgtcattcatgttgacctgatgaaattaacaccctccttgacctccgtaagggtaatgtaagtagaaatttgactgaagctcctacttcctttcacagcctttcgttgtgtgggcttgtcactcttcagtacatttctagtggggaagagcagggcgacccctgtgctgggtttctccttgaatgtgaagcaaaataaatttatgttgtgga

SEQ ID NO: 515955 - DNA, 880 bp, Homo sapiens
  misc_feature (517)..(517): n is a, c, g, or t
atggcagaatgggtaaaaatccaccaaccaagtatctgctgtcttcaagagactcacctaacatgtaaggactcccataaacttaaagtggtggaaaaagatattccatgcaaatggaaaccaaaagtatgcagagtcgttattcttatatcacaaaacaaatctcaataaatttaagaaaataaaaattacatcaagtactttctcagaccacaatgaaataaaatttcaaattaactccaaaggtaccctcaaaactatacaaatacatggaaattaaataatgtgctcctgaatgatctttgggtcaacaatacagtcaagatggaaattaaaacattctttgaactgagcaataatagtgacctatcaaaacctctgagatacagcaaaagtggcgctaagaggaaagttcatagccttaaatgcctacatcaaaaagtctgaaagagcacaaacagacaatttaaggtcacacctcaaggaacttagagaaacaagaacaaacaaaaccaanacaagagaagaaaagaaataccaagatcagagcagaattaaatgaaactgaaatgaacaaaaaaataccaaaagatagatgaaaaaaaagctggttcttttaaaagataaacaaattgataggccactagtggaaatttaaccaagaaactaagagagaaaaaaccaaaattaagctccaatggggaaactggactttgggaaacaccaaaaccaggtatggtacctggttcttacaaattggcagattaaaccaatggacacgaatttgagaacccagaaacaaaggtcaaacactttcaatcagctgatcctcaaaaaacaaaaaacttaagtaggggcaaggccctttttccccaatggt

SEQ ID NO: 515956 - DNA, 261 bp, Homo sapiens
gacatacatgagggatgctttaatactggaagacaatgctgacttagcttataacacagtcccgagagacggtgtacaaaacggtatttagaaagatcatttttaaaaaaagcaacaggaccggtttcttctttagttacaatccatgaggctctctagggcctctccgtgtggccagcacagcaaccctgctaggagcacaaacggctggcctgagatctggcccagctgccttgcccactggtctgcaaggaacccacg

SEQ ID NO: 515957 - DNA, 360 bp, Homo sapiens
ggatgctttaaaacattcttgcttaccttcctagatcagtggtcagttcctagttttaagttacttacttgaagccctccgaagtggcaaagactttatctgctaaatctgccttggcacacatgtgctcactgatgccatggcacggcttccggacatgcacttagatctttgtgcctaggggcaggtcatggagctaaacaattaaagaactcttcattcatggataggcaccatcataggcatctctggtatttagggtcagtggtattaaattgacaattctaatttatttcagtcagtatatgtagcaagtcagtatgtaagtaagtagtttatagtactccatccagtaggtaa

SEQ ID NO: 515958 - DNA, 1028 bp, Homo sapiens
cgtgtagctgagcaggctggggcttggttctatgtccctgtggctatgtttccagtgtgcgctgggtgtttccaagagcaacaagaaacgaataaatctctgatgaagagataccatttgacattttagagatggctgcatgcaaactcttaaaacatttgaatggagattcactcttgttgcccaggctggagtgcaatggacaatattcggctctccacaatctctgccatcccagattacaagctattctcctgcacatctgtctcccaaggagctgggattacaggctggtgtgcaatggtgcgacttctgcatcactacaccttccaccttccgggattcaagccataactcctgccctcagactccggagtaagatgggactacaggcatgtgccaccatgcccggtaattttagtattaaataggtagaggcagggattcagcaacaattggtacaggctggatctcgaaactcctggcctcaaagatgatctgcccgaacatctgacctcccaaagtgctgggaaatacaggacatgagcaaccgcaaccggctggattagttgacaaatttacttcctgtagattgtcaatataattactatatgttatctataagatgcgcacatatactcacatgggtatggaagtatatacacaagagaggatcagggcgcattagcagattatccacataggggagcaataatcttggttacgtacgatgacacaactattgcaagagataacgtgaaacgaccatgacacaggcgatatcaaaatgtcacaaggacgcctgcgtcgtaacatggcaaagtgggtcccactggcacggggtagagagaacatggacgcagcagaggcggaagaaaaaaggagaaaagccaacatacacaaaacgagcgaaacaaaaacacggaggacaaagaaggtaagaggtggcacaacagacaaacacgcaaaagaccgaacaacacaacaaacgacaaagaagacacacgacacgaagagcaagacacaag

SEQ ID NO: 515959 - DNA, 127 bp, Homo sapiens
gtcgactctatagatcccccatccaagactgaggaagctgaaaacactgataacctccttggtaccatcaaccatataacaactgaagatccccaagattactctcacctcatttacgatgaggaga

SEQ ID NO: 515960 - DNA, 1013 bp, Homo sapiens
accctgcaacttgtacgcaggaaattgcctgccaccctgaatggagccctgactaactaagggacgtgctgccatcaccaaattgttatgcaggaaacttacccttgttagtaaacgaaaatagagtatacttcaggatctgggcaacagagaatcgtcgtcgccacgttgacgacatatcagttacggaaattacgccactgtagtgacgaatgagagtacgtccaatatagtgacgcatagtgcaaccaggctccacacgacactagtgttgcgaggcaaatgcaggtaagcgaaactgtagttcattccccgacttcacgttagtgcaggttagaactataaaagctataagttcagggatcgactgagttcgacccaatctaggcatatactaggtattgaacaccgtatgtaaactcctgtcgaggcatattgcctaagaattctgagagacgagtgccgattgtcatgaaatcctgaaatccggtgatcggcagatcagatactcggtatagaattccaaaggattgttattacacatgaattgcctcagacatttttcagaggttcacgattggcacttaaatgaagctaaaggcttaagtgaagagacccgggtgaaccgtctgaatgccaatcgggttcacagacagaaatgctacgctaagacgacaacgagccagttgcggcaggaacatcgacaaacgggagtacaattgcggtgctgagctctgcgtgcaaaatcaaacccattggagaggtgtcagacgcatggggacttagctctgactccccaaggaggactcatatttatgttgcccccgtggctttaccagtgaatttgttaaacggagaactgaacctagggtcaaacaaggggcacggtctcgcatacttgcatggaatgggtcccgatgaacataacccatcaccgtatggttcccgcagcaatagtaaagcacataaaaacacccccaaacacacataaaacccaacacgcgtaaccaaat

SEQ ID NO: 515961 - DNA, 223 bp, Homo sapiens
  misc_feature (77)..(77): n is a, c, g, or t
aactgtgtgctttaggagtcattgaacaaaaaacatagctctgagacactaggtttctggggtagacaactacaaanctacagctgctgcgtgctgggatcgacatttgtggctataccaacctggtaccgtcgtctcgtttagctgtgcgcgataacactctgaggccaagtctctgattaaccacattccccggtaacacgttcaagaccacatttctttt

SEQ ID NO: 515962 - DNA, 118 bp, Homo sapiens
tattgtgcaggactcatgtgtgccagcagcactgtatcaacagcccttccatcagcatgggaggagtctaatgggaggagacagaaaaggtaactaaggcatgaaagcctttctcata

SEQ ID NO: 515963 - DNA, 1578 bp, Homo sapiens
tggcttaaggggcttttttttaaatggttccctcccactgtttggacaatttctatgaaaaaaatcaggttaaagaatctgggaattgggcctgggacgggagattcagagggcagctgggcgggggcgctggcaatagcccctggaggtccctccccccacctaggggacctaaggctatggagaaacaggagagcaccaaacagggggcacccagtacctctggagaacctaagtgtaaggtgtgtgcataagagtgtacaggcgcaagagaagaggagagagatgctcaggcgcaaagaagagagagagggagcgccggggcgccaccaggtgcgcgccattgggggagacgcgcccctctctagagtatgtgtgggagtgtagagggtatctctgtgtgtgtattctcccgcgcctctctactccccctcttaacactgctgggaggtcataacacctgctttgaggagagacacacatgcgtggagaaaagtgttagcgggtgtacacagccgcgccaagaaaatagtagaattgtgccgaccacgatgactcacttacacagcagtagtgtctctgtgccagagacgtgagagacaactcttgcgcgtaatcagagatgtagatgtgtgtaacgaatgagaaacctgctgtgcgcgcacacccatctttgtgttaacaacagagaagggggtgtatatagagaaaaagcgcgcgccacaatctgtgggggtgggggtaaaccccgtcttttattcacacccaccacgaggctaaaagaggtgttggtatcaacccccgcagttgtggggtccccccctcaccaacatgttgttgttgtttcgtgttactataaacacacaaaacgctgtttaataaaagcgccccgaaaacttcttctcaacccacaagaagctctgttggtgcagaaacagaaacagcgctaatgttttattagacaatttaaccatgcttctgcggtgacaacccctgtgggctgtccttacacttttaatgtggcgggcgaaaagatgacaacattttggtgggacgcctggtggcgaatcttttcacccagcacaactgacgaccagaagaggttatactccctgtggcgcactccctggagggggacaaccagaaggcccctctaaataacgagattgacacgcgggggaagaaacacactgtggccacaactttgttatctggctgcgcaagatgcggggcgcaagaaaaatcttccaggagaacccccccgttgtgtgttcaccctgcaggcagcaaatctcggcgcctccagagttgatggcccctctttatcgagtcgaaagaccagttggcgtctcaatataattttttgctagaccccccctgttagtgaagaaggctatccacgagagggcccacaaataaatgtgttgggggccggaatatataattcatcacccagcatgatagtggggagtctctctactaagggttgtcttctactgtcgttcttctttttataatgcccgacacacagatcggccaatagttgaaatattcaccggagggaagaacacccgctgt

SEQ ID NO: 515964 - DNA, 826 bp, Homo sapiens
ttattctagccacctctagcctagcccgtttactcaaacctctggatcagggggagcatccagactcaaacgtacgccctgcatcgtgcgcactgcggagtcagtcagtgccaagcaatctcatatgaagtcaccctagtccgtcattctactatcaacattactaagtaacgtggctcctttgagatcctctccgacccttatctagcatatcacaacgaatcgagcctctgattacgtcctgcgcatcatggacgcctatgggcataactatgatttatctgccacatctagcagagaccaatccgaagcccccttcgaccttgccgaaggggagtcccgaatcgttagtcctgcaggcttcagaatcagtcggaaatacagccgcgaggccccattcagcccataggttcgttcagtagccgaactacatcagaacgagttagttagtaccataaagcgagccctcaccactagcaactcttccgtaggaagcaacatattgacgcactcgtcccgcttgaactcttacacagatcattattttgtcactcaagactcctacttctaacctccctgttcttatgaattcgaacagcatagccccgagttccgctacgaccaactcgtacacctcctatggaaacaagttcctaccactcacctagctgtccttctatgatatgtctccatacccattgaatctccagcattcccctcaggctgaaaaaaaaaataaacccgggcactaggcgggccgggaaaggggaggatcggcagggaagggttcctgccagtttggaacggaacgcggcccaaggcgaaa

SEQ ID NO: 515965 - DNA, 1239 bp, Homo sapiens
tggctggtaaataacttaaagggttggatggggggagtcacaagggaggtatgttggccccaagggttcttcagtgccatcctcaaagcgggttagtgcagggaggtagggcagagtgggttccagtttttcttccaggaagggttaagggagtgtcccagcgagccccaggaatgagtccctcggttaccagtggcaacccacaatttataaaaggggctttctgtgcccaccccttgtaagccttaccccgaggtgtccaggcagaaggaaacgaggaaggctcagaactgtggccaaactgtggcatatatataacaagaggcgccggatatctccagagaagcccaaactgtggcgcatgtgtggctcattttctctctcttctctgtggcgcacagattcctatatgtgcccatgcacaccttatttctctctctctctccaacatctgagggtgagatctgtgcgatcgcccaattgtgcgcaagagggtgttgcgcggcctatatgagcgtgggcatagattgggctccttcgggggtcccccgggggagagagatttcgcggttgagaaggtgtgtgagagacaggggtaggcgccacacccccgtgatacgcgaagaacgcgccgctatatcgcgggcagatgttgagagcacccctgaggggagaggggagaccaagtggcccatctctccagacggggagcaaacaaagaaggggtctccaagggagaggtccaatcgcccacccaagtggtggcgccactggtgggggtgagaggaggtgctccccagagcttcttgggggagatgctttgggggtgggggcccacatctctttggattggcgcccaatgctggctagaacacccaacggggggtgcatataacggcggcaagtaggtgttcgctaaaggtggcctgtgggggcccttgtgggttcaaacctccactcttttgcggccccacggccctacgaggggtctcgcgggggggggatgttgtatctcttccccagaaggcccccgtttggcggcggcccccctctcacccggcggcccgttgtgggatatcccgagccgcaagtgcgctcccgtggctaaaccccctgcttcttcggtctgtaaagctggtctcacttccccaagcgtgggggctcttcccacatattgatcgccctatgttcttactagggtggcgcctcaccccaggtggggacccccccttgtgtttt

SEQ ID NO: 515966 - DNA, 112 bp, Homo sapiens
agtcagctgttcagaaaggatgtctatatcctgttattttccttagttgcaggtagaatttgtttataaatgtcaagtggcaaaatagaagactttaaaataaagctattaa

SEQ ID NO: 515967 - DNA, 289 bp, Homo sapiens
tcaaacagatgagaatgtcagagatgatctccagttttaagtgaagcaattaggcaaatttttattctcttcatatatagaatattatctcaagtttaaatctccagagataaattggatggtgatacagccatacaacttaaagttatcaatgtgatgtatcacatctcatcttgctattaacctaacctttactttctttttcttgtatatttcactgctatcaaacaagcaggtgtcgagcaggaatggatgcaggaagtagtacctcacagtgctaacagtatgt

SEQ ID NO: 515968 - DNA, 530 bp, Homo sapiens
tctcctatagtctgtcattttcaataaatgcatccagtatatgtaaacagatattgttgcggatacctgtcacgttcaacctaatcttaatagaccactcctttacctctggccacattcatcagcacaaatgcctgcttttctcctgctgctcaagtctgccttctgaaatgaggttttgtcctctagagcttctctataatgttagcttatttcaaagagtagctgctaatgataaggaagtctaccctccacctcatatcaatactttgtatgagtaggctggttatcccacatgtcccaaaggtcataaaggaggaaaaagaaaaaaagaaaaaattattcaaaacaattccaaaccccatgatgacttgggggagagacttcacttgactttttctgtttcttctctcattgtcagctgcagttttttttcagcaggatcaggtccaatttgacttgagttaccccttcatcccatatctagcaccttatttgtcccctgattgttagcagcaatcagcactttg

SEQ ID NO: 515969 - DNA, 464 bp, Homo sapiens
tggcgaattcggcacgaggagaggaagagaaaaggaagaattcatttttaatttaggtttctttttttcttcttcatttcggagctctaaggtgtatgcagttgtgaccccatgtgtggggaagtgtagcaaggacggctggtggagggggaaggaggctgcgacgtgtccgcctgatgctttacgaaatgtctactgaggaccctggtacttaagaatacgggcggtgagagagccattgcctgttcgggagacacaactgagcgaaaccgggtgactttgcaaagcaaactcaaaacccagtttacgatgtggcacctgccccatgattcctgccctcggctctgccccagacccttattccaaatcctgagagtgaccatgacagccgctcctgaggcccattggtcttctttccaacaagaaacgaaggctgtgatgtcgctgtctggatcatgccctgc

SEQ ID NO: 515970 - DNA, 113 bp, Homo sapiens
agttcgacggagactctcacattccatgggatagtctctctgtgggatcacaggatgttgctccggatcatacactaggcgagctaggaggtgcttagatacccgcctgttgt

SEQ ID NO: 515971 - DNA, 110 bp, Homo sapiens
cgaatgacggcgggcaaacgctgataccggaggtagggcgatggtggcggcagcacctcgtgactgagcgcttggggcggatcacggtgtgacttcctctcgccattaaa

SEQ ID NO: 515972 - DNA, 287 bp, Homo sapiens
attatatgtctaaggacattatcgataaagtgaaaacacaaccacagaatgggagaaaatgttggcaaaccatgtatctgataaggggtctagaatccagaatatatacaggaatttaaacagatttacaagaaaaaagctaacaaccccatcaaaaagtgggcaaaggatatgaacagacacttcacaaaagaagacatttatgcagccaacagacacatgaaaaaatgctcaccatcactggccatcagagaaatgcaaatcaaaactacagtgagataccatct

SEQ ID NO: 515973 - DNA, 216 bp, Homo sapiens
taaactctgcgcggggtattcgatgttgaagcctgagactagttcggactccccttctgtacggtcgaagggggtccggttggtctctgcgagtgttttttataaatcatattatcgccaccggtcttgatggcaggagtaatcagaggtgttcttgagttgtgatatgggcggagaggttaaaggagccacttattatttatgttgactgtataa

SEQ ID NO: 515974 - DNA, 404 bp, Homo sapiens
  misc_feature (38)..(40): n is a, c, g, or t
  misc_feature (60)..(60): n is a, c, g, or t
  misc_feature (91)..(91): n is a, c, g, or t
  misc_feature (93)..(93): n is a, c, g, or t
  misc_feature (164)..(165): n is a, c, g, or t
  misc_feature (182)..(182): n is a, c, g, or t
  misc_feature (184)..(185): n is a, c, g, or t
  misc_feature (224)..(225): n is a, c, g, or t
  misc_feature (244)..(246): n is a, c, g, or t
  misc_feature (256)..(256): n is a, c, g, or t
  misc_feature (272)..(272): n is a, c, g, or t
  misc_feature (275)..(275): n is a, c, g, or t
  misc_feature (282)..(282): n is a, c, g, or t
  misc_feature (289)..(289): n is a, c, g, or t
  misc_feature (314)..(314): n is a, c, g, or t
  misc_feature (319)..(319): n is a, c, g, or t
  misc_feature (338)..(338): n is a, c, g, or t
  misc_feature (373)..(373): n is a, c, g, or t
gttttttcaaatgtatatacacgtataacataaaactnnntgtaatttcaaatgtctttntttcagttttttggatgaattattatatttngntttagttacatttaaaagcttgaaaattacctttctaacaatcatttgaatgtcattcattgtcacatganntcaggtatttacgtttntnnctaatgctaaaatatccaacattgtaattgccctatttnnccatttttataagtataannnaatgaatttnaacactggtatttaantantacaaantattatncaaattcataacagcacagtgaagnttctnttgaagactatgtactggnagcatttagaacttaccaatatatactgggataantcgtttcaataaagtttatcaaatattctgt

SEQ ID NO: 515975 - DNA, 383 bp, Homo sapiens
ccaaggcaggaggatcacttgaagcttggagtttgagaccagccagggcagcatagtgagaccctatctctacaaaaaatacaaaaaataagccaggcatggtggcttacacctgtaatcccagctgctcaggaggctgaggcaggagaatcacttaagcccaggagttcaagaccaccctgggcaacacagtgagaccccatctctacaaaaattattaagaatcagccaggagtggtggcatgagcctgtagtcccggcttcttgagagattgaggtgagaggatcaatggagcctggagttcgaggcttcagtgagccatgattgtaactctgcactgcaccttgggagacagagtgaagtgagaccctgtctcttaaaa

SEQ ID NO: 515976 - DNA, 308 bp, Homo sapiens
atgtcgactgtatatgaagcatgcccgaacgcaccgactggctcatgtactgaagtccatgacccttcattcgggctgaggccaaggcgacaccttgtgtccttccgggcctgggcctgcgtctgcttcttccagctaccccttcagatttgaagaagcacccgcagcatcctgccaggcccagctacgcatgtgcccacgggccatgccactgactgtgtacctgcagctcaggtgctgatgatgtggctctggacccaagctccgatatctaccctatgacaaccacagagtggggcgctgtgccc

SEQ ID NO: 515977 - DNA, 1596 bp, Homo sapiens
  misc_feature (1247)..(1247): n is a, c, g, or t
cccattgtggatttttttaatggggcgcccttttttggggggtgtgttgggtggaaaaagtgtttgcacacaaggggctcgtcctgtggcctattttgatcgccgctgtgtgttgctcccctcggagaatatttgttggtaggaaatgtgtactgctcccagtcgtgtttatcacaccaacttggtctttcactacgtgggggcgcccaccctcccctgtcgtaagaagagccgtctgttgtgttcctacacctgtggggtgtgtttgattggtcgcccccccttctggggggccattataaatctttgtggggggagaagaggaagtggttgccccatctccttttggatgaggaagaggctgctttgtttgctagcgtggtagaaacccacccccgccatgctggtggtgtggcaccgcctctgtggatccccccacaccgggggggggcatccaccacccccccccgtttattgtgatgccctcctccccccttcttatagtgtcttgggggtttgtcgtgtggccccccgcctcgtcctctcttttgtctgctggccccgctgcttttcttggtgggcccaccagcgttgtatggcgccaccgcttgtgccccctgtggagaccccttcttcttatccccacccccctgggcgtttggtgagttctcacggtctgttctccctcttctcagagtcccacagtggggagaaattcttcgggcgggatcttgtgtgacacacaccccctcttctcagagagttctctctgtgtctcatatgtgtccactctgtccccccagagagacgtctcgctttgcacagagggcgcacacacccctctctggcccctctgttgtgtgtgtgtcccacagtggcccacaggggtcttctctctcacaccccacaggtgtgcccgcgcacaccactctctgctggggttgtctctttctgtgtgtccacagtctctcccctctgtggcacccacacactgtgtgtctctgtgtcacactcgggagacttctctctctctctgtgggggagactttccccctctgtcctcgtgctctcacagagaggcccctctctgacacaggggtcttctgtgtgtgtcacaccgtctgcctgctgtgtctcacagtgtgtgtcacacacacactgttcccctccgcacacagtctgtgtataacacctgtggcgctgtattatagtgttctccgctgtagagaggacacactgtgtgtgtntgtgggcacacccctgtgcacacactctctgtctctcagaggtgttgccacacacagacctggtgtttgtttgttctctccagaccccacacgagtggttcttccccccacactggggtacgccacgaccaggcaccagcaccacgatgaatccaccagaaatcttgcccctgacgcacagaggctgcctgtcccctgggacatctcctagacccatgggtccagacctgtccccaacaccggttttccccagaaaatgtaaaagtaaatccctttttatactgaaaatgttactgtaaaatcccttttatgagccatctccccttaataaaccagaccttgattcccc

SEQ ID NO: 515978 - DNA, 145 bp, Homo sapiens
gcctggactgctcagcgattctcttggactgggaagcaaggttgtagtgagctgagatcttgccctggctccagcctgggctacagagccaaatttcatctcgaaataaagaaaaaaaaaaaagagaaagaaaatgctttcagat

SEQ ID NO: 515979 - DNA, 425 bp, Homo sapiens
tctcatggctcacatacccaaatgaaactgtcacttgattacacatccaatgcatctctacattaaacctaaaacatcaacaaatcaccttcacctctatcatctgatcattccttcttgcaactcgctgtactcataagctaaagagcctaacccaccactctccattatccatacagtactgaccacatcatatcaactcctcttctgcccattcctatacactggagttccttggaggcagcatcagcccctttttctcctttactgaccctccataaatattttaatacaagctaatgtctttattaccaaatacctgcaacttccatatatttatcacataacagatttctctactaagctacaaacctacatttgggttaccattatacaaggctcatccgcaatgagatgttggaagg

SEQ ID NO: 515980 - DNA, 219 bp, Homo sapiens
aggcgattgtgcgtttcatagtccatcatagactcctcacttgtgatatatcagctcagtagtctgactttaatctagttctttcaatacactgttcccattataaacttcgaagggcctcgtgcctctgctacagcccttgtaggagccatggatccttgtttggtctaactgaatactgtttggggagtgtgccccatctcatcatttcgaagatag

SEQ ID NO: 515981 - DNA, 137 bp, Homo sapiens
ctcaggtacttcagagagtgagacccagcgccttgtctcgcacgcagtaggcttacatccccgccatggcgggagctgatccagaagaagctacagtgtagaatgtggagagatatcaacatgctacagcaaggact

SEQ ID NO: 515982 - DNA, 255 bp, Homo sapiens
tccccgtaactgtggtgttacctgtgcttgtgtggacaacccaaaagcagtcatcagagacgggttggaggtaggatggaaaacaaatgaaaatcaaatatgcaaatttgttgtgtttagaataatgaaactgaaagagaaaccagattcctcacacacaacccccaccccccagtggattttgtttaacaagccgtcgtcaagaaacatgaaggagtcctccaataaagtgacaacggtaacaccaccagtcgc

SEQ ID NO: 515983 - DNA, 157 bp, Homo sapiens
cttaggaacaaaaaacttatttggccaaatgtttcttttttatgttttggggggtggttttgttttttgaccttttttgtattgtgaacaggccctgaagctgatgttattttaagattacagaatggaaaaaaaaataaactattttaatgtttga

SEQ ID NO: 515984 - DNA, 1182 bp, Homo sapiens
gctgcgtcgctccgggagctgcctgacggacggagcgcccccgccccacgcccggccgcccgaccgccgccgccatgcgccttctccaacagccacagagcgactgaagctgcgcttcccgggcgagtgacgagattccccgacctgagcgcccacaacaaccacatcgccaaggctgcgtgacccccgcagcctgtacccgcgacgctgcgcgcccagagcacgccgcagcggccttcacgcctgcgccccgacgctccatcccaccacccggcccgtggaccccccccgcggccacccccgccaccctccaccgaacccgccggccccccgcccgctcgcccggcgccgcccccacgccacgcacccctaccgcaacacctgctccccaacgccactcctccccctcacgccaccacccaccccccacccccgcggacacccgcgcccacgcgccgcgcactacaaaaagacccccccgccgccactagcacgccaccacagcacaccccacgccgcttaaaaccacccgcgggcacgcccacccccttgcgccaaccgggccccgcgaccgcaacgacacccctcgtgcactaccccccgacaacacaacagcatccgcccacgcccgccaccccgccccgccccgccttggccccccccacacccgccgccccccgcccaaagccgacaccacccgcccgacgcgactcctcccacggcgccccaccaccccccaccccccgggccacagcccccgcccacaccccccaccccgcgcagcaggcacacgcaccggcccccagcccggtaccccccactctcagcgagaccccacaaggcgcctccccacgccccggccagccacgggcgccgcacacgcccccccccgacttcgctctcccacacaagaccaccccatagaagaaaaaccagccgccacgaaaacaacccatcacgcgacgcacgcaggggccccccgcccgaactcccacccctaacacgctaccggccccgccttcccaccccgccacacgccccccccccccgcaacaccccgcgcgcaaagccggcccccgggcccccggcccgccagaccgccaacccgcccccgcaccacgcccatcccgaacttccccccgacaccccccgcccaagccaccaccccgcactgtccgcccc

SEQ ID NO: 515985 - DNA, 348 bp, Homo sapiens
  misc_feature (159)..(159): n is a, c, g, or t
gaaatggcgtccacggattacagtacctatagccaagctgcagcccaaggggcttaccagtgcttacaccgcccagcccactcagggatattcacagaccacccaggcatatgggcaacaaggctatggaacctatggacagcccactgatgtcagctnttaccaggttcagcccactccaccctatggcagacccctatgcacttttatggacgctcccactggtatatactccactgccccaggataaagcagcctgtcagggaatgcactggtcttatatacacactgctcagtacacaccaggctcatcagctagttgatttggatagctcttatcagccattg

SEQ ID NO: 515986 - DNA, 1481 bp, Homo sapiens
  misc_feature (710)..(710): n is a, c, g, or t
  misc_feature (1165)..(1165): n is a, c, g, or t
ggttcgggtgtcctgcttcaacagtgctgggacggaagccggcgctcgttcccgagcccggactggccgcccatagccagccctccgatcacctcttcagccggtcggctcggatggtcccaatgggtcccgcgcctgccgcttccgaggtcgccgtcgcatgtcagtcggccgtcgacggacggccttttcacttagctctgccgctcactagagcgatgcagcagttgcaccttcgtctggtgacgccactactgtacgcactcagagacggcaagcacggccagcgcgatcgatgacgcgcgagaaatcatatcgctgggtacgctccgtaacccgtactcctcccataacagcttctattacctcttggtacgcgaatggctgaatttaagtctgaacttctgtgaaaccctgacctggattgggacttgctttggagttacttggagactggaatcgtattgtgacccgataagggttcaagcgtaggatacctttgcaatcgcagacaggttgcattcaacatgcacggcggacagaaggggggcgaagaacaaagtggcctttggggcgtggacattacggccttgaacttgcaacacgggcgttgggcccaaaggaacacggcccgaaaaccgggagaggtcgtgtggggacactcggaatacatttcgtactaccgcgtattcccagtggcgactgtgaanttcgagccggaaagaccaattctccgatgtgacccgcttcggcatacgaagtggggcatccgttggagagacccgcacctgccgaagcggagcccttcgtacatttgtgagcgaaaagtcgatggcaccattcgtagagcgacattactaggctaactatttgttcggcggacacaggcccctttgcacccttcgctttaggacgcctatcccactaagttccgaggggaaacatctatggtcgcaaatccgctccgctagtcgaaagccgaattcttcgggttggccaccaaccgtctaggactggaaggaaacaccacttcgaaaggtcgcttctctcagttttttgagggcataggtcagaacggtttctacgaagttatcgccaagacatactaggccatttatagaaacggcccgtaggatacacactggatgtgcacaaggggggctcngcaagataaaagcgacgcattatccggaaacgtaagagcgaacaaagttgaaccgccgccaggtttcagacatgcgtgcagccaagagattagacaccggccaggaagcctgtttttggcccgtccgaagaccgtaagtgtaggggcaggaagggcatcggctccccctagggggaagttccatgggcggcctttcaggcgttgggtgcaaatacatatattaccatacgagtaatgtgggatcacaacaaagtacaagtcgaaactcgcccttgtgtgggacaacatgaaagcggatcgcgattggcacttcatg

SEQ ID NO: 515987 - DNA, 227 bp, Homo sapiens
ccatcatctcgctgactaaagtgaatggtgaaggaatctgatgttattccatttctaaagctaaaatggtaaaataccagcgaattctaatttgcaatgcgacattagttggttttgagttggagtttaaaatcaaagcagatacagtgttccttaatgaagaaatctgcagttaactatagagacccattttgcctttcatcagggaaaaagtagtttgtttctac

SEQ ID NO: 515988 - DNA, 1613 bp, Homo sapiens
ggccgttgtgtagcaaggaagcacattgaacgtatggtccaggcaagctagagcaatgctacaaagctgaacgatgtagaagcatgatgggacaaggtgtcatccaagaattcacttgtagtcctatgcctttactacactatgaaaatgcaaaccatgtggacatgattgagtaaacttcgaaggtcacagcattcaacgagtgatggacacagaccagaagcattctggcagcaagtgttatgacgattatcatactgtgtctggactagagaactctacgcactgctgtaggaacggaagaagttggacatcaatcaatcacgtaaagtagtgtggacgaacacgttttgcaatcgcccagtcagtcactcatagtcatggtgcctagaatgtgcctcgtgaggccatagaccacgtgaagggcacattgcgcgtggtgtgagatcttccctgggtttgggttggcatgactccctacaccatgctggtgtcgggtagcgtttcctgctagcggaccccgaacccattggcaacgaagagttcagatcttaaagcgcaaccaaaggtgatatgaatcgtaaagcatttatgtattacacgagcatttgtacaatagcaattggagacggaaaccttaaaagtatcgtatgacaatacttgctggattgggcatgattttagagtaaacgttgaacgcttggctattaagtaaggttactttgggcattttctcatataaccttttgagacttcattgggcaaccattattgccagccagcgggacagggacaaatcacaccatttggcaactttctattgacacacgaactcggtagtgggtccaggctcgggaccacaacttgcacactcggttcttccacatcatacacatactcagtattaacaacattcgggctcaaacaagacacacttgaacttaaacagcaaatatccagggtgggcacgggagcccgaattcatgtacgtaacagccttatcccctccctgcgaggtggggtaccaccacgatgtatatgcagccggttataaccacagcgtatattttcgtttgaggacacgaacaagggtgggatctaccagaagaaaagacgagaggagaactagacttattatagctgggattgaaggagagccgtgggtcgagcagatctcattcataccacagtcaggtagtacatcgtgggaaaatcggtgtgtttacgcatgtggaacactatgtgaggcaaaaggcagaacaccaccagaccgcgcgacggaggatcacaccaccacagcggcggcacagccacacactaacgagacaacagaaacggcgccccggcggaaaaatccaacgacgctaggcgtcttaggggctgaaacaccggcaaaacaaggcgcgcggagactacaacgatcgagaccaacacaagacactagcagacaggagacaaaggagacagcgacccgatcctgacagaagagggcccggatcgcgagcccgcaacacctagcaccgcgacgcgagacggccaatgccatgcagagaacgaagcacgacgaggacagaaaacaagacagacagagacgaaaccgcacgaccgaagca

SEQ ID NO: 515989 - DNA, 597 bp, Homo sapiens
  misc_feature (30)..(30): n is a, c, g, or t
  misc_feature (56)..(56): n is a, c, g, or t
  misc_feature (71)..(71): n is a, c, g, or t
  misc_feature (95)..(95): n is a, c, g, or t
gggtggtgggtagagagcatcctaaaaatngtctagtcagcaaaccttatctgatnactaaggaaactgangctcagggagggtcaatagcttgnaatagtaatctagaattcagaagctcatgaatttaaggcataattgggaatctgcctttaagctaccttttctgtctgtgcatcctactttgtaaacttgcggaaataacactttggcattaagtagaaattatgtgaaggtgtacaataggaacaatttaagtaccttcagaaagattatgatatgaaaagtacattagagctatgagaaatgatacagtaaaagtgaaaatattcatatatggtaaataaaacctcaatttagtaaatgccattgaaacattgagttatctggaattagtccatttttatgtcttaaatatcagtctataataatacaactttattaatgataatatgaatttttagaaaagggaaaaacaaaaatgtgttttcattttgtgctcatttattccaaaaatattttgagagaggctgctttataccagctacttcctaaatactaaaggtcaaataggagctaatcagataccaactggtc

SEQ ID NO: 515990 - DNA, 769 bp, Homo sapiens
gtcggaggctacaggcgctgctggcaatgtttgctaaccggacggtggtcgccaggtcgagaggcgtggagcctggagatggtaggcaggacccgggctccactgccgcctctcgagctcttgtgacgcggacctcagtgccaggatgctcggggcgagcggcggcgccgcgcagtgccggcagagggagtgcggacagccgagagggcggctcgtgggagtgccccgggcgactgtggacggcctggggcggctggtgccgctgtagcacgggtgctgggaggagtggctcttgggccggtcgttggtccttgtcgtttttggccccttggggtcattgtcgggggcggctaggcgttgcttgggctgtttgggttaccctgttgccggctgtgctggtggggctggggtcccgactggccttgcactttccggtcggcccctttcccttgggttagtttgccctttgccgggaactttccctttcctatggtccccccgcgcgtttgggtcccccctgtggaaacccttctttttcctgtgggcggtggaagaccccttttaaaccccgggcccccgtttcaaaccgggtttctttaagcgttttaccggtgggccagtttgaagaaaggaaaccccccggtacgatggggcccccccggaaaaggcgccgccgctttctcctttccaaccccctggggcacgcgtttggaagttcgtttgggggcccgtgcgaagggagccagagggtggcaaacccaaaggcgcc

SEQ ID NO: 515991 - DNA, 528 bp, Homo sapiens
  misc_feature (479)..(479): n is a, c, g, or t
cctctttggactaacagttaattttcaagggtatatagagggttttgtgggcaaatttagagttgacttaagattctatcttggacaaccagctatcccgaggctcggtaggtttgtcgcctctacctataattcttccctctattgtgttacataggcggggtgtgctctttaagctgtttataggtagcttgtctggtttggggggtctaagctttggctctccttgcaaagttatttatagttaattcattatgcaagaggtataggggttagtccttgatatattatgttgggttataatttttcatctttcccttgcggtaatatatatagcgccacaggttacaatctctatcgcctatactttatttgggtaaatggtagggataaggttgtggggtagtaaggtggagctcgtgtagtattccagcagctcgggttatacatagaaaagagtgtaatttggcgaggctttnaaggttatcactttgctgatcttgaatactgcttaaaactggaaagttt

SEQ ID NO: 515992 - DNA, 1502 bp, Homo sapiens
  misc_feature (778)..(778): n is a, c, g, or t
tttttaatgggcttgggtgagggaggtaggtggtagttggtgtttaatattttaagtggggtgatgaggaatagtgtaaggagttatggggggtaattatggtgggcgccatacggtaagttattaagttgggggctatttcgggataagcgcccgaaaacatttgtttgtggggaaaaaaatgttagatttaccgccgatgatatttcgatatgtcgaacatggattttgggcggtaggtttgggctcatagggtgtgtaccctgtgaaaattatggggaaactcaggtgaattgaacgccctcctatgtgagtggcaaatatacagcctccatatgtgaataggacattatggtgagaagtgtgagctataacacacgcgtgtagttagcgtgtgtgtccggtgtataagtatcgcggaagtgttctttaagggtgatatggagttttgtggcataaatatatacacatgtgcccccacgttttcaaggggcacaacccataagcggggtgaaaacagagatgacacaatgatctgtgtgacttcccaataaaggagggcgctccaatagaaaggcaccttggtgcgaacgcaagagatctacaattttctaccaaatattttgtgcgtctcccccggcgtgaggaaagtgttgtttgggcgagagaggttctacacgcttaaaaaatattaaccgttttttagaacgcctcccccaggtgtttggtgaggagaatctataggcgccgcatgctggaacatctaagatggtggatnaaagcgccgaggaaggtgtgttgcaacaccacattaagttgcgccccaccaagaggagatgtagtatcatcaacagcgagggttccataatatttagtccccctaagaaggtggggtcaacacattatttctctttagcgagggtggggggtcttctcacccacgagcgaaatatataaaaagccccccttttataatggataagaagcgcccgccaaagttgtgtgggagaatatcataccaaataaaagggcgctccaaaaggagaagccataattagacgcagttattgttgtgtttttttccccccgcaaaagttggtggtgtcccactattatgatgtgttgccccccgacgaggagattaaaaataaacgtgtgtgtgtacccaaacatacgtgcggggcgggagcgagcagattaaattttcccccccagaaagaaaccccctgttgtgaagacgagagtataacacaggaacgattatattgataccacctttcacaagaggggatggatgagacccccgaggaaggaaaatgtccacagaaaaataaaaaggatgtggattgacgccggaattatcaaaacacaggggggggagatatcaccatccccatcactaccgagcagggggggggagtgcctcaagacaaacacaaaagaaggtgcggtcgatgattaccgacaagagatgatctggacagagacgatgaggtgaagaa

SEQ ID NO: 515993 - DNA, 356 bp, Homo sapiens
cccccccccccacccccccgggtttttgggggcttttttgggggcccttttttggggggcttttccccccacccccccggggggggggggggggcccccaaaaaaaaaaaggttttttgggggggggggggggggggccccccccttttttgggcccccccccccgggcccccccccccccttttttttttggggttttttttttccccccttttaggcccccccggggggtttttaaaaatttttccggggggggggggtttctttaaaaaagttttttttttttttttttcccccaagggggtttttttttttttggggggggtgggggggaaaaaacccccccccggggggga

SEQ ID NO: 515994 - DNA, 150 bp, Homo sapiens
tggcctccaaccaaaaaacaaaggagataaatctagtatacttggtctctaaatggcgggtctattcctagttataccccagagtttttatgtaccaggaaaattatatttctaatttaagaaatcattggggtaaatatcgcctcatca

SEQ ID NO: 515995 - DNA, 809 bp, Homo sapiens
gctttctctctcgcgcgcggtgtggtggcagcaggcgcagcccagctcgaaatgcagaagagccgggagttcgtggacctgtacgtgccgcgaaatgctccgttagcaatcgctatcatcggtgccaggaccacgcatcatccagatgaacgttggccgaggttgacaaggtcacaggcaggtttaagtggccagtttaaaaactttatgctatctgcgggggccatttcgtaggatgggtgagtcagattgattcccatttctccgatttggcaaagggccgaatggacaatcggtctcaaaagaccttttttggacttgggaagaagacttcaccatggtttgtggggaattatttgtgtcattaactttacatttagtggaagaaccaaaaaaagagataacagtagagaaagagaggaaaaacaatttttgtggtggggcgggatctgtggggccctgagagaagatgttttgatagagaaccacttgtgtttgttgggagacggggcgcccccatgattggtggcaggacgaccaacgtgtgccccaggagctgggttcccaagagggaacacatccgggggcgcacgagaaccagtgggggtgcggtggttttccaccacccaatataaaaaagaacgccgcgggggggaaaacagcgggagtggttttggtgaaacaccaccaccccagaagggggcgcattcggagagacagccactcgacgggaccttaaacgaccaaaggggggccccgagggaaggcgcgagtaataagaatggccggcagcgggggggtggagagcc

SEQ ID NO: 515996 - DNA, 400 bp, Homo sapiens
tatggcgtgaatactataccatcagtggctatccacatgtagtctattccgatcactcgagttgatgcacatattagcttagtttcacctattagtactatagttgagcttgtgctgctctgaccagtcacgtgccaccttcagtttaaacgtcgtgtgttccctatactttcgggtgcacaccatggggtagaattgctaagtcatatgggtaattctagatttcctttctgtaataacactgcctctatctcattttgagataagtacataaagcacttagcactgtgcctggcacacagtagtaataagaacaatatttatcatcatcaatgacattttctaagtgccaggtattttatattttacttgtattaacacatttcatccacattaccat

SEQ ID NO: 515997 - DNA, 210 bp, Homo sapiens
ttaaacaaaaaccctggacctggcttcactggtgaattctactaaacgtttaaaaaattaataccagtcctttccaaattcttccaaaaactgaagaggaaggaatactttccaactcattgcaaggtctaccctgatacaaaaaccagatggggtcaccataagaaaataaaattacagtccagtatccctgacaaatatcgatgtgaa

SEQ ID NO: 515998 - DNA, 205 bp, Homo sapiens
  misc_feature (39)..(39): n is a, c, g, or t
  misc_feature (51)..(51): n is a, c, g, or t
  misc_feature (66)..(66): n is a, c, g, or t
ataatcaaaaggataatgttttcataattttttattggnaaatgtgctgantcttgaattttttantctccagatttatgaactttttttcttcagcaattggtaaagtatacttttgtaaacaaaaattgaaacatttgcttttgctctctatctgagtgccccagaattgggaaactattcatgagtattcataggtttatgg

SEQ ID NO: 515999 - DNA, 111 bp, Homo sapiens
ccaaagcacctcactatgtgctttctcagcttaccacggacaacaaaggcaactcaaaagcgggaaatggaacactgcaaaaccaaaaaggaactggcgtaacagaagagc

SEQ ID NO: 516000 - DNA, 205 bp, Homo sapiens
  misc_feature (98)..(98): n is a, c, g, or t
atcacttgccttctatgtctattctcaaggaaaaaaaaaaatcacacactcatcattacaaacctcaggtggcacggagctttctggtatgaggctanctggcttggagacggatgacaatacctaagaggatcaggcaggctctattagtttacttctcggtcttatatctcaatggttcccggcggggtacgacgctcgacat

SEQ ID NO: 516001 - DNA, 934 bp, Homo sapiens
gggcgtttttgcacttagtctcaagggctcatgctcctgtgtaaagtggaatttagaaggttcgtgtcttcttattactttgccatttctttctttgctacacccccctttttccctaattccgtgtgggaaccaaatgccatccttctgtttaaagggtccacatattgagtgtcccaggcaagtccagtctaactcttgtccgtatgccaattggctcttttctcccatcgtctatttctcgtgcttatcaaaggtgttttatagtatgcttaacttaccttactgttttcccacggaatttctatgtggtttgttccatgtgcagcacatgaactagtgtgtaaagacctccgtgggcccctatagggccataaagggatagccatgtcaaccttctgggacagagggctcctatgcttgttccttcccctatccatggcactacaccacgttcgtatcgctgccttctgtgcgaagatgattccttagttaatgcagtacatacagctctgccatggggctcaacctggacctacgtgatcccatgatccatgtctgactagaaccgtgagggcaaagatcggtgactgatgtctctccaccggtaatgtcactgtttcttattccttccatctagcagctggcctaatcactctgagttcacagagtgctggtgatcggatgagtggggagaggcacattaatcgtgtaaccccacaacggaggaaatgaacataagagattcttctaggggtagcatggtggatctgtgccttttgtaggctgattccctgttgcctataaacctgaacgatgtctcctcaagcctgtgggcagcatagccctagattcccagaccgttaagacactgtgagagttgtcatctagttggtccactgtgtttaagttgcaaggatttttctatgtgtgg

SEQ ID NO: 516002 - DNA, 292 bp, Homo sapiens
agatatataatatacgatcacatgtaatatgtgggacgtaacagcagcagtagatgtcaccttaatatgttctgctgggaccatctaccgccttatactacacttaggaaaaagtattacatatggtttatttagaaacttcaagtattattgccttaatgtctcttaaccctgttacacgctgcatgctagaacatggttaatatagctaatacctcttatgatctatcgagctttaaggcactactcctttttctgcttttatcactgtcactgcacttattcttgtata

SEQ ID NO: 516003 - DNA, 1299 bp, Homo sapiens
taaactggagctgtaattacagggctactaaagatgtgaagtatatagttaaggttttgtcagcacttttattgtaatacttagtgagattagtcattttagttgttccctttgtatgccaaaaatggaagacagctgtttgtgcactaaaaactgctttttaaaggatagttctctctggttatcaagcatattttgccatcagggaaacatattttaaagcttttgcactgtcaaaatgaagtgtgtaggaatgattgctttagctgttacttctaaataacgacaggaagatctaacatgtggtaatactgcacaaggatgatacaaagtatctggctagattcacaactattccaattactatctcttcctgcaagatgtatttctgatggcactcatcagaccctgaattcattccctgagcttgagagtgctacagaagtgtttagggccagttctgtggcagccctcatggaaacaaagaaaagcctaagggctggtaacctgcatcacgaccagcccatcacccaagaacacagccagcttcttttgcaaggttgtacctgttagtcaatcaaatctaaatctgagagttgtgactgacttagacctattcatcttccaaagtataaaccttaagaatttgtttccactagtgcattaaatatttgccatctaacagaccaaaaagcctgaagcttaactaaattttaaataaagctcatgtgtatcatttgttcttagttgcaacatgtcaagttaccaagagaggtaatatttatctctcttctgtggatgttttgaagatcaacatctttttttttccagaggcactcaattattttttttctcctattcaacctataacctaataggaaatctactgcgctgctttgcagaatgagtttttttaatggtcctgactcttaaggttttactgtagttactgagtaagacctaaaaacataaaacaattaaccaacactaatcaatgtactaaaagacgtctgtggcatggatggagaggtacagctcagacctgcttttaagagaagagtcactgcccatctgtcagggctgtggggaacagacaacctccagctgttagcctcttcagcttgcaagccaaggtcacactcttctcaaggtcacactcttgcccagacagtaactgagcaaggcagtagtacaggacctggccatttacacccaatgagtgctcctctaacaggctctctgctacaggactcttcactggactggcaggaactttatcagatctgcatgccatttgat

SEQ ID NO: 516004 - DNA, 365 bp, Homo sapiens
gtgttcttaatgtattgcccccaagccatgcgatagagactactgcgcacagtacacctgatacatgctatagactggcctacactatgacgccttctgtatgagatgtgccatgcaccggagctcattgaagtgataatagctcttatgtatctgacaatccttgcacaacactcatggtattggaacacactctcgtacatcatcttactcttagagtctcactcttacatgtgcgcgactcgcactgactcgtataagatcacgaatcattactagtgacagtgccacaaccaaggagaatagcttactcttgctcaccaagatgtcacctgtttcgatacggcagagcttggagtcatctt

SEQ ID NO: 516005 - DNA, 568 bp, Homo sapiens
gacgagaagaccctatggagctttaagtttattaatgcaaacagtacctaacaaagccacaggtcctaaactaccaaatctgcattaaaaatgtcggttggggctgacctcggagcatgaacccgagacctccgagcagtacatgctaaggacttcaccagtcaaagcgaacatagtatactcaagggatccaataacttgaccaacggaacaagttagcctagggataacagcgccaatcctattctagagtccatatcaacaatagggtttacgagccttcgatgtggatcaggacgatcccaatggtgcagccgcatattaaaggttcgtggttcaacggattaacgtcctacgtgatctggagttcagacgcggagtaatccaggtcggttagctatctacttcaaatccctccctgtagcgaaaggacgatgagaaataaggctacttcacaaagcgccttcccccgtaaaggatatcatctcaatgagtattataccacacccacccaaagaacaggtctagcaacaagacacaaaaaagacctgcactggcgaccacaact

SEQ ID NO: 516006 - DNA, 255 bp, Homo sapiens
tagcactctttctactgatgaagaactgaggtacttcataaaaccacttactcaagacaccttgggtaagtggttttatgaagtacctcagttcttcatcagtagaatgagctgctagggacgcgtggctggacgatctggcgggaatccgagggcaacgcccgctaggcactacccttgtcctcttgatctgcgtggatgtggatcctgtacaactgtcttccatgctccagattatgtgatctgcaattaaaa

SEQ ID NO: 516007 - DNA, 219 bp, Homo sapiens
catgcgtgtacctcactttacataagcaatgtattcctgaaaaactgcatttcaatcaagtcccaaattcaatgacttagaggagttcagtatttaatgaatccctatggagaatatatccatttacaatgtgaatagtcatctcctaatttgtttcttatgtctttatgtttttcagtaacctggattttttaaatcatattaaaattacaagatgtg

SEQ ID NO: 516008 - DNA, 927 bp, Homo sapiens
actgttcgtcgttgacgtccgctgtgtccgctaatcgtttcgccgtatagcgttttccccctagtcctgcgtgttattttgcggggcgccgctaatctgtgtagaccattacgagtttcgtgtcggtccgacaattccggggtctgccactctcccggggttttttttttccatgtggagcacgttgtctctgccacggtcctttcgcgcccgggaagattgtgtttcgccgcgcgcccacatgttgtgtctgccccaccccccgccccgttgggccaaagagcacccttaccactcgttgagccctcccgcgatattgccagtggggggccgtataccgagcccgggaaatctgtcgcacgatgtggtgccctcccgccgcttggccagtgtctcacagtcccccgctatgaccgcccaccgggtttcttatcgacccccgcggcgttgtccacacccggcgccctttttccaaggctcacttcgcacaccaccccggccccaggtgtcactcgtgagaaccctgggctgccccccacatttgggtggctcttgttttcttggggctcgggaattggaaaaccttcgtttgggggcctccactccactgggtatagcccgggaccacccttcttcttgtgagcggcaccgcgtctcttctttctctacagcctcattctgtggcgttttccctttcggggagccacttgggcgtcttttgtctgagatgtagccgcttcgtctaacacgttctttgcccacatgtgaaggaagcccgttttctcccctcctccataaggtgtcttctccggcgtctgggtggcccccctgtgttccctgtttcttaatacctcacccccgcaccccgggggaaagggtgggcccggggtttcaaaaaaaaacccaaaaaaaactgtttcccaaaaa

SEQ ID NO: 516009 - DNA, 300 bp, Homo sapiens
  misc_feature (32)..(32): n is a, c, g, or t
agttgtttgtttctggtcatctcagggatcanctgttctttgtgttcagtgccttgtgttcatgccttgtgttcagtatcttgaaaactgttgtttgtatattgtgtctgttttttagttgttttttgagggcctgtgagtatggtaaatccggtccctgtaacctcatctttgctggtaatgcaaattctgacttactaaagtttagcaaataaaacacagaaggagatttttttcatttgttaaatctgaaatgcttacctctacttaaagtgaatattaacatgaatattaatgttc

SEQ ID NO: 516010 - DNA, 175 bp, Homo sapiens
ggacaaaggacgatgatcgggcgggctccactcagggtctaaggcacccggagctgtccttggcgtgcaatcccagagacagataaccctgcatccatatttactgcagacaaatctctccttagttgatgagactgtgttgatctcccttgtaaactctgaagctgagctccca

SEQ ID NO: 516011 - DNA, 897 bp, Homo sapiens
gatcacgtaataatatgcacctgtcagccgctcattctacctactctctggctgtgccgtggatggactgtccaaactagcacatggtcatccaaacgttcggtgctctcagaacacgtggaccccataaagcggttgctcctctgtggcaccctgagactagccctacacatggctcttcctgctcatatactcgcatttaagctctaccatcagtagtgggtaagagttgaggataccttgagtgaacacatctgtggaagggacacctaacaatacctcagtacaacaattccatgaaggcgtcacccatgaagaatacttctcctgaccattgcgtccacttgcctagcttctgcgccttgcgcaaccaggcagtccctttaacacgcacaagcttcgcttaaggctagttagctggttgcccctcgggttccacaactgacccgaagcctctagaagaaatttctttgcacccaagtacatccatctctccaccggattggatgctggataacgagacgtgactacgtagatatagaatggatggagattctgactcgaacacctagtctcggataagcatcggggagatataagctaaagcatcgtctaacttgaagacggtgctatagacatgacagattaacgataacccatactctttggagtgcccctgatcgggcaacagttcttgaaccagcggcaccagagggccaaagaaaaagcgtcctgggggccaggacgtggcaaagggctcgtgaccaaaccaaattgcaggaaaaaatggggtgcaacctcactttggaggaaaccccctctcgacgagcgcttactcccatttcctttcctctttttatccgtgtccccaacattggtacttggctaaaactatta

SEQ ID NO: 516012 - DNA, 805 bp, Homo sapiens
cagacatatcatataaggcgcctctcggtgtggcgagaggtcacgataaggctgtatgggcagttatgaatatctcgctgtgcttgctgctaaagaactgggaatctctattacagtacatgaacctcgcaaggaaaatagagcgatttactctactccaatcagatgcatatttacaagaagcacagagtacagcatgaacactgagaacactgttcacagcatgtttcatgcagttagatagcatgctaatcttggaaggcgtcgagcacgatgtcgtcacttggcacataggtattcgacgtctgaaacttcagccttgaaggggtgtgtgcccatggcaacgtagagcaatagacagcgaattagatacagtatactcagaaacacagtcaaggtgagccaagtctgtggaaacactactcagaagcagaacgaatgaaacgcagagtctatcaatacgatctctagggtatggcctatgttttcgccatacatgtatgaaatcgatgggtcgggccaagatagagtcatgtttagagtcggagatgtgcttaccacgtctcgagaatcgatctatgaggtcatgaacactaactgcatccattgagttcattcgtagccctcgatcgagcatgagggcagggtaattggaacttttgaatggaagaaccacttgtggatctagttctatctatccactgtttcatgtatctgatttgcagccagggatgatgccaagcacttgtgactgattgatatccatggactaagcagtagggggaaccgaaaaggtaaaccccgg

SEQ ID NO: 516013 - DNA, 259 bp, Homo sapiens
tgccgcatccccttttattatctgatctaactctttttctctggtctctgtatctacttgttagctgttttaagaagggatggggagagggtcattttctttcattaattttttattcccttcttttaattttctcgaccttttctcaaaacatttcagccgattttccaactcaatgaccttctgtaatgtctgctccaacatttcttttccattcttctctggagtactcctcttgagggggggggtcttcaccaga

SEQ ID NO: 516014 - DNA, 342 bp, Homo sapiens
tctatatgtccatatggcctcatcatttagctctgactgatcagagagatataccatcatatactctttgatgtgtattatagcatagttcaactcagtagtatatttaacatctttgaaagatctgtgactgagttttgccacttattcattgaagatattaatcatctcgagacccacctacactgtgtctctacgcttatgcaggctctaagatcagatacctaaggagaataggctatgctgtcctgctataagaggggatcaatgtctcagttatttcaggttgccataacctagaagctggcatgcccagtatcggcactagcagattcgtggctg

SEQ ID NO: 516015 - DNA, 952 bp, Homo sapiens
tccggtaacccggggcgccgtggttgagaagtcgccacgtccaccctggcgcaaacctaagatggccacagcttgtgcgggacctcttagacaccccttcggggcaaaaaccacttccatcaagatgttgcatcaggggcctggacaacctccatcaaactctggaaggaaggaggggcggccattggaaggaggcctagaagctagaagccgcccaatgactgggttcgaaaatgacctgggcccacccccatcggccggcccaccgaacacccaatcccagccgcgtcccagagatggtcgtgggttcatttggacccgagatgacgcctcaagccacacggggccccaaactgcgcacaaggccaacgatctgaggtgccaatgagtggcccaacacagccgaaaaccaggcggtctttgggtggagacaacaaaggggaccccttggaaggcaactcagatttactgggccatcggggtgattcactcagaggacgtgcacgcaacggggcccgggctccatatcagcatcagcgacagaggaccatcagaacgagcaggagcacagacagctaggggcctggctccccagccccacagctgccacggtcgccccttccctgggccaacgaaccagaccacatcgggtagaggcccccactccctacaggagttacttttctcccacggaggagagttgacagaggacacccgcagattgatgacatcccttgaagctgatcggagatgctttgtaatgattccgtccacatgaaaacactcatgttacgaggaagagacataccaagttatttgtcaaatgcttgtgtttcgggtcaactatttacagtaccacttgggttcaggcattactttcggggggatttgtttacccaaggcattgaaataatcatcatcatgtgtcttatatgaacacacagaacaatca

SEQ ID NO: 516016 - DNA, 232 bp, Homo sapiens
  misc_feature (124)..(124): n is a, c, g, or t
  misc_feature (126)..(126): n is a, c, g, or t
  misc_feature (160)..(160): n is a, c, g, or t
ttttttttttttgtgacaacacaaggttctattaattttatcatattatacacaacaatcaaccagactacaacatgtctcttcatcatcgagaatattaaatagagttaagcactagcattancnacacttatatgtgcatctagcaatatatgtccanatatatacctcaacatagctaccgtatacctaatcgtaccactcaaactaattcaaggtactaagtccttaa

SEQ ID NO: 516017 - DNA, 893 bp, Homo sapiens
atgatgcggctcaagcccagtccctgtgaggaattgtcgatcaacttaggcttggggccttgcggaggcaaggtccagccgcgagtcctccaccgggcaaataggctccgaggggccccgtgggccctcctctcctccctctcagggcagcaggggccgctgggagacacggcggaggcgggcgcccacgggccgggtcccgtcacccgcagcagtcgggatgcgggggccccgccaccttccgccgcacaagggggccactgccgcaccagccacgcgtgcgcggtgagcccagatcgaccacgagttgaatacgcaaactggggttgggtgggacggcgccccgctgccagttgcacaggtggcaccgattgcgtgtgacgcttcctgcggagccctaggttgctgctcatctgctcgtcccggtactcgctgagcatccagcctctcgctttcccctgacgtagatgctagggcacaggggactgctatggttctttgtggtagaccgtgtgttgtgtcttctcctgatgctagctcctgcccctcagacggacccacagcgtcagttcgccgggacgattggcaggaatagtaaaggtcagctcagggctatcagtgcgaacagctcaatgcccagtcgatctagtcgattgcgtgagccactgacctgtgaggagagatagataacaggacaccgggagtgagatgtggggtctgtctagaggttctcccagtgaactattgtagctttggcgttccactcacctgttgatactcgttactgagtttcctagacctggggtgggtgttccacccaggaggaggggggtcccgacactgtgtcctgtggtggccaatttgcagctaaaatgctgggtcccttctcttcc

SEQ ID NO: 516018 - DNA, 1154 bp, Homo sapiens
gctcgtgaaggatcgcctcgggggaccggacgcggaggactacacgttctggacaacacaaggcacgacagtgactacgttcaccgtacacgacaggactgtgacttgacgctgaccagaccgaccacgctttgactacacgacactgtctctggaccacgtgacacgactgtatatggactaggtatgaccgtctctacatgctcactctggctcgtggaccacctggcaaaacacctacgacgccacgacgtgtggctagccgacagccttacagaacgtaaacacgacgcacgacgacacacggcaaacagtgacacactggccagcttgtggcatgcatacacgtcacatcgcgcgttcatggtcctcacacgcataccgggcacttagcaggcattctcgctcacacaatcaacgactattctccagacaacggcgccagtcctccattgtgggacttactgaacgcgctgaggacgtgcacacacgactccaggcacactacgatgataccacgtggacctctctggacttctcgtatactatctgactacactgcaccacacgcatcactgaagacatgcattggagaactcatattcatactgacgcgacactatgaccactgacgcgaccgtgttgacggcagcacgcatgcatctgctgcttgtgagctcgctgctggccccactactccttgactacctggacagctgcacgcgacagacaactccattcatcagcgcacagtacatccatgcagcctctggacagcacccacatacacaaaacgacaaagatgcgccgctggcaggtgggaccgaacgctggcagccccacccctgcaccctgcagcaccgcgacggggcgacatgccgcgggcagggaccccgagcaaggcacgcgacatcaaacgcacgccacgcatgacacactggagcccggccacacaggggccctaacatgaacaaggggcctcaccaccactcccccggggagccccccaatgggacgcggcccaccggcactggaagaacgcaggcaaccccaacaacacggagaaacaaacacagacaccggacagacacaaagcaccccgagcagaactactccacacccagcatgacgaccacactcgcacaccacaccaa

SEQ ID NO: 516019 - DNA, 781 bp, Homo sapiens
gaacctttctttccccagtgtcctaaaagtatgaggatctcctgtttcaaagctgaccaaggcattatgggagaaacttgggacatacgaaacctctagcagttgtgtaattaacctctggttgatgctactattatatatggttatctttttactatgacacgccttgaccggatttcgcgattcatcttccatactgctcgaattaggccaattagcattctgaattggggtgcggaccttcccacccttctgcctttcagcacaggtgtcctcttcggctctggggaagacggtgagatttgatacaacaatcatattgtagtttgccgggcaaaaggcacctttcaaaacaggagggctctcagctgtgggactccaggtatttaatgcttattgatcccttgttggggcttgccacatatatgtgagaaaccgacacggataaattaagaaaaatgtcccctattacaaaaaaggtccatcatggggcccactaaactggttgcattctcaacctacttaacgcggggcattagcactaattcacttcggcgtacctaacgggcagtgggacaacactgaccaaggtctttgagctaacacaccatttgttgtttccccacaacaccacggggtttggttttaacatccctttcaagagccccccaaaaaaacagaggggaggacattgtgggcacaacacaatcctgtgggcctccccaattggacaaaaatttccctcacgatttcccattggtttttgggagcgttaagccca

SEQ ID NO: 516020 - DNA, 924 bp, Homo sapiens
cacggtggctcacgcccgtcatcccagcacttcgagaggccgaggtgggcgcatcacaggaggtcgggagttgggagaccagcctgagcaacatggagagacacggctgtgccatactaaagaacacaaatatcagacaagccaggcgtgggggtgcctccctgtaatccccgctaatcgggaggcggaaggtgcggtgagccataggatcgcgccagttgcgccgtctagccggggataagcaacgagtgaaattctgtcctcgaaaacaggacagaagtcgagaagccagatgctaagaacgtggtggaccgcaaggaacgcgaacaagaaatcgttacgcagcagacgcactggcgcttgcggtcgaccggcgagggccgaaaaagacgagttacaggtaagagccagtcggcacgagtacgccaggcacgccgtaaggggaaccagtctgggcgcaaccagcgcagtaacacggactaggcgacgtatcctccggggctgccattgaccaaagatggcgccggggagtgcctaccgcggaaagcgaataggcaaagaaggcaaggcgagacggagaaagtagccaggactccgtgaccgggaaccccggcacttcggcaaggacctgagtaacgaaaggcatggggaaggtttcccaataatggccagagggcctccggaaattagccacaggaatggaagtgcccgcgaggggccacgtggacagaaagtaaatggaaaaagttaaacgacacccgaagcccgagagaggaaacagacacagcaccaacgaaaaacggccaaggaaaacacgccacggaaaaggccaaacggcaaaagggcaaaggaaaaaggcaaaggacaacaggaaacaagaacacaccaaccagaacaaaggaaaaagacacacagccggagaaa

SEQ ID NO: 516021 - DNA, 141 bp, Homo sapiens
ctcgaattcaagcttctaacgatgtacggggacatgttggccaggctgccattcaactcctgacctcaagtgatctgccctcctcaccctcccaaaatgctgggattacagggaatccagaaaattggtaatcccaaaaaa

SEQ ID NO: 516022 - DNA, 361 bp, Homo sapiens
  misc_feature (31)..(31): n is a, c, g, or t
  misc_feature (34)..(34): n is a, c, g, or t
  misc_feature (60)..(60): n is a, c, g, or t
  misc_feature (63)..(63): n is a, c, g, or t
  misc_feature (85)..(85): n is a, c, g, or t
  misc_feature (262)..(262): n is a, c, g, or t
aaatagcaagcccttgccacttttaaaaaantcncagagggcctgggcgcaatggctcangcntgtaacccagcactttggaagnccaaggcgggtggatcacctgaggtcaggagttcaagaccagcctgtccaacatggaacagttggcccaacatgggccaataaatatcccatgtatatttttagtctctactaaaaatacaaacaattagctaggcgtggtggcagacgcctgtgatcccagctactcggggggctnaggcaggagaattgcttgaacccaggaggcggaggttgcagtgagccaggattgtgccattgcactccagcatgggctacaagagcgaaactccgcctc

SEQ ID NO: 516023 - DNA, 125 bp, Homo sapiens
tgattagaggatctccagaggacaaggaggccactgatacaaaaccataccattgctcgttgacaatatagctgctaagcccgaggctttagtcatacaaagaaaataaagaaggaaactgtctc

SEQ ID NO: 516024 - DNA, 289 bp, Homo sapiens
  misc_feature (216)..(216): n is a, c, g, or t
tgcacgacatctagaatagcgatcatggaaggttgaaagacaggtcatgacaaagtcaaagaagtgagcagctgagaagggtgaaggacaagatcattggatgagtggatccaagctgagtggaccaggcacggtggctcacgcctgtaatcccagcactttgggaggcggaggcaggtggatcacttgaggtcaggagttcgagaccagcctggncaacatggtgaaaccctgtctctactaagaagtccgtcatgagaatcacccctttgcaactccaacagcctct

SEQ ID NO: 516025 - DNA, 388 bp, Homo sapiens
tgccctctggcctccatcatcactgacatcatgctgattgtccccatgaaggccagccttgaagcttggtcagtctccctaactgtatgattgatccccacttattgcactacatcactgagttcccgtatgccaagttatggccacttacatccacgtgagtaatggttacttggattgtcctctagtatgcatttgtaaaacctgagcagaaagtcatccgggtatttctagttgggaatctaaaattttactagtattgggccgggtgcagtggctcatgcctgtaatcccagcactttgggaggccgaggtgggcggatcatgaggtcaggagatcgagaccatcctggctaacatggtgaaacgtgtctcaactaaaaattaa

SEQ ID NO: 516026 - DNA, 107 bp, Homo sapiens
tagcgggtctcatacaggggtgtgggcatgcatgcttttattaaggctcttgttacacctggcagtgtactgtatcaacgtataatacagaaaatgaaatctctatt

SEQ ID NO: 516027 - DNA, 456 bp, Homo sapiens
tagaagcgcccagcagccgtccatcatacccctatcacggcccaggcctatgaggagctagtcccggcagtttgacccccagccgctaggccatagcagttacatacagccagtacagccctagaggacatacgtcacggcgcagatagagggcagctaccggggcgctagtggcgcatacagtaccccccagccgtgcccagatagaagcgggagctactacaacggcacggccgacatacaccctgcgcttacacctaggaactatccagagggacctggcgaagggaggcactgtggagtatagccaacgagaagcacatgctggccctggccccaacagcactagcacggggcagctggccagctagtcagggcactcggaccgtcagaggtcatcccaattcttccccaagtacatcgtgccccaggggccgaagcacccgtaacatggac

SEQ ID NO: 516028 - DNA, 493 bp, Homo sapiens
  misc_feature (404)..(404): n is a, c, g, or t
  misc_feature (410)..(410): n is a, c, g, or t
  misc_feature (421)..(422): n is a, c, g, or t
  misc_feature (437)..(437): n is a, c, g, or t
  misc_feature (439)..(439): n is a, c, g, or t
  misc_feature (442)..(442): n is a, c, g, or t
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctgcctcgtcgttcgaggcctcgtcagcaggtcatcgcgagctgggcgggctgagcagcccgggccgctcgggcncgggangtgggcagctnntcgctcgggccctcngntgnagacggctgcaggtcctgggcccgccctggttcagcgctaatggtaactgc

SEQ ID NO: 516029 - DNA, 2817 bp, Homo sapiens
cggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctgcctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattatgacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccagg

SEQ ID NO: 516030 - DNA, 435 bp, Homo sapiens
  misc_feature (408)..(408): n is a, c, g, or t
caagcgtaatggcacgaccacggtcggatcaaagacacgcgaacagcgtcccttgatccaagtgaccttgatggccaaccccaccacttgtatcatcagcagcactggaatccacggcaaagaaaatatctggttgcatgagattaactgcgccatgcgcccacgcaagccaacttcttcctgtacattagccccataatcaacgtgttcggcgttgtgacgtcttgtaggtcttctaacgcccctaataacgtgactaacccaaaacggttgtcccaagcttttgacatcacccgttgctgattggccgtcaagacggtggtcacttctggcacaataaagtcgccaggtcgtaccccataagccatttcttcctgatcatccacaaacccagcattaaacaacatntcatcaacagttggtaactgtggtgct

SEQ ID NO: 516031 - DNA, 309 bp, Homo sapiens
cggacccgagctttctccttcagtgaaggctgggcgttgtggctcacgcctgtaatcccagcactttgggaggctaaggcaggcagatcacctgaggtcaggagtttgagatcagcctggtcaacatggtgaaaccctgtattttttagccatcatcttcacttttttttcttttttttttttggagacggggtctcattcattaccccaggttggagtacaggggtgggatttaagttaaccgaaccttttgcttccaaggttaaagcatttttggggcctcaccctccggagaagctagaataacgg

SEQ ID NO: 516032 - DNA, 1865 bp, Homo sapiens
tgccctctggcctccatcatcactgacatcatgctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattatgacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccagg

SEQ ID NO: 516033 - DNA, 531 bp, Homo sapiens
  misc_feature (20)..(21): n is a, c, g, or t
ttatcgacacacattggctnnactgacacaaaccgcggcgctccacaaggttgcactgccttgccatagttcaattgttcaccaccatggtgtaaagtggtgaaatatcagcggagtggtcgccatgaaatccagtcgcgccagtgctcaacaatccgataccgagaccgtaagggcctcgatcagtttcccagcaggtgactacgccgagctgcaacggctcgccgcgagcatgaaggtgtcggtggcgtgggttgttcggcaggccattgaagagtatctggccaagagggggtacggatcagacttggtcaagagaacagggtaactcgacgcacttcgaagagcggcctcaggtgcgctcattcagcggactctgccaccgcgcgtggcgtgcttcggattcgcagggggagagccatggatgtattcaagctcagggagagtctagtctctgactacagcagcttcgcgcgttcgttcacttccatccttgctgacgatatccgtggggggtcgagccaacattgt

SEQ ID NO: 516034 - DNA, 1855 bp, Homo sapiens
agcgggacttagcctgtggcagaggcagctgcacacatgtgggagggatatgaacttctgagaaaagagaaaatcccatgttgtacccgactctaataggccaggaacgagctttgccattggaatgtggcagtcctgcctctgcaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattatgacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccagg

SEQ ID NO: 516035 - DNA, 446 bp, Homo sapiens
tggatgtactaggtggggccctagcctttctataagctctaagtaagataacacatgcaagcttcccggtccagtgagtcaccctctaaatcaccacgatcaaaggggccaatgcttcaggcacgcagaaatgcagctcaaaaggcttagcctagccacacccccaggggaaacagcagtgataaacctttcagcactaaacgaaagtttacctcaagctcatactaaccccgaggttgggtccaatttcggtggccagccaccggcgggtcacgacgaattaaacccgaagttcaatagcaagccgggcgtaaaagcagtgtttacagatcaccgccctccccgaataagagctaaaactccacctgcagtggtacaaaaactcccagtggacacaacaataaactaggacaggtggcttaaccattatctgaacacacaatagc

SEQ ID NO: 516036 - DNA, 541 bp, Homo sapiens
  misc_feature (4)..(4): n is a, c, g, or t
  misc_feature (73)..(75): n is a, c, g, or t
  misc_feature (83)..(83): n is a, c, g, or t
  misc_feature (113)..(113): n is a, c, g, or t
  misc_feature (211)..(211): n is a, c, g, or t
  misc_feature (279)..(279): n is a, c, g, or t
  misc_feature (300)..(300): n is a, c, g, or t
  misc_feature (325)..(325): n is a, c, g, or t
  misc_feature (347)..(347): n is a, c, g, or t
  misc_feature (375)..(375): n is a, c, g, or t
  misc_feature (397)..(398): n is a, c, g, or t
  misc_feature (419)..(419): n is a, c, g, or t
  misc_feature (428)..(428): n is a, c, g, or t
  misc_feature (436)..(436): n is a, c, g, or t
  misc_feature (438)..(438): n is a, c, g, or t
  misc_feature (462)..(462): n is a, c, g, or t
  misc_feature (464)..(464): n is a, c, g, or t
  misc_feature (541)..(541): n is a, c, g, or t
cgcntcttaaataccagcttataatacttgacattttctaatcatttcaaattgggtttcccataagtgtttnnnatgggagngcattcattcacttgggtgagttaccagtntttacttccaccaatccaaagtgggttttggtttttgaaattgtccatactgtagtcattcaaaaaaatacaatatgcttttgaaatgtctagctttnaagaaaaaagtcctgtgcttcctaccccagttgtgggtttttactccaaaacaactcatgtacccttnttttctttctgcctgtttttntgtttcctctcttgcttttttaagnctctttcctgtttctctctttnttccttctccctcacgtttcaggtttgntggaagggtaagttgtgtattnntggtgttgtgtagtggggggntcccggtgnccctctgngntcccattactggaaatacaacagncntggcccaaaaatctgatcttactagtttccttcagggtcaaatccaggatattttattgtacaaaaatttccaatgn

SEQ ID NO: 516037 - DNA, 1925 bp, Homo sapiens
tgccctctggcctccatcatcactgacatcatgctgattgtccccatgaaggccagccttgaagcttggtcagtctccctaactgtatgattgatccccacttattgcactacatcactgagttcccgtatgccaagttatggccacttacatccacgtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagggtatgaaatcaaggcttaggtgcaaagccatggataccatacctgagaccacacagccaagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattatgacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccagg

SEQ ID NO: 516038 - DNA, 909 bp, Homo sapiens
  misc_feature (300)..(300): n is a, c, g, or t
gactgcgcacgagtctaccgacgcggagattctcgagcttcactccaaggatgcagagaccatctgagcccgtcctaggcgcggtactggactggccctcgtgaggctgatggctctgaaagacgtacggcgtctagcagtaaggaaccatggtataaggaacgtgcattacaacagagtactatccaagactgatgaaactcgggaatgaagtccggtatcaaggtactgggaaaccagaattggccttcggacatggccgtcaatcgggcaaacaagggtggacgtcctgttcagtgntcgtgagccgtgtggacctgaccggatagggcgcaggaagagtacttgagctcccccgaaagtcttaggtggtgagccatcgagaattcttgctgtacgccacatagcgcaatgagcttgcgttactgtcgggatacgctctttttctgacttggactgcgcggttactagacgcagcggtgctgcacggtcagtctacgaagggaggaatgcgagaaaagcgtggggtacgcaaaatacaccacgagacttgttcgccgtggtgtaccccgatttgtcccaaccctaaggaggcttactcttggcgcaccgtagaaccttaatcgcgctagaagcgaccccacagcggcaaccgtcttgggcggagcactctcgtccaggggaacctcgaaggttccccgaaaatctagcgccgcatcgtatatagaaccccacacgattaagaaacccggtagcacgctagacggaggctaatctatagtgggttggccacaagcagctaggtctttaggcgacgttcgatagctttctgctcaaaacaagtgcccctactgtatagctatggccacagggagaagcgttcgcatacaagctggctagaataacccg

SEQ ID NO: 516039 - DNA, 1239 bp, Homo sapiens
cagtctagcagtgttgcgtcctggttgtttgctgacgtctcttggtggtgagatggacaattacgattgcgggtgatctccagttctctacggactcctggtgtgtcacgctgagtgaacttgggcacgccaggctgctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattatgacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccagg

SEQ ID NO: 516040 - DNA, 640 bp, Homo sapiens
  misc_feature (107)..(107): n is a, c, g, or t
aatgttccctcatgctctttcttggcaaaataaaacaaagcaaaataactctccatatctcactccctaaaattatcactattctgaaacttctatcactataaatnggttgcttattgttgggctttttttttttttggagaacagggtctggcctctgtcgtcgggcttagctagagttacaggggcgtggactcagtggcttcactgtgcagccttcaacctttccgaggcctcagggaaattctcccacctcagcctcttgaatagcggggactacagtaggtgcacgccatcacaccgggctaatttgggtattcttggtagagacgaggtttaaccagtgtggctataggcgggtctgaactccgtgagctcgggcaatctgccgtgcctgggcctcccaaaggtgctgaggttcacagatgttgagccacgggtgcccagcctattcttaagccttttataacatagatctcataaagctatatcacgggttgggttctgggttctctttcattctcaacattaagggtctttctcagactttataccgtgagggccgagtttattctctcctaatggctcgtatagcatttccatgggtgtaccctagtttatatgcttaaattttaccagt

SEQ ID NO: 516041 - DNA, 126 bp, Homo sapiens
gggacacctcaatttctgcctgtctgagccgtttaggtctaagtatatcaagggagttggcagtgcaccgaggtgggggatcactggttgaagaatacaggatggtgagatgcagaaactgcatta

SEQ ID NO: 516042 - DNA, 115 bp, Homo sapiens
agcggttgacggacatatctgtccgaggggtcgtgggagcccagcgcctgccttgagggaaatgaacactgaatacaggatttgggaactctattggcttgactgcagagaaggg

SEQ ID NO: 516043 - DNA, 273 bp, Homo sapiens
ctggcaacatggtgacaacctgtctctactaaaaatacaaaattagccagggtgtggtgggcgcctgtaatcctagctacttagtagagtgaggcaggagaatcacttgaacccgggaggtggaggttgcagtgagccgagatcacaccactgcacttcagcatgggtgatagagtaagactctgtctggaaaaaaaaaaaggaaagcaaaacgaaaggaggcagggagtaccccaggaagggtaaggtaggggtaggtatgcatgaaggacg

SEQ ID NO: 516044 - DNA, 895 bp, Homo sapiens
  misc_feature (52)..(52): n is a, c, g, or t
  misc_feature (72)..(72): n is a, c, g, or t
  misc_feature (125)..(125): n is a, c, g, or t
  misc_feature (153)..(153): n is a, c, g, or t
  misc_feature (186)..(188): n is a, c, g, or t
  misc_feature (224)..(224): n is a, c, g, or t
  misc_feature (248)..(248): n is a, c, g, or t
  misc_feature (284)..(284): n is a, c, g, or t
  misc_feature (365)..(365): n is a, c, g, or t
  misc_feature (371)..(371): n is a, c, g, or t
  misc_feature (378)..(382): n is a, c, g, or t
  misc_feature (384)..(384): n is a, c, g, or t
  misc_feature (388)..(388): n is a, c, g, or t
  misc_feature (475)..(475): n is a, c, g, or t
  misc_feature (498)..(498): n is a, c, g, or t
  misc_feature (503)..(503): n is a, c, g, or t
  misc_feature (508)..(508): n is a, c, g, or t
  misc_feature (544)..(544): n is a, c, g, or t
  misc_feature (551)..(552): n is a, c, g, or t
  misc_feature (584)..(584): n is a, c, g, or t
  misc_feature (632)..(632): n is a, c, g, or t
  misc_feature (641)..(641): n is a, c, g, or t
  misc_feature (665)..(665): n is a, c, g, or t
  misc_feature (679)..(679): n is a, c, g, or t
  misc_feature (688)..(688): n is a, c, g, or t
  misc_feature (699)..(699): n is a, c, g, or t
aaaaaataaaagggaggtgggcagcaaacacacaaagtcctagtttcctggntccctgggagaaaagagtgnggcgaatgaatccacccactctccacagggaataaatctgtctcttaaatgcnaagaatgtttccatggcctctggatgcnaatacacagagctctggggtcagagcaagggannnggagagagaccacgggtgaaaacagcagctacacanattcacctaattccatctgagggnagaacaaagtggccaagtcttgggggtagcagctgntcccagagtcaagagaataccgtacacccctggggagatttgctcctaaaaagaagtggaagttaaaaacaaaaaaaaaanaaaaanaaagggnnnnntntttnttgggccacactcttcaagaaaatgccataaacctgttatttaatattttaatttcatagcattggacacacactcaacatattganatattgcttccttagagaaaaanatggnaaaanagggaacaaaaaatattgcatctttctgctggggantctcggnncccgggcatggggtgtggtgcaccagtgtccnagcctgcgggaggcgctgaggtcggccgggtccttttttgtggaaggntgtgcccantgcctggggctgtatggcaaaaantgtgttgggtgtcnttggccttnccagctcatgncctcagtcgccggtcacctggggggcctgcccgtcggagggctggttggctgactggatgaacatgggctgggcgaggtcctggcccgcagcatggtgacttgctggatctggtagagctgctgtccatctgtgaactggctgaactgctgctgtccttgctggacctctgtctgtgtaatctgttgagcattggt

SEQ ID NO: 516045 - DNA, 152 bp, Homo sapiens
  misc_feature (48)..(48): n is a, c, g, or t
  misc_feature (110)..(110): n is a, c, g, or t
  misc_feature (140)..(140): n is a, c, g, or t
  misc_feature (149)..(149): n is a, c, g, or t
ctgggaatcagcaccgctggaggagtaggcagcccacttggtgatgancctccatttattcaatgatgcacccaactggagttgcagcacagacctaaaaactcagagcnggggataggattgtcaccatctgtgggcanatccactcnagg

SEQ ID NO: 516046 - DNA, 286 bp, Homo sapiens
catacgctctagacggggttcacgcgggttagaaaggaactctgtcttatccacggtcagtaggaatgtaaattagtacagtcattatggaaaagagtatgcaggtttcttcaaaaataaatctaccatatgatccggcaatcacttgactagatatttatccaaagaaaatgaaatcagcacgtcaaagaggcatctgcactcccatgtttattgcagcagtattcacaatagccaagatatgaaaccaatctaagtgcccatcaacaaatgaatggataaagaa

SEQ ID NO: 516047 - DNA, 85 bp, Homo sapiens
  misc_feature (36)..(36): n is a, c, g, or t
tcaagcttctctttttgcttatgaatattctgtatntataacccattgttttctgtagtttaattaaaacattttcttggtgcta

SEQ ID NO: 516048 - DNA, 426 bp, Homo sapiens
gcatacttttgacctcatgcaatccacctgccttggcctaccaaagtgctgggattacaggctagagccactgtgcctggcctctggtcactttgtaactgcgaccctacgcacatgtcttaacctcgctgaggctgactgcttatatgtagaagggggaggataacacctgcttagagaagctatttcacgtgataggaaacatatacatgcatcgttcaaagtctcgcctatattatgcgcttacgaaatgtacatgtctatacatgtgtatctactgcatgttactgctccttgcatctgataacatctggagatgccatactttgctgtagactttatattgtggacatatgtataccatctgtccatagtttcagcggctgaagtgtgctcatagtacagccactatgtgttgcgtgtgtg

SEQ ID NO: 516049 - DNA, 206 bp, Homo sapiens
  misc_feature (22)..(22): n is a, c, g, or t
ttttatatatgtataagaatgntccacaagaagtgtttgtaatagtaacaacaggaaatggccaggtgtggtggcgcacacttgtaatcccagttacttgggaggctgaggcaggagaatcacttgaacctgggaggcggcggttgctgtgagccaagatcgcaccattgcactccagcctgggtgagaagaatgagaatccatct

SEQ ID NO: 516050 - DNA, 338 bp, Homo sapiens
ggtcgacatagaaactagagcatagcttccataggattatgggcaaatagtccaggcacggtggctcacgcctgtaatcacagcactttgggaggccgaggtgggcagatcacgaggtcaggagatcgagaccatcctggccaacatggtgaaaccccgtctctactaaaaatacaagaaaatcagctgggcatggtggcgggctcctgtagtcccagctactcgggaggctgaggcaggagaattgcttgaacctgggaggtggaggttgcagtgagcagagatcatgccactgcactgcagcctggtgaccgagcaagactccgtctaaaaaaaag

SEQ ID NO: 516051 - DNA, 415 bp, Homo sapiens
agtgtgctacccatggaccggtatattgcgggggaatgagattacaccctgtaacttagatcatatataaaaatcaactcaacggggatcaagagataaactgatgagctagagtctataagagtcctagaagaaaacagtagtgggaaaatcttcatgaggctgcatctggcaaggtgggaagtatgacatcaagggcaaggacaacaaaagaaaaagataaactagagttcatcaaatttaaaaacttgtgtacatccagcaacagtatcaagaaagtaaaaaggctgactgtggttgcccacgcctgtaatcccagctactctggaggctggcaggacaatcactggaacccaggaggtggaggttgcagcgagcccagatagtgccattgcattccagcctgggcaacagg

SEQ ID NO: 516052 - DNA, 1112 bp, Homo sapiens
  misc_feature (201)..(201): n is a, c, g, or t
  misc_feature (225)..(225): n is a, c, g, or t
  misc_feature (228)..(228): n is a, c, g, or t
  misc_feature (358)..(358): n is a, c, g, or t
agggaacagctttcctttgccgccgaggaagtattattggaatggccggcaacatccccttttttgcttcacccttagccccctttgcttcccagccctgaaggttttacccggctatgctggccccctttgcccaggacactcttccctctcgggatgtgtgattaactcccagaaagggaaagagggagccagggcaanataggaagctctgcctgagctttncantaggcacgccagccagaccaataaaaagcgtctgtcccactctgctaagcctggttttcttgagcagagggatggaacagagggtgagagaggcagtggccgtctccacctcagctcctgctccctctgnatcagagcccttcctttcttgggggatgggccttgccctcttctcttttcccttcctgtacctttgactaacgctcagcttccgggcctgcatggcagaaaacaggaaaaaggaggaaagagacacgagagtgcacacggtgagatactcacagagaagcagaagtaggcagaaccgcgtggagtggcaggctgcctaaagacttccgttacgcctgccttctcccagtacagttccaaagaggaagtcaacagtaagcagcagcctccaagactgtctcctttcggccagatatcataagatggacgccataatcctgaggcctcctagaggctgagggggcaacggtgtgatccagctggctcatcccagacccaggtgggccagttattcaaattgttcaagaagtttggtgtgcaagccaggtagtcaaagcagagagcagttataagttatgtaaatggtggaaattatgttaaaaagcaaggacgaataaagtattcaagaagtgcatcccataagttactaaggaaagacagacaaaaacagacaggaaggaactcaatatacaggggatacgcgcaacaacacacggctacagcgccaaagtgcacaacgggacacagaacaggaagacgaaggccccagcgcgacccagcacacaaatcgggaaacaacacggcccgagaacaccacaatcaaaagagcacgcatgaaaacgaggaaacacgcaaggagtaacccgcgacaaagg

SEQ ID NO: 516053 - DNA, 100 bp, Homo sapiens
gcgagcaccgcatcacacatgctgctgtcccaggaccagtccagtcctctagtgccttatctgagtgctgcagccgccagtctccaccccaaggagacag

SEQ ID NO: 516054 - DNA, 222 bp, Homo sapiens
cacgaggcctcgtgccgatgtgctgggcgttggtggcagcccgcgcttcgagttcgcggatataggcctgggcggccggcgggaatcgggagaagtcgtgttcgttcatgctgaacacaatagtgcagccgccgcgcaattgggtatacgtcacaccaaacggtactcaagctgtgtgctgatacttgcgcgaagggtgccgctgcacaggatccacgtcta

SEQ ID NO: 516055 - DNA, 183 bp, Homo sapiens
ttcaaagtgtgaaactaaaaccttatgggtgtaccttaaatcttggcatggtgcctctatgtcccatttaaaataaaataccttttccttaactttagattggaaataaggttttattttgatggatgaatttttgcctgatgactttactctcaataaaggctgaaaattgtgttttactga

SEQ ID NO: 516056 - DNA, 165 bp, Homo sapiens
tgtgtgggctgctaacaatgcaatgaaaaccaccgctgcagctgatctgggctttttggttgttaagtagagtctgggcagagtcgggaaactttcttttttctttttgagacagagtctcgctgtgtcactccagcctgggcgacagagcgagactccagctca

SEQ ID NO: 516057 - DNA, 221 bp, Homo sapiens
ggacgaatcagaaagggcactatgatttgagagaaagaacggacagctacaatccagcctgtacttactccatttacctaacactgaattactcgttaggactgcattagccttagctagtgttaccatttcttgctattatcacactaggagtgcactgttattggtgcactactcgttgacccccgtctcaccctacttcctccagttcctctgtgggt

SEQ ID NO: 516058 - DNA, 401 bp, Homo sapiens
tttaaaaaaaaaaaaaaaatttttaaatttttatttttaggtcccttaaagggggcgggttttccttttgccctttaacccccaaaaatgggaggggaaggtttattttggcccccttaaagcaagcaaaaaaggtttttccatttccctttttttttttcttttttcacaaaagggaaaaaggtttttccctggtttaacgggtttttttttaagcccttccggtcggtttttaatttttggggaggtttgtaaaaggccccgtttttcccggttgaaaggaaggtttttttttttttaaaaaccaaggggttttttaaattttaagggaggaggttttttttgggaattcctttgtttttatttgtttaaaggttgggaaattgggaaaccccccccca

SEQ ID NO: 516059 - DNA, 932 bp, Homo sapiens
ggtctcctggaactgctgctgactacctggctgcatagatgatgcctggcagcttgcactgtgactgctccagttcccactgcaagagttcatcctggccatgggcttcttcctggtcctggtgaatggagcagatcacacttggcttacaaaggagcagtcagggcctgtcacctctggatgtgaaacaacggtgctctgcttggtgaacatgtgaatggttgtgtgcctgcagcattgtgcatgatgggccaagggtgtcccacaaggctgagtggatgccccagcaaacccctcagccttgctgttgccttgtgtacttggtgttctccctggccctccactccgtgttccgatggtggctggcggtagtggcctgcagctgagacctgggctccgggggccatggagctgtgcctggctttgcttggctccacaagggcatcctggctgtcagctgtccctgcggcttgtttgcagagccaccttagggcacaggtggtggctggctgtgtggatcctcttctcatgcatgacacctctagtgcatccgggctgggtgcagtctggcagagtcggcaggacctctgcagcacgctggcccaagtcttgtgctaagagcgcgcattggcatgttggcacctttctctataatcaccttttcttgagaaatccttgctcccaggagctgggcagttcttgagcaaaggatcctccacggtcatatctgctccctagcacggtttgctcttgtcacattggcctggttctattccaaatctagggggcgtccaacagatgggcactgcgagatagctgaacggtcccctgttccacttccctctcccaattcgcggcgcaaacgacgcgagcccgcgccatatctctcagacacaactctcgcagccaacatcaactcgcgcctccgtcag

SEQ ID NO: 516060 - DNA, 1597 bp, Homo sapiens
  misc_feature (1597)..(1597): n is a, c, g, or t
acgtcgaccttaggaggcaggtaggttcttaggacagacgaggcatggtcgggataccgctggctgctggacgagttgatgagtagcgtggcggaggatggctacagcatgaagtggttacactgtggaactcttcactaggatcgagcgtaggtgaatgcacacatgggagaatattcattcaggaagacaatagtgtacgagaggagacgtggattgcatggtagaactagagcgcaaatgagccgtgccgtgtactatagttcatagtcgctgagagttgcatctcgtgactgacaagggacgaaaaatccgacggaacgagtggggcctagatgctgagtctatcctagaaagaaaattgccctctttgatggaagcattgtgttgagcgatctaccaagacgtgagccattagatagagcgaattcattgtgagtcgtccacatggattagcatagacgatactagcactcagccaagtacatatggacgtgcacgttccttggacacggttacgtgcacataggcggtagaacgtcgatgcgcctatgtgcgcagttccatttagccacgcgtacgtaccgcgctggtggggcgcttgcatattcacccgttacacgtctgtcgttgtccctttctacgcataggtagattggggtgcctaggttagtcgggcaagggagcccatttagtgcgcggtacttcataaaggagtcttgttttacattaccctacaattcatgtgccgggtggcctcgccacaaaacacggtccttgttaacacttgacggacgattggtttcgctaaccatacaacataggatacagcggtgggactttcaaccttacaatcaaggcaaacggcaaagaccatcgaaagacaaaggccacggacagggtataaattatgcgattggtcatccattacgaacagcagtaccggctctaggaggggggagccctttattgcggcacagttacaccaaggacactttccatagcgacacattcacattctcctggttaaacctcaacaaggggcactgtcgcaaggaaggaacatgaaaagcaagaaagtcacccctccttagttgcgaacggcaaacaatcgacacacttaagtgtgagacggcagacaactccggggtgggactacacacacacagtggactttttcaggccgaaggacaacgacagatggccagtacaaactactcgcaagcaggaacagagattggcctacgggagagcagacaatgggacaccacggtgacaccgccgggccaaagaagggtaccacggcgccgaaatagctcgcagggagcacggataccaccatcagcctggggcatcgtgatggggacctacgtggcggcgcaagtcaacatgccgtgaagccaccccggaagagtgagaccgcgctgaatctcgcgagcagaggcagcggtgacacccccgaggcgtcggccaccggacagtggacacaaacaaagagaagaggagtgaaccaacacgtcaggtcagaggtcccacacgagggaagacgggacatcgggagaagcacaggagtagagcgacagacccgaatgcaggn

SEQ ID NO: 516061 - DNA, 514 bp, Homo sapiens
  misc_feature (13)..(13): n is a, c, g, or t
tgctgcttctccntcctcggagctcagttttctcatctgcaatatgaaggagttggactcgatcaatctttgacagtccatacctgctctaaaatcctatgtcttttcttgaagttactctatttaacagaatgcattgctttctcagtttgactatttgaattatgtttgcagtacacttattgctattgcatgttgtctaaaatagttttcctatatgatgtatattaaaactaatccctcttgagctgattgataatgtgtgtatatagccatacattaaaagctagtaatagtagggctctcataacatacttttccagttgtctaaccttggaatgttattaattcttctatcttacaggagatacttctcgtcatcgtactcacattccgtgattacagagtatgcaagagtcatcttctcaactgttgtcctcatgatttcctttctggaactgtatgtatttactatatgttttgttagattactggtatgctgcagttttggact

SEQ ID NO: 516062 - DNA, 150 bp, Homo sapiens
gcaacttagagttcttagagctttctggttttttagcttagtgctggctatagcttgtaatcatgtcggttgtatatttcatttacggcagtttttttgtttgtcagccattttggaatgtgtcgcctgcagtagagacaggttgaaggg

SEQ ID NO: 516063 - DNA, 406 bp, Homo sapiens
  misc_feature (140)..(140): n is a, c, g, or t
  misc_feature (142)..(142): n is a, c, g, or t
  misc_feature (151)..(151): n is a, c, g, or t
cacagagccgccttgcactgttttccctccaccacagccatcctgtccctcattggctgtgtgctttccactatacacagtcaccgtcccaatgagaaacaagaaggagcaccctgccccaaaaaccccaaatgtttggngnatttccccnacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctttcatgaatggaatggaaaaaagatgactcagttaaaaaaa

SEQ ID NO: 516064 - DNA, 178 bp, Homo sapiens
  misc_feature (144)..(144): n is a, c, g, or t
agctcctgttactccctcttaaattatgtgggaaatcttaacggaagggcaatgggcccaggaatacctgcagcgtagtgacctcagatcctgatactcaccatgaaactctaagatactgattggaagcgacttgtggctgcnggctgtgtgtgtgactctgccggggaccctggca

SEQ ID NO: 516065 - DNA, 332 bp, Homo sapiens
gacagaagggaggcggggaggtatggagcaccagtagagaccacctttgtctcaaagcagaaactgattcagttaaaagtggatttggggtcaaaatgcgcgtgttgatgttctacaaaagttagaagttgcacacattgctcaaaagaatctaagtattaaaaaagaggtaccaggccacacccgtgctctttttgattcatctgcacctttcctcagaggcagctgggcactagcgcagcacagcctgccggtgaaatagcagctccatgctgttgaaggtcttatactccataccagcaattccttcttctccccttcggtcgtcttct

SEQ ID NO: 516066 - DNA, 425 bp, Homo sapiens
gccattatggccggacctttaggaaaggtaatgggaaaggttaaggaagggcttgggggccaaaggaaggagaggaggtaaattttccggatgggggggaaaatttaatttcccagttaatttcaatattccttaacggggtaattcctggaacctttaaggtttaaaacctctttattaaaattcatggccaactcctagaatccaatccttttaaaaggttacctaatttccaagggggttgaaaatatggttaaccattccaggattatgaatggactgtgaagattttaaaattaaccttagggcctaaattagccactgcctggttaacttggctgaaattttttaaaccgcctggtttttaatatagcaacctatttaaatactgcctggattaggttaaataaggaattttaatgtcc

SEQ ID NO: 516067 - DNA, 912 bp, Homo sapiens
gcactggctcagggccatgtggccatcgatgctggtgaactcgggggtgctgcaactgatgacctgtgctccagcccctgtcaagtactgctgcttcatccccccagtggctcacctaactgcttctgccgacactgcctgtactaccagaggatctcagattacatcgatgctgcaagtggcaatacagaccgggccactggatgcatcttctacaactaaacccagactcttatggcctgcaccctagggaatgatgcagacatccagacatactaggtacactttgacgtgaggctcgagtagactcaagactatgtgcatcaggaatgatggacagtccctgctatctgttttctacttggtactacgcctgtatcgagcagagaatgacctggtgaccgctctttagtggccctcaggacgccccattcgccccaatacccagtcacggttcctcgcacaggacgccctggcccatggttggggctgctggggttggtgtgtggaccttggagactcatgcccatcttggcaggatgtccctcgtgaactcggatgcaactggctctgggctgctttgtctgccagtgccgagtgtctggcctgtcgctctccccagagctcctgctggctgctgggatcatatcctaagaccgctagctccttgactccgagggtggcagaccacacaggaagtccatgtactacgtacaggtgcccgtagtttgccttgggagcccgagatccatggcgagtggtctccccacagaatccggctaggaactgattcctggacgaggagaagtagcttgacggatgccagcttgtccagggaacagtatgtgacagttgtcttggagacaggcattaactgacacccacaatccccatgggctggaagggaccctc

SEQ ID NO: 516068 - DNA, 180 bp, Homo sapiens
aagtgggacgtaagggactccatctcctcgttgtgtcatccacacgtttcctgtggaagtgcgggaggaggcgggggctgagggcgaggtgagcgagagcgatctcctggatggcgaggcgtagcttgggtcggatgcagaggagttgctgactgccagatctcgacgctgcgatctccg

SEQ ID NO: 516069 - DNA, 286 bp, Homo sapiens
  misc_feature (161)..(161): n is a, c, g, or t
taagaccctgatcacggtccgacatgatgatattgactctagatgagtatttttgctttctgtcatgtgttatcttttgtctactatctaattagtgctttcatggattaaaactattggagtctattttttaatttcttatcttacagtattttgctatntcctgaatatactgccttatatctcagtgtattagaaaattagcttactgttacattagtggctttttaggagaaagtagagacatgtacttactcactctactgcgtttaagggaagttttttg

SEQ ID NO: 516070 - DNA, 112 bp, Homo sapiens
tgaagaattgggtagaagctggcaagaaaagctaaagatctaactgacaagcttgctgttaccatatattatgaaattactataaaattacggctacgcgggaagggaatgg

SEQ ID NO: 516071 - DNA, 1509 bp, Homo sapiens
tgctggcatcttagtgcttgtcttgtgtgtgatcgcgattgcctgggatgttattcgttcgtgttaacctcctggtggagctccggtccgatcgtccttcgggattttggctcaagggtcgcggtgacgtggttacatgtttaacgccgggtaccgtctatagtcccacttgtggccctacattgtagggcgtagcacgcctgagggcgtaccgtagtttgtgtgtctgttgtgggtgtcgcgagggggtagcaacgccggatccgcggagaatgtcccccgggaggatcagctccggtcgaagccgccaacgggcgaccgcggccgtaaggcacttccgactaagtcaaggaccgggggaatctggcaaagggccagaccgcgggccccaggtccaagcgggccgcgtggaagcgctacagctctgagcggggcgaatgtcgagtgaggctaagggaaaggaccccgggggccggtttttgtaagtgccaagtgtgttgtcagcgatgcccatgggtctttttgaggttgcgttgcacgaaaggctttcgtcttgatatcccgtttcgtagggggttggaatttatctcggccgtcttagccgcgttctcatgctccccttgccctcctcataacggttgctctttgggcggagttctaagccagggggctgctgaagttctccactgcagctaaccgtttggagccgcgcttatggcgaagttgcgttgcgtgagcctgtgttaaaaccgttttggtcaggggatgagttatgaggccaggagttgtaatttcctcagcagtcctgtaacagtcgtggcgagagtgacctgaaaagtctccagaggacacaggcgggagactaggtaagcgctttttcagactaagctttacagacgaactgagggtcgtgtgcgcaccgaaggaacagtacgtctctagtgtttcgtcgagtgctagtatcgaagagtgtttgcaggagagggtgtagtgttgtcgtgtgtagtcagtgtggcgtaaagctagagtgactttgaccactggagatcggggtcacacgtgcccagtgactcttggggtacaatttgtaaacgctagagcttttagtcagaggctcttggtgaagcaggttctctggtcagtaagtagctcaagtgttgctactctgctggacaagtcactgctcagtgtccagcatgtatggtattatagtaattcaatggagaaatatgactaaaacagctgcccgtcttcgctcggctgcatttgaagagaacgagagtgaggacaaatgagtgaaaatggttcgcctgaacaataagtggggagacagccatcgttaacttgcgcaagaaaactgaagggatgtggacgcgagctggaaaacctcctattagccagatagctgactggcactggtggtttttgctctcgacagtatccacaactagctgacggctgggtgtattcagtttgaaaatattttgtgccatcatcttcactgcaagt

SEQ ID NO: 516072 - DNA, 287 bp, Homo sapiens
gctcagttgatcctctaactgatatctttctgaagggcagaaatatggaaaaggttcttgggacccagtaattctatttctaagaatttatccttaaggctggggcgcaggggcttatgccggtaatcccaccactcggggaggccaaggtaggatggctggagggcaggactccaagaccagccggagcaatacagcaagacctctctctacaaaaaaattttaaaaaattagccaggcatgagggtgtgcgccggtagtcccagctactcaggaggctgaggggg

SEQ ID NO: 516073 - DNA, 345 bp, Homo sapiens
gggggggggggggggaccccccctagggggggcccctattggggtccccgggcccccccttagggggggccgggccccctttttaaggttttttggttgggggggcccaagggtttaaaggttggggggacccccccccacccggggggttttttttaccccccccctttgggtgggggtgcccaaagggggttttttacccaagggggtttttttttttagggttcttgggtttaaaattttttttggggaaaaggggggggaattttgttccccccgggggggggcccccccttttcccttgcccccaatggggcctttttttttttttttttttccggggga

SEQ ID NO: 516074 - DNA, 137 bp, Homo sapiens
ccgtgctgctgctgagaaggcgcaagaagttggccattatgcatcgcggtcgcgttgccatttattcaccagtaaacattgctgctgacgcacaatgcatgaggccgagcagcagcaacagcatgcagcaccaccag

SEQ ID NO: 516075 - DNA, 352 bp, Homo sapiens
aaggatccccacttcccctgtacaggaatacaaaatgaaataccacgtgatctcacctataagtgggagctaaacactgggtactcatggacataaagatggaaagaataaacaccgggactactagaggggagaaggaggaaggcaaggtaagacaaactatagggtactactgctcatgtattactctgttctcaccctgctatatagacctaccctgaggctgggtacatttataaagacacaagacggtttaaactgacctcacagttccccaggctgtacaggaaacatggctgggacggcttcaggaaaccttataatcctggcagaaggtgtcaggggacgaccg

SEQ ID NO: 516076 - DNA, 1178 bp, Homo sapiens
gtcttcagcaaggccgagctagtggggtctcagtgttcctgattgtagggggctggtgagggttactcaggagtggggaagcactgaggaagtggcattagtgtgctgcttacttgccagctcctccagggtgtcctgcactggaggactagatgtgggtatcaagagacgcaatgtgatccgagcggaccagggggctcggggcgggccgctgcacgagtccggctttgccatatcacttgttccctcagaaggcggtcgtgtgctgacaagagtggtccctttccacaggtgccagacgatcctgcgcacgacctctatgagaagctggtgctgcaaggcggaaaatccacattggcctgtagtaagacgggcggttgtgagtgttccttgttcactagaggctgttggcacacgttccaaaacactcactaggtcagatgggacgagggacctgctgagtctgggccgtccatgtagcactcgagtggttgtctgggacccagggcgtgagtagctatccatgaatctaccctcgtggtggcagtcagtcctgggtgttctactatttgtctcaacccggatgcaccggcggcttggtcctaaaggtccagtcggtagtatgggactagtcacatattcttgcacgctattgccgtgactaaagccaaatcttagccttggatggggccggtagttagcgtgatcatactaacccgccgggggaagcctcccgttttccaaggaccacggccaaggcgcttaaccaagtaaggacacgggggggcatgaagcggtggggcaccatacgcgttggagtaacggccgccattggtttggtagtgcccattgcaccatgacgggtgcgagagttggtaccaaatgcctggggccccttttaggtgtcggagaggccgtggttactgcccggggcgtagttcgtaaggggaaggagttgccatgcacggttggtggccaggggcacagccgcaccaggcgttccccccggggaagaaaatttttgacccctgggcagtgaaaatacgacgcgtggcctggtaacgaccacgcccaaggcacttggcgcgctttgcattccaggggtgtaccattcactcgaacgggcaggtgcttcagagaggacacaccgttctatggacgggcctctcgtgggatgc

SEQ ID NO: 516077 - DNA, 395 bp, Homo sapiens
  misc_feature (233)..(233): n is a, c, g, or t
tcaatgatgggcgcatagcatctgttatagatatcaccgacaccaccgattgaatctggttggttaaccaagatacgtgatgcaccgatagcatcagcatattccttaataaatggatcatcttgtgatccgatttgaatagccgcgttgtgtccggcaccttgatagtctaagagtgcttgtactgtgtcgatagcttcttcacgtgtgtcgaccttataaagtgacaacantggtgaaagcttttctgatgacaaggcttcaccgatgttcttgcggtctaattcaaacaacaagacatccttaccttcaggaatcttaacaccagcttgttcagcaatccaacgacctgacataccagcaactggaccaggaacaccaaaggcttctgcatt

SEQ ID NO: 516078 - DNA, 423 bp, Homo sapiens
cctgagggtggaccttcgggttagtcagagttcttagatacaatatcaaaagcacaatccacaaaagaaaagaatggataaagtggacttaatcaaaaggtaaaacttctgctctgcaaaagacaataagaagataagtggggccaggcgtggtggctcacacctgtaatcccagaacttggggaggccgacgtgggcagatcacaaggtcaggagttccagaccaaccgggccaagatggtgaaaccctgtctctactaaaaacacaaagaaattagcagggcatagtggtgggtgcctataatcccagctactcgggaggctgaggcagagaagtacttgaacccgggaggcggaggtggcagtgagctgagaccgtgccactgcactccatcctgggtgatagagtgagactccgtctcc

SEQ ID NO: 516079 - DNA, 212 bp, Homo sapiens
cgaacagaacacgcaaggtgagaggcagggcatgagaggtcaagattgctgtgaacagatctgtgcctactttattactgaagtaaaagaaaacatagttcattgatgtcgaaggatatatacagagttagaaaataggactgtttagaaaaacaggaatacaatggttgcttttatcatagtgtacacatttagcttgcggtatatgactc

SEQ ID NO: 516080 - DNA, 520 bp, Homo sapiens
aattggaaaaaccttgccgggatagctcatctactgtcttctccaggactcgtctatgaaacagttacaacctacggccaggccaggcagtggctcacacctgtaatcccagcactttggaatgctggggcaggaggatcacttgaggtcaggagcccgagaccagcctgggcgacaaaagcaagactccgtctccaaaaaaaaaaaaaaacttgctttagtgatttccattgtgtaacaattgatgaaccattaatgattcataattataagctgggtgtggttacctgtagtctcagtatactccaggtggggctcatttgaccccaggaattgggattctagccctggccaacatagtgagaccccattcgcaaaagaaagagagagatctacttgtcaattttaactataactgtaacctcattgttttatagtataaaataaggtttcccctgtttgtgttcgtccagtcctgaatttggacaaattttccaccattacggttctcatatagaat

SEQ ID NO: 516081 - DNA, 183 bp, Homo sapiens
gctgactcatagcaggatccttctaaatggctgtaacaattcactttgtcgtttgttaataaaaccaggagaaagcgatgcaggtctctgggaatctcatcccttccataaggaaaatgctctgccaattcaagtttcattcagtcagggagaccagaagggtttaaaaggcttcgggtgaca

SEQ ID NO: 516082 - DNA, 134 bp, Homo sapiens
ggactatctacagcatactgatcacacttcgcactagttctcggactatgctatgtccatatcaagggatgatagcatgaaggactcggggatatctaacagccatacctgatcactacttcgcactagtttct

SEQ ID NO: 516083 - DNA, 2640 bp, Homo sapiens
catccaccgcatgtgggctggggatcatattatataatcgtcgcgagcacgatcagagccacgtacaacacatctactgagagacacaagtgacatcatcagcagaatagctacgataaaaactacgtagcttaatacataaagacacatcatgatgtgatgcaatcaatagcctctacaagagtcatgcagtgacgagaagacaactaagtcatcgatgaaaggacaaccttcctaactacatacaagaatatagatgaacaagcagaaacgtatagtgtcaagcattagagtagagcaagatagtacgaagatggaaacggagagagaggctgcgaccgaggtgagaggagaggagagaagagcgatggtaagaaagactaatagaatataaagaatagaggagtaaagagaagatgagagggatagcagacggacagcagaatagagatgcaggagtgaggagacgctgagatgaggacatgaagagaagaagaatagtaggtgagaaaagagacgaacgaggacttttttgggaggaaggaagagggagagagggaagtaaagaagaggggagaagtgcaagtaagggactgaaagagttaagtagtagcggaataagtaaggagggtgagcagcaggggagatagaaacagaggagagtaaagcgcgaatatgaagggagcctgcgtattaggtactaagtgagtgaaagtgttagagagaaagactaggtaaataggggatcgaggtaatgatcaagtgtggtggaatacgagagtgtgacagataggattggtatggtggtaatagcggagtgagaattagtagattcattgtgagtgtgagtagtccgagaggtagaagccgatagggtagctataatatgtgtttggtggagagtgaaagagtgaatcggaggaagatgaggtcgaaggagggatagtagggtggttgtgagtaggagtgagtgataagaattagagccagaggaatagagagtagtaaaaaataatggagagggagaatagcggatcaggagagagcatcttagagtaggtaattaggatataaagcggtaactaagaagtactatgtagcagggtcgatatgtaggttaacgagcatgatagtaagggaaagagactagagagatgctaagagacaggagaagccaagagagtggaggagctagacaatgtcagatcgataggataggactagctatataagctacagtagagcaggatgagactggaagatcgacgaatgatcatgcctactactaggttagcggagagttagagttggttgagtgcgtagttgggtaggatagctatgaggaaggtggacgtggtggtatcggtaggggattggaagcattggcgaagctgtaggatcaaggaggatggagtagtagaagatgagtaatgtttgatagataatggtcgcatatgatcattgagtattcgggatatgaagttgttgtagcatgagagtgaactagatgatgcgtgcgaggtatgcggtagtacgaatgagtgtatgcgaagatagagtacaagagtagagagaatagtgataggataggtaatgatcatgttaatggatagttgtagcttgatgtacgaattctgcgagttgaaggatgtgggtaggagataagtagaatataatggtagtatagtaagtaggtaccatgtagaatgagtgaacttctgtgctaatggtgtgtcgacgacaatgaatgtaatgtataagatctgttgtaggtaggagagaacgagtatggtgaagagagaggatgatgaagggtaataagagacgagaggtggttatagtagatctgttggaagttgagagatgaagtaacttacaaatgaaaaagaagaatgtaggggagggatggggtagaggaaaggctgttgaagtgatggtggatgaagagacgaggagatgtacaggagaaatagtgaaagatgatatacggtagtgagggtgtgggaattaatagagaggatggaatataaagaaaagtgggggattgtcgatacggaggagaggggggcacgtgatgagtagaagatgatgtggaggatgcaagagagaatggtaacgattgtggatgagggagagtggggatagaatggaagagggagggacatgagtggggatgaaagaggtctgcgtgagtagtatggattgaggaggagaggaagataggtagagaatatgtaagaagagagagagaggatagcaagtaaggagtatgtgataggggtgagaggagtaagtaggagggtgtagaggggggagagaggatatggtaaaagagcggtgagagagagtaaggtgtacaatgtatcagatagtatagatatatgagtgagagtggtagtggaggtggcgcggggttaagagttagagaaaggtgagtaggaaggatgtaggtaataagaaaggatataggattggtgttagagttgatgatgagatatgtaagggggggggagggatggggaggggagagggtggaagatgagtatatgaggacggatagataggtagagtggggtctgaagatgctagtagtagttaagagatgaaagtggaagtgtgcggtagttttgtagattaggg

SEQ ID NO: 516084 - DNA, 133 bp, Homo sapiens
atctggctcctgggctattccggtggtggctttttgttacctttaacacattacatacatgagtatataggatgtgaggggaggggtgagaacaactcagctgtagcatgtgtaggctatatactttaccatt

SEQ ID NO: 516085 - DNA, 438 bp, Homo sapiens
  misc_feature (418)..(418): n is a, c, g, or t
tgttactggcagtatctaagaggtgagtattggggggtcgtttctgggaaggaggctcagtttctacagaaaaggataattaaatctccggccgggaaaatttcagttggctgcccacatggtgtggatggagtaagagacagaggttacaggggagtctcaaccttcaacatgcagattttaatggaattaacctattttcagttcagattatgcagtgttagttgagacaaaaaggcacccaaatatttaaggcaaaaaattaaggggcctctaaaaaggtttgggcagtagggatagataggagataaatatgttgggaagggacttaagagggacactgggtagggcttggtgtttgactagacttggagctggaggaagggggggttagtcagggtgacttccaggattcggnatggtgcgataagggtcagg

SEQ ID NO: 516086 - DNA, 174 bp, Homo sapiens
aacatacggtacagctgtgaagacgaaaaaagaaatctttggcctgggcatggtctatggggtttcatgagttgaagtactatggataaaggactcccagtgtcgcaaggccccatatataatccttgtatttcccttctcactcttgataccctcccagcacagtcttgcata

SEQ ID NO: 516087 - DNA, 96 bp, Homo sapiens
  misc_feature (37)..(37): n is a, c, g, or t
  misc_feature (46)..(46): n is a, c, g, or t
acgagaaagcccaaagctcagcgtgttgtagttattngttacattnatatacaaggttgccagtactcataatttttatttctgcaattatgttat

SEQ ID NO: 516088 - DNA, 1481 bp, Homo sapiens
tgcggatcattggcagatggggtgatggattgcataagcctgtagtatattgtgatctagtatcatgtagaatgctatttgtagttgtattcgagaataactggcttgtataaaggatggatcgaagtgatgtagtaatgattatctaagatacattatggggagtacactggcgtgatccaccggaaaatagatagggaaaaattgatgtgtcgtcacatttgtgtactgtttgtaagcatagaggccctatagtggatatatgcatggtgacgtactcatagggaacgttgagagattgttagtacggcaacgcataaagtatgaatcttccacctaagggatgttaatgtccatcggttggtggttcacttcgtcggttgcatacagggacagagagtatgggataaatttagggcggatgttggagggtccacaacagaaatacagtataggaggatattggcacaagcaatgttcggaatagacagtcggggttggccagaaaaagagttgtgtttcgggctaaattgaggtactcgacgatgtaaactagtagggaattgaggacagagagtagatggcatgaatcaacagtagggaaagagcttgtcgagggtaaaaaggacagaggcaattagaggaaatagaacagagggggtgtcccgcagagcacattaattcagtgggacgtgaaggtttaaaacatggtggatcacaaccattgtggggaaaggtttacgaaataagaggcgtacacaataattgggggagaggtacaattagagggtgtaaacaatattaccttggtgggggcaacattgtgtttgtgtacaatagggagacatatttgtgacataatgtcgggacaagagggaggaaacaccttatttgggatgtgtattggtggagaaccacacattaagttatagttagagagaccgcgtgggtgcaccgagttaacaccggggtaaagttaccctatcacgattatgggagtgcgcgaaggttacggccaacacccgatcacacctccgggcggtggtcaaaacacacgcgctacacgcccaccgaagctaatataggggaactagcgcgaggacgccagaccgcacagaggactagtacgcgttgtgtcggaccacacttgtcggtcggggacacacatctaaggttcgcgagtgtgccgagaggaaacaaacatttagtctgctccacaaccgacaggaacgcaaccatatttttcgtcgggagctcccatataggtctggccggatcacgggcaagaaagacggaggagattccagtagagagtccacgggaagaaagtcgcgccgcgatgaacagacgaggggcgaagagcaagcacacactaggttagcggcagcggtagagtgaccagtataccagccgcaggttgacacaggtgacaacaacacaaagtttcagggcagtgttggcgcgtgtggcctcagtagcag

SEQ ID NO: 516089 - DNA, 453 bp, Homo sapiens
tgggtttgtgtttttgtttattttgagatggagtctcgctctgtctcccaggctggagtgcagtggcgcgatctcgactcactgcaacctctgtctcctgggttcaagcaattctcctgcttcagcctcccgaggagctgggactacaggtatgtgccaccacacctggctaatttttttgtatttttagtagagacagggtttcaccatgttggtcaggctggtcttgaactcctgacctcaaatgatctgcctccacctcggcctcccaaaatgctgggattataggtgtgaaccaccgcgcctgatgccttttgggtttatatggaggcttcatgatgtaggcatgattgattacatcactggccattggtgatcctctcaaccttcagcctcacttccctccctggaggagatcagggagatggggctgaaagtcaaacccttacacac

SEQ ID NO: 516090 - DNA, 640 bp, Homo sapiens
acatatagggtaagacaggggcatgactcgatgaaggaagaaaacagacgtggttttcttggcgtctgggcagcacagaagcaaaaatcacttagcaggtagtccgagactaaagagggcagagccactccctttgatgcagagggggcactgaggaacttgccctttcattccaggtttgctggtcgctaggcagggtgtcctagagtgagactggcgctcacgtcgtgcatatctccttcagagttggttcaggagctcacttccctctacagacacactgtcactgctaggccctagtgttttcctttgttagggctccaagtaatgagaaaggctgccccatgtagggtgccacctcaaatcctttttctcatttcacctcacagtaaccctggtgagccctctacatagtgcctgtccagcccatgcctctgggtaggcagccacataaaaatcaaacacctgttttgttggctaatctggggaggaagaaagggagtgattctttgtgtcatactccacaaagcgccatctctggcctaggcagcactgcagaaggcaggaccatgtacctgagactgatgagctgagtcgggtgcgagcctcactcaaggagagggtagagagggtaggtacc

SEQ ID NO: 516091 - DNA, 783 bp, Homo sapiens
gaaattcaaggccttttgatagatcaaggtgccgtgactggttcatcagactgctccaagtcagacctcttcgcacatgtccacccaatggatttccaccttcagacaccctttacgttctgtgtctttaagcatgagaacaagtggacccatgcatcttagggggtattttctccgcacaactttctgatagtgtgagctcatgtgccatctctccttcctttctcatgtgtttggctttggggctaggcatctatattggaaagcgactgagcacaccctttgccagcacctactgagggaaaggaaaagcccctggaaatgcgtcgtgacctgtggaagtggtgtattgtcacagtagcttatttgaacttgagaccatttgtaagcatgacccaaccgtaccaccctgtgtttttacactatccaattccagtaagctctcaatattcgatactttctatgtcaaactctcgttgaggcattcttactaaccttataccctttttggctctgaagacattctttagaatttcctaacagagtttactgcttgtgttagaaatttgcaagggcttcttttccgcgaatgccaccagcagattataattttgtcagcaatgcctatctatctctaattagtgccaccagatctagacctgtatcattcatggcataaattttactcttgcaacataactaccatctctctctttagagcgagatcaggttagcaaatgatgtaaaagaagctttattgtctagtatttgtttcccccagac

SEQ ID NO: 516092 - DNA, 172 bp, Homo sapiens
  misc_feature (16)..(16): n is a, c, g, or t
  misc_feature (71)..(71): n is a, c, g, or t
  misc_feature (81)..(81): n is a, c, g, or t
  misc_feature (86)..(86): n is a, c, g, or t
agtttgcaaaccgagnggagttgtgaagggcgcgggtggggggcgctgccggcctcgtgggtacgttcgtnccgcgtctgncccanagctggggccgcaggagcggaggcacgaggggcactatggcagacaaagttaggaggcagaggccgaggaggcgagtctggtgggc

SEQ ID NO: 516093 - DNA, 351 bp, Homo sapiens
tctgttaatacagtgtgtctgtgtgttcccaaatccagctgctcccaccagcgtcagattccattatctagtgtgtgtgtgttgtacacaggtaagccggcaatctactggctcccggagattatacatgtgtcacggatgtcgaaaagcaattctcctgcctcaggctcctgagtagctgggactacaggttcctaccaacacacccggccaatttgggtatttttagtagagatggggttcaccgtatcggcgagaatgatctctatctcttgacctcgtgatctgcccgcctcgggctcccaaagtgctgggattacaggcgtgtgccaattgcaacacggtctctca

SEQ ID NO: 516094 - DNA, 760 bp, Homo sapiens
atatgcaaggacacgagacggggataaatcggcacgcagggtagccctgtgctgctagctgcgcgtacaggctgctcccgtgaggcacgtgcgaggcgcgcggggcacggatgggcggtgtgctggcgggctcctgcgagaagcaagcggaacttcctgagcgtgcttaggtgtcacagctgggtgaccctccgaatggaaggtttttgcctgctggctgctgtcttggtgtatctgctgtgccttggtgtgcctgctggataccctgtgtggctctgcctgctgcctactggtgtgttctgctgctggccctggcgtcgtgggctgtcctcagtcgctgtgctgaagtgccggccctgaagcacccttaattgtatgtgcctgctgctgcttcccgtgctgcatcctgctgttctaccgctgtacgcggtggtaggactctgtgcaggtggagccttgcccaggcgagactgtttgaggagtgaatcatatataagattctaaaaatatattattccctatctctgtggacttgtgtatacaaactgtaggcttattttttctagcttggattcatttctctaaaaatcaacacctgtaaacccatactcagatacaacaaaaattggggtagcttaaaaaccatgagttgtgcgaaatgacgtccgtggaaacctattcaacaacaaaattggttaatcccaaagctgatatctttactgtgctgaatacttttgacagggtatgtctgatggcgtga

SEQ ID NO: 516095 - DNA, 312 bp, Homo sapiens
ggatcgacttctcctcatctaagtgcatttaggccacgcatggtggctcacgcctgtaatcccagtactttgggaggctgaggcaggaggatcacttgaggtcagggattcgagcgcacgctgggcagcatggcggaaccctgtctccactaacaatacaaaaattagctgggcgtggtggcacatgcctatggcgggtgcgggggaggcaggaggatggtttgaacctaggaagcaaaggttatagtcagccaaggtcgcaccactgcactccaggctgggcaacagcgtgagactctgtctcagaaaaaa

SEQ ID NO: 516096 - DNA, 892 bp, Homo sapiens
agaaaaaatcctacagcaatgacaaacggtatctagttactggactgtgtgcctagatggagaggcgtaaactgattgtggcgatatgcttgatgacgctggatcgccggtggtccacgcctccactctcccagcagtcactctggagctccacgagacgtatcaaacaaaactatgttctaaatactcttccataggggcatctattcaaaacgcttgcatgagccaattctcaggttttacatatatgtgcattagtcaaactattgcgaagagccagtctgacaaacagagaggagaagcatttgtgaacagtgatctgaacatgaacgactttggaaatattgatgcttttcttggtgtggacatgacctgacatacatacgtcgaagagtataggcatgtcgtcatagtagaatcttgaagatcttgaagctaaagattgcatccttattatgaggtgtggaagtcagtgacttgggtgacgtgtcttccgtagacagagtgtaagtaacgatgcaaggaagtaagagcatgagtgggccttgaacctaggccagcatgcaacataaccaacagactcaccaagaacagagctcagagtatgggagacaaggatagggtagaagattgtgaacacataatacaaaggggggaataacagcaagaaacaacacgttgcacaacgattgggaagtgcgctaaagttctgtacacagaggagctcaacaacagaacttcctccatgggcacaaaaaaagataataaccgtgcggaacctccaaacagcactcagaactaacgtcaacaacaggcaccacaacaggggagatggcaataaaaccccctccgaaataatagcccgaataaggaaagcaacaaataggaaaag

SEQ ID NO: 516097 - DNA, 204 bp, Homo sapiens
  misc_feature (48)..(49): n is a, c, g, or t
ctcctcctcctgtcgtgggctcattgtgaccactggcctctctacagnncttcgtgtggcctgttcaaggcagaaccacgacccttgactccctggtgttgatgtggccaatgatgctggagctgaatcagacgctgacagttcttcatgcatttctatttcacaatctaatttaacacattttccaaataaattttaaatttt

SEQ ID NO: 516098 - DNA, 280 bp, Homo sapiens
cgtgagtctcatgagatcagatgatttataagtgtatggaaatacctccttcactcttctcatttactgccaactgtgaagaaggtgccagtttcccctatcgaacatgactgtcagtttcctgaggcctcccaaccacatggatctgtgagtcaattaaacctctttcctttataaattacccagtcatgggtagttctttatagcagtgtgaaaacggactaatacagtgcatatttatttacaatcgttatatcctcttgctggattgaccccttta

SEQ ID NO: 516099 - DNA, 763 bp, Homo sapiens
tataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtgaacctgggaccaccagtagccatcttgtttgccacatggagagagactgtgaggacagaagccaaactggcaagtggaggagccaaaggattgacaaacaacagagccttgaccacgtggagtctctgaatcagccttgtcttggaaccagatctacacctggactgccaggtctataaagccaataaagccctgttaccttgacacacaaaacacaaaatccttatt

SEQ ID NO: 516100 - DNA, 357 bp, Homo sapiens
  misc_feature (57)..(57): n is a, c, g, or t
  misc_feature (71)..(71): n is a, c, g, or t
  misc_feature (257)..(257): n is a, c, g, or t
ctgcacatgcccggcatgagcggcctggacctgctcaagcagctgcgggtgatgcangccagcggcatgcnttatgttccggtgatggtgctcagcgccgatgtcacccccgaatcgatcctgcgttgtgaacaggccggcgcgcgcgccttcctcgccaagccggtggtggccacgcgcctgctggaggtgctggccgatgtggcggccaacatccgcccggaggcaggcatccagtcggtgcctgcgctgccggncggcgatggcgtgctcgacaccgcggtgctggatgaactcgcttcgctgggcatgggtgatggcttcgaacgcaagttcatcgaccagtgcctggtggat

SEQ ID NO: 516101 - DNA, 137 bp, Homo sapiens
cagagggcaccaggaaggcacgttgcacactacttactgcttcatgtgaggggttcatggtggcttctccctaccttcggaccacacctctggtggggaggtgctgcgtgaggatcccaggtgtgggtggagagcgg

SEQ ID NO: 516102 - DNA, 147 bp, Homo sapiens
ctgtgagagtctcctcaagtccctctaactgtgtgcgagctcctcaactctcccctagtgtgtgcaagcttccctaaatcccctatattgtattcaacctctccaaatccccatcactgtgtgcaacctcccgaaatcccatcaact

SEQ ID NO: 516103 - DNA, 117 bp, Homo sapiens
acagcggttcgatacaaggtcaaatcaggaacaagttctaaatccagtgctgatatcagatacaagttcaaggacaatttcttttcgaaggctaattccagtttcgtgagggtagga

SEQ ID NO: 516104 - DNA, 169 bp, Homo sapiens
cacgagggcaccagaaagcaggtggactgtcacattacagagccctctcccggaccaggggctgggcaccaccaaattatggtacgacctgcgttgtggcatcatggctccactgtctggctccgtctccacatttaccgtctccccgtctctctctcctcttctcacg

SEQ ID NO: 516105 - DNA, 217 bp, Homo sapiens
ctgggactttgccatccaggccaaaaagcatgctccagtgggcatgccctttcatcaaagccctagtcaggaatcccagcccctcctttcctgtgcagcccaaactgaaggataaggtgtggggcagtgactgggtggggctgcctgtgtgattcctgataaaaaaaagccttcatgaaatgtattgttccccaataaagctcattttttgtgggga

SEQ ID NO: 516106 - DNA, 344 bp, Homo sapiens
  misc_feature (262)..(262): n is a, c, g, or t
  misc_feature (294)..(294): n is a, c, g, or t
aaatccgaaaatcacaatcccaaaagatctaaatcctggaaatataattctgggaaaatttttttttaattttttaaaagatacttacattttaaaaggatttatttgagaaacataaaaacacaacagaacacatcagccacttcacacaataaaataggcaataatacatatttttggaagcataaacaggtatactgacagttacaccggtgtgagttattaggcagacaaactatatttcatggaaggaaatagggtncaaaatgggggaaatgtattacatggcatgtncacttatggcttgggtaattgtgtggcacctcgcttttatacttggcagt

SEQ ID NO: 516107 - DNA, 141 bp, Homo sapiens
ggcccgcacttactcaagaacctataaaatctgctaacatgattcgaatatttataaattattgggtaaccagttttcagaactatttctgagtacagcttgcttataaagaaaaacattcattgacctgttaacgactgt

SEQ ID NO: 516108 - DNA, 361 bp, Homo sapiens
gaagaaagttagtaatgtgtgtctacgagaaattatacgctacctatctcccacacagcctagttcccaaactacctgtgctttgtctctctctccactggatcatttcttttcacacacctttaataacaaaatttctttacttaacctatctatcctttttcctccttttcaaggggtttattctacacgacctctattttgttacctatttctttgttgaaaattggatgtcatgtaatttatgacggggttgaaaggaacaagtgtgcatctgatgcttcaaaaatcctctactggacagatgttaatagacgtttatctcatgagtaaacacttccacagacaaggtagagccgag

SEQ ID NO: 516109 - DNA, 301 bp, Homo sapiens
agcactctactactcagtgtactggttaaatccaccttcgagcgttaggtggcataaaggacaatccgcagtagggctggggtacgaaatgtagcccatttgttgccacctcatgtgctacagcttgagctaaacgtctttacgtgggtacttgcggcttaccattgtagccttcatcagggtttgcttgcagatggcggaatatagggcgtgagccaagaggtggtgacggttgactcgggggtttatctgcttacatgaacaggctcctctagagcggctatgaagcaccgcaagcccc

SEQ ID NO: 516110 - DNA, 144 bp, Homo sapiens
cttctttctgaatcccagctacttgggtggctcgaggagagaggattgttgagtctaggaatctgacactgtggtgatactatgatcacggccactgcactccagctagtgggtgacacgagggtaccgacgctcgagattcgt

SEQ ID NO: 516111 - DNA, 496 bp, Homo sapiens
  misc_feature (386)..(386): n is a, c, g, or t
  misc_feature (395)..(396): n is a, c, g, or t
gaagaaggacatttttacttttggatacatattgcactttctccacagtcagctggaacctgaagaaaacctgaagagaacacatcttggctctgttctgcaacgaatcctggagtaacaaaactgtcactagttgccttagatggcccacacagtacggcacagccagctggcagagaaacactcacatcagcagaaatgcttgttgtactgtttggctttaaaaaaaaaaagcaaaaactgattcctcttaagttgacctgtgtgtgcagaccacagtggagcagccctggtgactttttctttcaaccgttaccctctaggacacaaattcccccacgaggcacactctgattgggcctctgtcactggagagtaaacatttngatctttgnnaaatggctttttcttaggtgttcaataaacaacaaaacgtctaacaaagaaggaagcattttcctcgctcagacaaataaagtctcaaactttaaagctt

SEQ ID NO: 516112 - DNA, 1034 bp, Homo sapiens
gcgctcagtttccctctatcgcggcccagggtagtctctcctctttcggtggatcaagtggtgcaaagatcttcgactaagtggcgcaaagtggaaagggtgagctcaatgtgctgacaagcctgtctgctactctcaccccaatggtctcgtcgcagcacaatagggtctcttagctgcggcgacttgcttgataagaggagttgcgtccggagaggttgcggagccactgtgtggactgtgggggccacttgcgatcttggtcacgcattgcggtggctcttaagcgaattgctggagcggatgatcgagcttataggcggaggtgtcattactattgggtaaggagagcgcccgcggttccctcgttatatgggagcctccattggggagcacgcgtaacaacgggtgatgtgagcgcgcggtgtttgcgcctctcgctatgccggagggctcctcgactctctagcggctgtcaccccttctgtatagacgccgtctcggcgctgttgaatagtaggagttcactgtgttcatactgctaactcgctgtgaacactcacacggtatctctgttaccctggtgtccacatcacgggagccgttctgagacgcgctttctcttgttggcctttgttttttgtgtcatcctgtgggtttttctaatggacttgtcaggaatctttgtaagtcgtcataacgtttcgcaaggctgccagccacgtgtccgtaaatctgtgaagaactcttaattgacagtattcaagatgaaggtgctggtttgtagacttaacacccagtgaaagcccagccatcatggacaaatgcctgtgaatagttctctctaacgaaaatcgatgctggtcatcgcagcgtcagcatctccagttttttgatgcagtggcatccctcatagcgtagatctcagtttcgctggcttttcctccctcagccccttctcacccctttgctgtcctgtgtagtgatttcggtgagaaatccgttgctgcaccctaacccccagcaccatttat

SEQ ID NO: 516113 - DNA, 1064 bp, Homo sapiens
  misc_feature (1064)..(1064): n is a, c, g, or t
atttaaactcccagagcctgtataagttggttctgtagtcttgatgctgcgcgcaaccagggtggtgtgcgtgagatgctgcatgctgtggttcctggggctgaatgtggaactgcgctgctcacctgatgctgctgctctgctggcctggtgtgtgtagttgtgcatggatgtgatgaaatggggtcagtgctgcactgctgctggtttgagtccgtcgagtacgttcgtggtctctgctgtggaccgtcattgatatatgtgcgtcttactgctgtgtgccgtactgtatgtgtgctggcacctatgtgctgtgtgtgatgtgctggcttttgtgtgctgccagaatggacctaatgtggctgttgacactgactgcaatgcatgctttggcagctgtcttgcacctctgtgtgaccaatggtgtgtgggacagtgtggaggcacggtggtcacagagcacaggaggggggaagtataaggtgcccgcccttgaaataccgccgcgtcggtaaagcccactgacattggacaacagtgaaactaactggggggatgtgaaacattgactcggaagcatgggcgggactggaaggaaaggggaaggcactggatatgtcctttgggataagacctggtgcaccactggaacctggcccaggagccggcgtccaagaagacttccgacagtctgggtggctcggggaagcgggtgggcgtgggcacacccagaaccgtgctggacccaacacctggagaaagccaaacatgaaggggaccttgcccattccttgggtggtgaacggcttccctggaagggggactggtggagaaacaggggaaggacaggtaaggggtccccaggaaggagtaccagggaagtggcagggctggcccatatacctaggcatgaggtgagtaacccccccaaaggacatggcatgagcggtagcaccaagagtgacagggagaaaaaatgaccccacggggggggacccggcagggcagcaaaccataaccgttcacaaggtgtggtccccccgaaggactaggccgagccagan

SEQ ID NO: 516114 - DNA, 104 bp, Homo sapiens
agtacagatcatgccgataaagtaaggcttgtcctacatgcagctgccaggtgatagtgtggccaacatgcggataccaagcctacgaagtccgtgacttgata

SEQ ID NO: 516115 - DNA, 145 bp, Homo sapiens
taggctggggaatgcttttttatctcatattagtgcctgtgatggcatctttcatctaacacgtgcttttgaagatgatgatatcacgcacgtttgaacggaacgtgtagactcccagttgcgcatatacggggtaccgtagctc

SEQ ID NO: 516116 - DNA, 301 bp, Homo sapiens
cccctttggatagggggtttggcccccccccccccccccggggggcctttccctttccccggggtttttggttggggggggggggccccccccccccccgggttttttgggttgggggggggggtttgggggggccccctttttttttttttcccggggccccgcgtggggttttggccccccccccccccttggggggaagaaataaaaataaaaaaaaaaggagtaggaaaaaataataaaaaatagaaaggagtgtaaaaaaaaagagatagatgtgtgtttgtttagaaatgtgagt

SEQ ID NO: 516117 - DNA, 202 bp, Homo sapiens
  misc_feature (70)..(70): n is a, c, g, or t
  misc_feature (72)..(72): n is a, c, g, or t
ggattctcagagtggcgcactgtacatctctaaggttcagacagaggacaacagcacctacatcatgaanangcttgtaaaaagaactcggcaatgtagacacgaaattgaaagattcaaggctgtcaagagttctttaccccgctatccccagggcctctcaatcaaaaattgagaaggagtagatagagtatatatgaga

SEQ ID NO: 516118 - DNA, 589 bp, Homo sapiens
ttactcctggaggagtgatattcaattttctttttttttttctggtgcaatcttgatgcagagccgaaacagtcctatgaaagagagacagtgtatctttaattaaatgggcactgaaatttcacttcccttagctgcattctagtagctgggccaagtaatctcgtaattctgttagttcaaattattctttcccatccagatattcctaagagtgtcttcaggttatggcgaaaagcttctggtacatatctgactttatctccagaacgttgctctaagtcagacagttgtccctccaggtcttggtcccgaatatctactccctgtagtttctgagtcaaagaatccctctgtcctggtagtcctcgggcattatcaatttctggtttaaacctttctattccctcttccttcagttccagtgtctctcccagtcctggtatggtctgattaaatcctgtcttataagtatgtccggtattggctgggctactaacactttcaagttcagtcacccgtttgtgcagacgtacggctccctctggataggcagcaagtggctgttcccatggttccacattgggcg

SEQ ID NO: 516119 - DNA, 111 bp, Homo sapiens
cttcgaccagtactctgtgggtggaagttaactcacaatgttctgggaagcaacaggcaaatgacctaatcaggcaggaagtctaagtgaccttgagtgtagaatactgtc

SEQ ID NO: 516120 - DNA, 159 bp, Homo sapiens
atacattggagattacattattgtataatacagaactctcaatacagcggcttgtctcgctttcctcatactccgtttggtgctccgtcgacttgtctccccgagagcggtccctcagaggtcgcatacaaggaaattttaccactaacttcgagagag

SEQ ID NO: 516121 - DNA, 96 bp, Homo sapiens
ggatttgctggtgcagtacaactaggcttaatagggacatgcctggataaataaaattggtaggaatgttttcttgccattatattcaaaaaaaaa

SEQ ID NO: 516122 - DNA, 110 bp, Homo sapiens
tcttctttattggatcagtctatacgacagatactattctattgtcctcgtagaagagaagtttgaccatattactttccaacactgagaaccaagaaaagaagaaaata

SEQ ID NO: 516123 - DNA, 148 bp, Homo sapiens
  misc_feature (1)..(1): n is a, c, g, or t
  misc_feature (33)..(33): n is a, c, g, or t
nggagcagcagaacaagatgctggagaccaagnggagcctttttcagcagcagaagacggctcgaagcaacatggagagcatgttcgagagctacatcaacaaccttaggcggcagctgaagactctgtgccaggagaagctgaagct

SEQ ID NO: 516124 - DNA, 443 bp, Homo sapiens
attccaatgctttggaaatagtgcagacacaaaactggggtaggctcctaggctgacaggtgtaatacagccccagacccaaaccaatctcgaaaattttacacagatgttgtaaaagcaaggccattgcctttggacaacataaattgggataagtttcaattataaaagccaaaaattgttgactgtattaaaaaccaaaaggggaaaaataaaggttattcaactaccttcagcaaattaatccaaaacaccccgggggctcaaaaaagaatttctttttttggaactttcctgttttataaaacgaaacatgtttttttaggaagattcttaaaggatcaaccatgtccctgaaattatttacccaataaaacaatacgggggcaactcttaagagtcctcaattttctttttacaaaacttggtgtaaaccttcctcg

SEQ ID NO: 516125 - DNA, 1962 bp, Homo sapiens
gggttaacatggctgacatgtgtgaaggatactcgtgcgtcctgaggttcggcaggacagctcagagtacgctagcgtgtacacctaagagaattcagcagcgggtaccaggcgtggcctctctatagtctgtgtgtgtattgtctatctcgctcttctgtctttggtgattcttgttcgaccatgcgggcatactacagcatagatctttggccccaggggccatggatactgacggatgcgacgtggatcgtgcacctttacacctggagaggaccactgtactcctcagaagtgctcaaagcgcagtttcgtgcacctgtgtttccagatctattccacaacacttgtatattgggagagtacccgacccatgggccactagcgactaaaagtccagtgtgatgatgtcctgtgagtatgaaatgcgcttagaagaatatacccgggcggttgtcaacatctccactaggttggagccattagttggtttggcgataactcctaaagggtccgtttggaatgcctccgcataagtgcgcaatccttaagcgcacacacacgtgtatgtgtctctgacgtacctaagggatggattgtgccctagggggcaagtaacgagacgggcggattgaaacctccataattacgcgaccacctcgaagaaggtacgtaccaagagcgttaaaaatgccgggaatacgtaatgttacgctcgtgatgtgtctcggtctggcacaatgtccaatgccggggggcaatatttggcggacttgtgtaccatttagaaggtgcaccaacctaattgttgggggcgacaggggggaactatctgaaaccagattagcggaaaacaaactgtggtcagttgtatagtaaacagcgcctttagtgtacggcagagaacattgaattattgagatatatccccgtcttgagatcgttgtagccatacaagtcactcttcaccaaataatattcttcgcgcaaaggccgccacacttataggaaacctatcgatgaataggcagaccgcatttttagggtgaccgcctaaatacgaccacatttatggggcttttactgcgctcaccttgaactttgcctccctacattagaagaggactacatgcaacattctcactatagagtgccacaaggtcatatccccaatgtcgtatggcccgtataaacgtggaatacaaacaacccaatgaggaactcgtgtaaacaattatctcccgcgctttccagtttagtgggaccacaatttgaatcagaccgtaccctcacattggccagctgcgcctagggcagtttagggtccgcttccgcaaataagtcctcacaccgaagggactcacgatataggttttcactatccacaaataatatcggcgcgtcattgaaaaccggccttttaatatcagggcctcccgtcccaaggagacgcaattacggcagcaacttaaagataagggcagccatcaggtggggggaccgctaaagagtttcgcatactattttggcgcataattttccctttgccatatagaggaaagatatcgcaaataggtgtcttgcacgacggacaatcatataacaacggttgtccggcaaaataccggacaatgtacattctttcgtccaaaaggacccttatgtgagaaggcgtcatcttaacattccccacgatgaatgtgagactattcgtaggcgagtacaacgtcgtgtaggacaaggcactggcgaagacgcacctgtggggcctaataacaccgcggcgggctattatgaacctacatcgagggcagaacagcctatgagtcgaccacgaatgacgacgcaccacaatagcgcgctgtgataaccagcgttgaacaggcagccacagatgaacgaggaaagcactagacacgtagtaacgaagcggctagatgatgcggccccaaacaagatagg

SEQ ID NO: 516126 - DNA, 1163 bp, Homo sapiens
  misc_feature (1140)..(1140): n is a, c, g, or t
  misc_feature (1152)..(1152): n is a, c, g, or t
tcctgcggatcagtcccacctctatacgctcggctgtcacggggggaaacaacctacccggcggtgcccactgtgtggagacacactcgactcgcaatcaacggggacccaatgcccactgtcacagtgtcgtccctacttaacctcgctaaggcgactggggtttcccacacacgcccccctttccagacgtgtgtcactcggtgagaattcacacaactctcgtgcgtccctgcgcaagagtaaacccgttcctgcacggggggctttctcacggaaaagtcaaactgccctacaggtcctggacacaaaggcggtccaaggcttactggccacttctgcaacgcttgctaggtctagtccatctaccacagcattagatgacttaatgaggcataacgcacaatattactctatgaagattgcttccacccactctgactgcaacatgacatggtgtcctggagcgaaactgtggagaacaggtcaatctttgccgtcagctacttcatcaatggaagattgaacactggagatccagagaggctggatgacctgctcaagttcaccagcatggtagtggcaaagtagaggtccagacgtcctggcccctgatgcccagctcagtgccacagaagctcaataggaggcatcttccagtggatgagggccaccaggaagcacaggtccaaggctggtcccacacttatcagcagcaacaacatgtctagttcatcctgcatgggaaaaacgattggcatgggagtctgaaatggggctactgtttcagtcctaatgtgctctgtgacacttgggacaacactctccctctctggacctcagtttccgctgcgtgtatacaaggactcagagatgctatgcccgtgacgcgcaagcaacatgccatgaagatcatatagcaaggcctggggtggagccgctgtccatatccgtggattgactttcgaatatactgcagagagtccacttctatccttataagcaatgaacatcctggatataaaggtggaaatggcctcatttaatgaatgattaaatcatatatgtggatatagttatgatatgatgggctatggctgggagtggaagaagaggaagcgtgttgcaaatagagagatntaatcagggggngcattgactaa

SEQ ID NO: 516127 - DNA, 901 bp, Homo sapiens
  misc_feature (622)..(622): n is a, c, g, or t
ctccagcctgggtgacacagccagacctttctcaaaaaaaaaaaaaaaaattacttttggggtaggggacatactatttccatggggtatttaagaaatctagttgggaatataaggtaattctatgggcaaagggtcactttagtggtggaaactcaaccccaaccttttttttttttttttaggaacggtggtttggggccgcgggtccccgcgggggcggggttggtggcagtaccgtgtggaccggtgggcccaggcgggtagtttggggacccccgcggggcccattcaattctccaccttcggccttcctgaagagccggggaccaagacgggggcaccaaataccacacgagggcctagcctagaagttatggggaatattataatttcttgtggggaaaaagaagagggggttgtggggaccagtgggtgggcggacggggggcggggtcccaacaaaccgcggggggggcccacagaggaatccccccacctccaagccctcttaaagagggcgcgggggggtcaccagagatatatttggagcccacgatgcggcgccaaattgggcgcgccccaaacggccggcgagtaaattctactaacccgtggggangaggaggagagggaggagggggacaacgagcgcgggggggaagacacactcgggcgggcgaatctctcaacggagacaacaagcaggggggcggctcacaacccacacggagttgataacaccccgagggcggggggaccaaaaaaaaacacccccgagaaacccacgagggaggaaaacagccgacccggccatcacacccaatcttcccccacgacgatgcgcggggagcaacacagggcgggtgagagaccccaaaaatgcccccggcaggaagca

SEQ ID NO: 516128 - DNA, 647 bp, Homo sapiens
tttgggaataaaggtccagtgtggaagagatcctgcagaaccaccacccaaaaggtggtttgccgaaggctgtaatgaaagaaagatttcgggggctgtttaaggaaaatatagacattctcacataagcccaggttcatccccatttcttccttcacctttcagggcagtttcttttcacattaggctgtgggttcaaacttttgggagcacggactgtcagttctttgggaagtggtcagcgcatcccgcagggcttctcctcctctgtcttttggagaaccagggctcttctcaggggctttagggactgccaggctgtttcagccaggaaggccaaaatcaagagtgagatgtagaaagttgtaaaatagaaaaagtggagttggtgaatcggttgttctttcctcacatttggaagattgtcataagggttttggcaaggtcccccttttttttcccccccccctttgtttttttattaatcaaaagaaacttcaaagttaatgggagggggggatttcacagggtgagaactcgttcccctccaagcatttcatgaaaaagcggctttttattaatcaaacaaactctccccatgatgggaagagtttcccaaatctttcaaaataaaaagtaatgcctta

SEQ ID NO: 516129 - DNA, 221 bp, Homo sapiens
gtctccgtttccctggaattccttttttctgattgttttcacctctctcttccacattcgtggctttcctcaaggtctggttatccttgatgtttgtgcacataggactgggcacttatattagccaaggttctccggaaaacagaaacagagccatatacatatggttatatatatggtatatacacacacacacatatatttccatacatatgtgaatg

SEQ ID NO: 516130 - DNA, 257 bp, Homo sapiens
cttcctgaccttccccaggttccagtggccccgggcataccttggcctctggttgtgtcactcctgtctcttcctccactggaccatggctgtcttccctctgtgtgtcttagtcacttctgtacttataaggacatcagtcatgtcgcattcaggacctaacctactccagtatgaccccatctgaactgcaaccgccctatttgcaaacatcacattctgaactaccacagatttgaacttcagcatagcttgac

SEQ ID NO: 516131 - DNA, 1171 bp, Homo sapiens
  misc_feature (579)..(579): n is a, c, g, or t
  misc_feature (582)..(582): n is a, c, g, or t
  misc_feature (584)..(584): n is a, c, g, or t
  misc_feature (598)..(598): n is a, c, g, or t
  misc_feature (602)..(602): n is a, c, g, or t
  misc_feature (604)..(604): n is a, c, g, or t
  misc_feature (609)..(609): n is a, c, g, or t
  misc_feature (626)..(626): n is a, c, g, or t
  misc_feature (630)..(631): n is a, c, g, or t
  misc_feature (633)..(633): n is a, c, g, or t
  misc_feature (637)..(638): n is a, c, g, or t
  misc_feature (642)..(643): n is a, c, g, or t
  misc_feature (649)..(649): n is a, c, g, or t
  misc_feature (652)..(652): n is a, c, g, or t
  misc_feature (789)..(789): n is a, c, g, or t
  misc_feature (792)..(792): n is a, c, g, or t
  misc_feature (799)..(799): n is a, c, g, or t
  misc_feature (806)..(806): n is a, c, g, or t
  misc_feature (809)..(809): n is a, c, g, or t
  misc_feature (816)..(817): n is a, c, g, or t
  misc_feature (830)..(830): n is a, c, g, or t
  misc_feature (833)..(833): n is a, c, g, or t
  misc_feature (859)..(859): n is a, c, g, or t
  misc_feature (886)..(886): n is a, c, g, or t
  misc_feature (889)..(889): n is a, c, g, or t
  misc_feature (904)..(904): n is a, c, g, or t
  misc_feature (910)..(911): n is a, c, g, or t
  misc_feature (952)..(952): n is a, c, g, or t
  misc_feature (989)..(989): n is a, c, g, or t
  misc_feature (999)..(999): n is a, c, g, or t
  misc_feature (1103)..(1103): n is a, c, g, or t
  misc_feature (1113)..(1113): n is a, c, g, or t
tttgcgtctcgtgtgtgttcctggtgtgctttggttctcgtctgctgtgcggctgtgtgcctttccgatgtcgttttatttgctgcgcccctcgttttgtgtgaaatccctttgacacaggtttggccctcgtccctttgtcccttttttctgtcgtgtgtgttttcccgctgtccaatagctggtgttttgcgtttcgtgtgggttctttaagtccctcggtttctcagggggtttctggtccttttggtatgttagggtttttgtgtgccccttccccaagtttcgttgtttcatgaaacggaaatctctcggtttaatgccaagagacctgtgtcccggtggacacagcaatttctggtctttgaaattgttacgcgaagtattccctgatttaagggactttttggaacgatttctccattggaggataaattgccccttaatatggagcccaaaatggtgctttttcctatgagtaaatgtccccatacccaagggttccacatcacgggcacggcatattacccatatatggttgatcttagttctcaaacgccacgtgtgacgcctcatttntgngnaccctgtccccttngttnanaaaanacaccactggggaaaanaaannancccnnatanngcttanctngtgcaccctagaggcttttttaataaccacaacgtgctttttgtttgtttgttttggattctttaaaaaatataggttaattctccactttaagtgccgcctcctcttagccacgaattctcacttactgcttcacnttnttgtaanaacacanttnaatttannataattttccacnatnttggcacctgcttaaatagaatatangcactctttcaatatggtaggaacccnacncaggagaactttccnttaaannccctttttacacctttatggtaagtagcccgggggggaaangcatttatagatcacttttctaggccaaattgtgaanctaatgaccncacctgtttctacctatatgccgtctctttattttactagaaatgggaatcatggccttcttgaagagaaaaaagtcacccattctgcatttagctgtattcantatattgcanttctgtattttttgtttgtattgtaaaaaattcacataataaacgatgttgtgatgta

SEQ ID NO: 516132 - DNA, 1466 bp, Homo sapiens
  misc_feature (1252)..(1252): n is a, c, g, or t
actgacagaccatacgcgatgatgctgctgcttacggtgccttttagcaacgctatgcaacacaatcctgatacaaaccaagataccatagacgagtcaactctggcttctgacgaactttaccacagtgaacaagatgtacctacgattccatcatgcccgtccacgtacaacgccaacccacggaacacctggacctgaggtctctctgtgcctaccggtacttacacatctcaaccatttgactcgtcacgtgtacttcgtgatacctttacctggcacacccagacacgacccttttcaaccacactcacttggatcccacacacgcactacccagtgccaccaggtctctgtacgcacccacgcctactgggctgcttccacttcagccctatcctgtatacacagcaccttgtggaagccccgtttacaaacttcctgatcgatggactttccacgtgtacccatcctgtgacgacccaccttgtgaactcgactccaccgcacattacgcaccacctctgggtaagtcgttcacgccctggttggcacccactttggagcaaagcgtcggccttgttcgatagagtagctggcccaactggtacaccactcaacctggttagtcacggtatccttccacaacacacatctaacgcccacatacaactcaccatggggcgcacaatggggcgccttggcattggcgccattacaaccgggcccccaggacagacaaattcccatccaaacgccaaccttattcgtggggagaacacgcgataccctgcacggtcccacgcgcgtgtggccacccattcccaccaccctcgacttgcagcgtccaatggcagcacggctttcatgggacaggaaattctcatggcatactacgggtggccccacaccacccctcttggcgctcgcaagcaacacccccccagggtccgtgtcccctacaccatcacaacaacaacagctttcaccaacacatacaaacttttcataccgtcatggggggtgctgattagaccactcgcagcatggcgggacagcctcaatggggacaaactacccccgaagcagcctaacaacagatggccaggacaagcaccatcgtgccgtgcgcagcgggcagacggaacaatccacctatcgcaacaccacccgggcgcaaccggccacagaccacgtatgcgcccagtagaccagcccacggcacgaccatacgacaaccgcaagtaggganacacgcatccacagcgatctggacggcgcccaaccacgaaccgctgaacgcaccaccccgcggccagctcaacaccacacccaacaacaggcatcaacggtcgcaagccaacaccacaacatcgacagcgacataagcacccacctacgtaaagctgcgagtccatgccacagccgggcaacagcgacacacatgctcgaggtagccatcgacc

SEQ ID NO: 516133 - DNA, 333 bp, Homo sapiens
gaattaaaggactgtccgctagtggtcaatcaagaacacattttaaatatagatatacattttataaattgtaaatatatatttgagacggagtctcattctatcacccaggcttgagtgcgagtggtgcgatcttggctcactgcaggctccaccttccaggttcatgccattctcctgcctcagcctcccaagtagctgggactaccggtgcctgtaaccacgcccagctaattttcttgtgtatttttagtagagatggggtttcacggtgttagcctagatggtctcgatcttctgacctcatgatccgcccaccttggcctcccaaag

SEQ ID NO: 516134 - DNA, 699 bp, Homo sapiens
tctgtaaatccatgcctaagagggcgggaaataggtattttccaagccaagattgattaggaagtgtcatgagaggcccctggtttccaataagacctttcggaattcgctaacacaggagtgcattcaaacgaagagccaatatagtgatgagctccaaagagggccgggacgggcgggttggcttgtaggtaactgaaagtgtcgaaaggaaaattctatggcctggttgcgtggggacttgaactccataaaaggggtttgagaccggaagaaatttcccctcatgtttaggaaattcacatgagggggggtttcccggctctgagggcagtgccacgtgttttctgtgtagagggagacgatactcccgttcacaccccaaaggtaaagaacccccggaaaaaatagcgggagacgggcgcctttccgatttcaaaagaggctcccagaggggtggggggatgggaaaacaaaaaaagcgaaaggggaaaaacagaaagtttggccttccggaacttttttaaaggaccggtggatgcaacccgcccaggggtgcctttttgaaaggcaacctgggattcttggttctttcctggggaactgccgggtttaaaccgggccccccacagaaaacatatgggttaaggggttctggttcaagggcaaaggaggtgtaaaattttttgtggggaggcg

SEQ ID NO: 516135 - DNA, 153 bp, Homo sapiens
tctaagaccccgtcgacggtacacagacacatagaaaaaatgtgaatgtgtgtgtaatacaatggaatattattcagcttttttttttttgggagagggagtctctctctgtccgccaggttggagttcaggggtgtgatctcgggacaagtt

SEQ ID NO: 516136 - DNA, 262 bp, Homo sapiens
tcagtgttcatattccacatgccccaggaggtgggcagtgcgcagaggcaaggtgcagttaagtccatctggggaatgtgttatatacactaccacaccagctacgcacagggggttcagcttcctcaactacaacacaggtgccattcacttcatctgctgggtttctcattatccacctatcatgtcttcatcagggacctcacagcagcaaacagcagcatttaggcccagcacactgggcagtgcagtgggcagggca

SEQ ID NO: 516137 - DNA, 946 bp, Homo sapiens
  misc_feature (312)..(312): n is a, c, g, or t
  misc_feature (946)..(946): n is a, c, g, or t
ggtgcgatcagatcgatctaaaatggcgactgtcgaaccggataccatccctactcctaagtcccccgactacaggaagaggagagaacggatatctaatcaaggaggttgctagacccagaatcactatattaatacatcccctacaggaacagatgggcactctggttgtttaatagaatgataaaacgcaaaaccttggacatacgcaaatcctgccgtgctgtgtctccaatgttttagactatctgcttgatagcactcttctcggtggtctgatacaagccgatactccagggtgtctacgtacantttaactgccctggactgtgaacttactcagcttttgtaagggactgcgtagttcgaagccctactgctgagcgaacgactgaggcaaacatacctagaaccgtgggcagcgcagcgatggcctaagttaccattttgacaccagaactatgcatgcacgacgaaggtagacctctgattcggcttttggcctatgatgaccacttctcgtgcctctatttgggagaactcgtttcgactgactacagctgagtgatgtatgtgcgcgctgctgtgtgtaatgctctagcagctacaagcgtgactaagtatagcacattatggactactgagattgtgaacaacagagaagctgttacaccagtatagggagggtatacacaggaaaggttaggacttcctccaaagatagtgatcgcgttatcatgtcccagcgcatgacacagtctactaagagcggatccaccactaaaaataggttgccgttaagaagacaccttctgagtatctcataggagactgcgtcaagcaatcgagattgggagctgaaccaaagcctcttcaaaaaaggcagagtggcctgctttaacattggattcccatcttaatgtaccccagatcttagagaagtctn

SEQ ID NO: 516138 - DNA, 172 bp, Homo sapiens
tctactagtgcctggtagacaagtgtctacattgaagatacacaacacctcgttgttaagacattgtcctgtagacttgatattacacgatgtgctattaggtgcaataagagtgaagcgctgtctgcccagagaaataagtaatttatataagtaaataaatttcataaat

SEQ ID NO: 516139 - DNA, 201 bp, Homo sapiens
  misc_feature (179)..(179): n is a, c, g, or t
ccgcagctggcggcttggtggcaatgttttacttctcggctgagtgaggggtggcgtcggtgtttatttataacacgttctagggctgggcagatggctcatgtttgtagtctcagtactttgggaggccaaagataggaggattgcttgagcccgtgagtttgagaccagcgtgggtnacatagcgagaccctgtctcta

SEQ ID NO: 516140 - DNA, 299 bp, Homo sapiens
aaaacacaatttaaaaatgtggcaaaagtccaagcgtggtggctcatgcctgtaatttcagcactttgggaggccaaggtgggaaggtcacttgagcccaggagttcaagaccagcctggaaaacacagggaaatcctgtctctatcaaaaaaatttaaaaactagttgggtgtggtggtgcacacctatagtcccagctactctggaggctgaggtgggaggatcccttgagcccaggaggtcaaggctacagtgagccatgaccatgccacttacactccagcaagaccctgtttca

SEQ ID NO: 516141 - DNA, 359 bp, Homo sapiens
tctctggaaaatatcaatttggaaatgctgcctttcaaatcaatgccatgatcatccatattgttgagtttgttgttggtgttccagaagtgtccccattttacaactttatgcacacacctggcaaatcattaacatgagcattcaacagtactgggatgggtggggtgttgataggcggctcaccaacagaactgtccatgagacattgtctgaagacgcaccacctattaaggccagatcgtggttggaggagcacagatatgagaattttgatctagcctccgttttgaatggtaaaaagaaaatgccgctatggaggatggaagtgctgccatacagattggaaatcctttctt

SEQ ID NO: 516142 - DNA, 965 bp, Homo sapiens
tggggaaaaacccgggggggccgggggggggggtggaccccccttggggggggggggtcccccccttttggggaaaattttttttaggggggcccccaaggtgggggggagggggggggggccccccgtagactttttacaaaaaaaaaaaaaaacaacactgaggcgggcctcctcatgtcggggcgggtggcgacagaacgacagagagggtaaagcaaaaggcggaccagcgagcgagcacacggggtgccctgagccgccagactattgctgtgtgccgcagaagggggggaacaacactaccgcgcggccccccctaataggaggagactggcactacatatcctcgaaaaagccacgcgcgggtatccgcgcgcggttttatatagaggatcgctggcgggacaaaccgaccggactgaaataccgccgcccaacacggagagaggacggagcctcactaggcaggcacgccgaacgaggaagccctcgcagcaaatctagtccctggcgacgaagcaaacaacacgatgaatgacgccgaacacaacgacaacaagcaacccacagacgcccaggcaggacagcaatcgaggccaacgcacggagccacaagagaccaagacacagtcaggttctgccagcggacgaccagactgggcgagcacgttgaagcgagcggggtgacgacgacacaaagcaaggacagggtctaataaaggaggacacacgtagcagagcagcccccacgaggagaaaaagcagtgagcgcacggcagagtaagcccaggggagtgaaactaccgctacacagaggagcgtggcagaaggagaaagaaaacgtagctttcacacgagggatgcacacaacgaatcagtaagaagacggagcgctgacggaataaggaaggagccgcaaccagccacgtggaaacgacaccaggagaggaaaccagggataa

SEQ ID NO: 516143 - DNA, 165 bp, Homo sapiens
gcggcgttggcggcttgtgcagcaatggccaagaatcaaggctcgagaatcttcgcgggaaggagcaggaggagctgctgaaacagctggacgcactcaaggtagcagctgtcccacttgcccttccgccaaagttacaagcggtcagctcaagctcttaagtcc

SEQ ID NO: 516144 - DNA, 132 bp, Homo sapiens
gggatccagaaaccagcctctccgcgcgtccctctgcgcgctggcgaggcctgagacgtctcccgggggtgaccagcgtgcaaggtctggagaccctggtcgcgctcccagcccagggaaagcccaggcgac

SEQ ID NO: 516145 - DNA, 378 bp, Homo sapiens
cgtggattgtgggtagaccgtggcttactcgttatttaataaactggcagggatttcctgtgtcatgccacgctgggctgcacttctaaccttggcttctaacagcaaacgcacattggcttggagatgccactgctggaatcagtggatgccgacccaaagcaaggaacaggtcacagtgatccagaacatggcgagagacccagggatcaaagttaccagggggaaaacaggcatttttttggacttaacttttggggaaacgacatacatgcagagaaaatgcaggggtggggcttgagtcccaccaggcgggaggaaaaggcaggtcaagggtagggcgtggcgagaaggcgcaccttgtagtcttccctggtg

SEQ ID NO: 516146 - DNA, 473 bp, Homo sapiens
  misc_feature (120)..(120): n is a, c, g, or t
cccgctgcgtattctatgagaagcgtatggcacagaagttgctgctgacgctctgggtgaagaatggaaagggttatgtggtcccgaatcaggtggtgcgaaccgaccaatacaagggtnttccccaatgaatagcaggggtggtcttgaccccatgggccgtgtccgcctgctactgagtaaggtggcatcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggcccccaaaagagctagcagaatccgcaaacttttcaatctctctaaagaagatgatgtccgccagtatgttgtaagaaagcccttaaataaagaaggtaagaaacctaggaccaaagcacccgag

SEQ ID NO: 516147 - DNA, 123 bp, Homo sapiens
attttctacacgattgtctgaacctgcggttcctctcgtactgagcaggattaccagtggcaacaacacatcatcagtagggtaaaactaacctgtctcactgacggtgtctataacccatgc

SEQ ID NO: 516148 - DNA, 335 bp, Homo sapiens
gagaggacctcatatgaatatgggacgcttccctatcatggcatgaggtcggcacctgtgccacctgcagcgggtaggaatcagttcccgacaccatgagctacattctccagagactcaagcatgcgaagtcggtgatccacagtcggcagtttccattcagattacttaacgcccatagatgccattgatgccctcgaggctcaactcagaaatcaagcattgccctttccttcgaatatccaccctgcatgcaggcggcatcctcacctagaaatgcaccaagaaccgtcccaggcaggaggttactttgccacctcaaccgtcagcagctt

SEQ ID NO: 516149 - DNA, 458 bp, Homo sapiens
  misc_feature (345)..(345): n is a, c, g, or t
  misc_feature (366)..(367): n is a, c, g, or t
  misc_feature (377)..(377): n is a, c, g, or t
  misc_feature (383)..(383): n is a, c, g, or t
cgagttctagttccctgaggtctttaaaaacaaaaacagaatgttgtacgtgaagattctaggaggggagggaccagcaaatctgagagaaccgtcctggggcctcccttcgaggagccctctgatgtgaggagggacttgagttgagtgacgctgtggtgtgaggtgttctgagctcactgaccggaaggtccaggtgaatctcgtcataagtgatctcaggctctcacaggatccggagggaaatgtgttagagggtctggaaaattcagtgcttttgagttacttgtttttattaaaatttcctccacaaaaaaaatcccccaattgtgggtgtttttgggnaaaagggttccaccggtttcnnacaagatgtnaatttnaaaaaccagttgattttttacaaagtaagtgtgttgggaattccttaattttgtgcaaaaatttttttggtaaaa

SEQ ID NO: 516150 - DNA, 219 bp, Homo sapiens
agcagagaaactgccctgcctaaagttaatcgccgatgaactagaagtccccggttaattaaatgtaagtagattgtagaacctgttttatatccaacaatgtttataatggggatatagaattgttccctgtaaaaaaaatggcccaaatgtgttttttttttaataagtaacttggctataaaataaaaccgtccgtggggcggctgccctcgttta

SEQ ID NO: 516151 - DNA, 315 bp, Homo sapiens
attcactatacctagggtctcaccggcgtgaaatacgcggcttctctcaataggaggctataaaattaatttctgggttaatttacgaaagctgaggggtcgctgaacgagagtcatgttgaagccaataataaaacagaaaagaccagtatgggggcagtgaaaggggtcactgagcggcaaaatcattgagaacaaaaaggaaatatagtgttgtctcacaggtgatcaataatcaccttctaggaaaatccaaaggaaggtcttaatcaattttctacttctctgaagcttcagcaatttgtgccacctttc

SEQ ID NO: 516152 - DNA, 298 bp, Homo sapiens
acctgttcactgcgcgtcctaccagccagcttatctgttgggctctcggccgcgtacaccgggtctctcccacgagaaggggggggactcccacgcagtcctgggtcaccccgcagctgctctggagacttggctctgggcgtctcgtggcccaagtgctccaagttggaagcttctgtgggcctcgtgtaggggatgccgtgctgggtgagcaaacctttcagccttttgatctcctttgagagttctttatgagccttcctgcagttttccagggtctcaaaccccaagctgtcag

SEQ ID NO: 516153 - DNA, 659 bp, Homo sapiens
  misc_feature (227)..(227): n is a, c, g, or t
  misc_feature (531)..(531): n is a, c, g, or t
  misc_feature (541)..(541): n is a, c, g, or t
  misc_feature (596)..(596): n is a, c, g, or t
  misc_feature (601)..(601): n is a, c, g, or t
agcggaggggcgcgccgcagcgtcctcaacgccgcaacgtcgccgggccaactgcaggaaggtctgtgctctggagccagggtaaatggttataaaattatacaccatggccctcctaagagacactctaggaaaaccatgtcatcctgatcttaaaacagcgctgcaaggaagagagctacacgtacctctcaccagttgattgtccacgtccaataggctttacntaccagtgtagtctcgtatatctcgggttcactcgttgcgtcgcttaccacttctatttacctcgccacgaaacgggaatacgtgatccacgctttcttgatcttgcgtgtatggtgtagacgcgaacccgatgttagcaaattgtgcaaaatggcgcagcattggctacaaataatatcacggaattgtatagcatgaccagggatagaggctaggtgcctcgtcctacctgttgcccagcgataaagcatcgtcgtagagaggactcgtgacaattgggacgcccagaggaggggtcagacnaaacagagantcgcccctcaaaaaggagtctgtgcgcgagacatccacaaacgttcgcagcgttntgtancaagatctagtgaggctcgactgcgcaagcgaaaggggaacctcggcgacatataatc

SEQ ID NO: 516154 - DNA, 186 bp, Homo sapiens
gggttttttttcccatcctactcccttttgtttccctggcctctgccatcctgaaccatgccttggttttaacctggctgggcaagttttgtgaaacttatcctgctgtttcggggtggcacccatatgtgctccccatgtgtaaggtgacatttccaaatgcctttgtgtgataatggtgttgga

SEQ ID NO: 516155 - DNA, 402 bp, Homo sapiens
agtcgtgtccgtccccccaacgggaatcatgcagaatatctcaagcatagaggcaagcattttaactaaaaaaaaaaaaaaaaaaaaaatcctaattggtttttaaagaaaaaaaaaatcttaaaatccctttggctggataaattagaaataatatcttctggtcctacttgggtgaacacaaatgtgccaagaatccagtcacttacgggcaaaccaaaggtggggaacaatccatttacacgttctactcaaacacagtgcaacacggccgtgtccatatataattttctttatagttaccaacacttttcgggcaaagacaaagtttgggaagggcaaaagcaacagaagtttaagatctcaaagctccagaagggaattaatctgagtctacgtcat

SEQ ID NO: 516156 - DNA, 305 bp, Homo sapiens
ccctcaccatctacccatgcatactggatcttggcagagctctcaccatctacccatgcatactgggtcttggcagagccctcaccatctacccatgcatactgggtcttagtagagccctcaccgtctacccatgcatactggatctcggcagagcccccaccgtctacccatgcatactgggtcttagcagagccctcaccgtctacccatgcatactggatcttggcagagccctcaccgtctacccatgcatactggatcttggcagagccctcaccatctacccatgcatactgggtctt

SEQ ID NO: 516157 - DNA, 178 bp, Homo sapiens
ccgctccagtacggaatatcatcattacctcctccacatctaccatcgtcatcacatcctccatctcctccaggacttgggtcacttcacttctcttcatttctttctgtattcttttcttttcttttttttttttttttggcatttgcagagttggggtctcccgagactcaaatgc

SEQ ID NO: 516158 - DNA, 120 bp, Homo sapiens
tggtaaccagggcccccttttcagtttttgtgtctgttattggagtctggccagggttgacttgagctgagaccccaaatgctcccggagatgctggacccataaagcaagttccagcca

SEQ ID NO: 516159 - DNA, 229 bp, Homo sapiens
tgtatgttcatctcctttgggtctctcaagtgaaatgaacattcttttaacatgaaatctcccatgagacagttgacttcacagttcctgataggcactgtggttccacttgagcatcacatgtggccattctttgcactggtagagagtacactcagtgccatgttctgatccaagaggacccggtgaagctaaccatattcattccgtccaggcaagtcttgtcgat

SEQ ID NO: 516160 - DNA, 1176 bp, Homo sapiens
tttttttttcaacctgaagaggtttaaataggggaatctgggttacagggatcctcataaagaagaaccgccgtggctgtggggtgctcaaaccacatgtgggccgacccaaaagagcgccaaaaccaagaagcgtgctcaggaggcactaaagtgtttgacggtctgggccggcttcacatctctcaatttcagcatgaacaagccagaggggtaaggtgcgagtgacgccgcagcaccctcaagtggccttgagtttccaggtgggtgtgtgccgtgaataccagagggtcttctaagaccaggcaggtgtgaggcgaatttctcagtggtctgtggtgagtggtgcgattccggggtccaattattattcccttgggttactccagggggcctcacaagtgggctatattttcacaagacctcttgtggtacccatgcgatagggcacaaaaggcgggacaagggcgcaacgtggggaggaaaccaatcgtggtggagaccaccagcgcaaagaagtgtgtacttcaccgagggtgggacaaagggaggtaccgacgtggggaccaacgaaacgcaaagggagtttcccattgggcgatcagggatccttaactggcgtttaacaattccttgggatacatcttaggacatatactgggtgggtgaaaacgtggtgcttccagcccaggggaaccagggggtatagggaccaaaccggatgcatactggtcacaaagcaattcaggaatctatcctcgtcttccaaaggatgtccgaaaggggtttaccgatacagtgggctccgggaaagggctctctcacacaaactgtgctagctccgaaaaaggacgttaatgtgcccacaatttctctgagaagagacgtctaaaacaaatcggcgattacggatgtgtgcacaccgcgtagagagcattgtcaacaatccgcagcgtctcccgtgggaacgtatcgtagaccatgtgtggaggagaacactctccaaaaacatcgccccacgagacgagaggctaggggtgtccccagtcctccaccaaaatcggtggtgccaccccagtggggagggcgaacccgtgcgggacaaaacatgaatagcgcaggcctacgacaaaataggcgcgcacactaggaaagagcggtgaattaaacgaacgt

SEQ ID NO: 516161 - DNA, 217 bp, Homo sapiens
  misc_feature (76)..(76): n is a, c, g, or t
  misc_feature (79)..(79): n is a, c, g, or t
cccaagatatacagaccagccctgccacatactccaaggtggattgaatatcaaactatgatgatgatgaaaatantcnctttaaaattcgtgacattggccgggcacgggtgcacgcctataatcccagcactttgggaggctgaggcaggtggatcacctgaggtcaggagttcaagaccatcttgaccaacatggtgaaaccctgtctctacta

SEQ ID NO: 516162 - DNA, 430 bp, Homo sapiens
ccatatctttagtctatactgcgactcctctcctttttcctctcttgtagttgatcctcggcttaatgcgtatgactgtccctactaaagattccagggttgagtcatcaatgttacgcgtatgtcgactcctactgcgacggggacgaggggttcgtctatcccaagagcgactgagaggtgcgggtctctgcctgagcattagtggtgcaagctcgtcggtgtggaaaatagaagaattagccaggcatggtggcacgcgactggaatcccatctattcgggaggctgaggcaagagaatcgcttgaccccaggaggcagatggttgccgtgagctgaaatcacaccattgcatgccagcctagaggacaaagcaagactctatctcaaaaaaggacactgactcggcaagaccgaaaagcccgtctc

SEQ ID NO: 516163 - DNA, 475 bp, Homo sapiens
  misc_feature (465)..(465): n is a, c, g, or t
  misc_feature (468)..(469): n is a, c, g, or t
gagggctggggctgggagatccggcggagccccggcagagcagtcgcccgtgagcccccgcaactcagacgcgctcggcctcgcgctccggggctgggaccaccgagggcgagctgcagccttcgccacccggtccgccgccggactccgcctcccacaaacagcccggcaaggcccttttccgccgctccctcatccagcgaagcctccttcccagcttccccggcggcggcgccgtgacgtcacttccgttctccagcgcgcacgtgggaggaagtgctggtgccctctgccgctgctcccgtctctttggttacgctcgtcagccgctggctcagccgcaagtacccgtccatcatagtcaactgcgtggaagagaaggtgaggaggcgccagccgtgtgccgctatgggagtcccggcgttcttccgctggctcagccgcaagtacccgtccatcatagtnaanngcgtgg

SEQ ID NO: 516164 - DNA, 272 bp, Homo sapiens
  misc_feature (40)..(40): n is a, c, g, or t
  misc_feature (239)..(239): n is a, c, g, or t
  misc_feature (241)..(241): n is a, c, g, or t
ttcattcaaatgctttcaatattaaagaactagggcaaanaaatatggaaaatgggatctgtgaagcagcattatttctgaatagcacagacatcaatggctcccctttccctgtgatggcgtttcaggcagggccaaagtgactgagccgtactccacagctctctaatcagatttttctgcaagcatattaaaagggaaaggaaggccaggtcagtggccacaattgtgccactgcncnccagcctgggtggcagagcaagctctgtctc

SEQ ID NO: 516165 - DNA, 354 bp, Homo sapiens
ggctggagtgcagtggtgagatctcagctcactgcaacctccgccacccagattcaagtgattctcctgcctcagcctcccgagtagctgggattacaggcaggcaccaccacgcctggctaatttttgtatttttagtaaagacagggtttcagcatgttggtcaggctggtctcgaactcctgacctcaggtgatccaaccggctcacctccctgaggtgaggctaggattacaggcatgagccaacacacctggccaagtggcagtatttgaaaaaagaaaagcagagaaaaatgctcaacctgtaagtataatgcaaatatagtgtccaaactccaaacaaaaaaaaaaa

SEQ ID NO: 516166 - DNA, 915 bp, Homo sapiens
gagcatggggaaacgtgcacaaaatctttccataataacaaagaggccttactgcctttacataccacatggacagaatgcgtgtcaaagtgaattatctaacattgtaaaaatgtatgtttcccctcacggtctgcagctcccaatgtggtcatttcagaaatgttatatagcatctcaagggttatgccagaccctttcctccaaacccaaactttcatgtcctacttcattccagcaggaggcacttaggggagactcggatgcggcgacatgccagaacaatcgcaggtctccttagacttattccttatggttaatatatgatcattatcatgaataaccgtgaggcaggaaagatgcttctcctttataaagatcccctccagatcctcaagacacagagcctctgtgaagagccttccccgaagaatgtcgctttatagacggacttcattgaaaatctttggttcgtccttgaatcagagtgtcataataatttgttgcttcttttttaaagatattcccacctcagcactcagagacacaaaaatagctgtagtctcaattaagagcagaatctcagagaatagctgttgtgcaatccaaatccagcctttgaggaatagagctgccccattaacgatcagcaagaggagattacctctgtttgttaccccctggggatcaggcataaaggaaaagagcaccagcgttgtcagtatgacctggaagtaccgaggccgatgttggcttggtgtaatcaatgaggccaggtgccctagtctctcaaaggggggaggactcaggtggaaatgacacgacgttttggagaggcggtgtgaacgggcgtagaacactcgttgatcctatcccgtaaacacagatagtcttcctctcaatactataatatcg

SEQ ID NO: 516167 - DNA, 145 bp, Homo sapiens
gcacagctcatggccggtgtgtagcgcttggcatggtgtcttcaggttctccttgagctccgtgttcagctgctggtagtaggcgtagggaggataccagcgatgatctccagcagaaagatgatgagcagcaggaggaattccg

SEQ ID NO: 516168 - DNA, 387 bp, Homo sapiens
  misc_feature (84)..(84): n is a, c, g, or t
  misc_feature (222)..(222): n is a, c, g, or t
  misc_feature (248)..(248): n is a, c, g, or t
  misc_feature (255)..(255): n is a, c, g, or t
  misc_feature (257)..(257): n is a, c, g, or t
  misc_feature (260)..(260): n is a, c, g, or t
  misc_feature (310)..(311): n is a, c, g, or t
  misc_feature (313)..(313): n is a, c, g, or t
gaaacgacctgaactgtctgtgtgctctctggtgtcccatgtcgccctctggccagtgagagcctcaaggaccctggcctttgnttcccagccccacagtgcagggagttgagcagggtccggggtggtggagaccagggccaggctgggctctcccttgggccagcagttcccgcaggtgttgagggtcgggggatgctgcccacttggccgccgccgccncgcgtcatggtctccctgtcgagtgnccggcgncntcngccgggcctcaagtcctctgccacggggtcggcctctgttgagtgagtcnngnttgtcaggctgcgtgggggactggcccagctgactggtctctctctcctgcactaaaaggatcaacaaggaaaa

SEQ ID NO: 516169 - DNA, 392 bp, Homo sapiens
tctagacgatcctatggatcagagccaggaagctgggtcaagtttcacgtctcttgagtgaggggctctgcactcctccatcctgtactatgtagtgtcatctttcatgacctacatggagacattcaaatccggggatgacacagagcttggagggagagacgtgtcaggagacagaaacagtgtccctggagatatcagcaggcaagtgtgctgagctcacactgagagccagaggggattctgaaaactagactgatgattaaaactgcttaaaaactcagcagcctccccatgctcccgggattaatgatgcaggctcacattgactacacacgtttataccaggcgccatgttctttgccgaaactcccgctcagagcctggataga

SEQ ID NO: 516170 - DNA, 459 bp, Homo sapiens
  misc_feature (8)..(8): n is a, c, g, or t
  misc_feature (62)..(62): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (87)..(87): n is a, c, g, or t
  misc_feature (94)..(94): n is a, c, g, or t
  misc_feature (99)..(99): n is a, c, g, or t
  misc_feature (120)..(120): n is a, c, g, or t
  misc_feature (164)..(164): n is a, c, g, or t
  misc_feature (187)..(187): n is a, c, g, or t
  misc_feature (228)..(228): n is a, c, g, or t
  misc_feature (417)..(417): n is a, c, g, or t
ctcttgtnctcatggttatagctttggtatcttttttggtgctgttatcccttggttttttntttactgtgtctctggnttncngtnagtggtnttctnggaagaagttgattggccggngctggaagcccacggagttcccaggtgtggctgtgttgggaatntcctctgagtgggggatgttcangaagcccaccgtcacccaggccaccaaaaaatcattttcantgttctcgttgttgtgaagaaactgctcaaagaccacgggcgggtgccaggggtcgttctggtggtagatgctgctgctgcacagctccgactcccggtacttggtcactgccagggggtaccttgcccaggtgatggcctgctcctcctgccagcctgggggcagcccctggtcggccatggagtggntctgcaggcggtactgcgcttgtggccccacgggttctcctc

SEQ ID NO: 516171 - DNA, 127 bp, Homo sapiens
atatgcattctggtgtgagtagttgagagccttgtctgcagaagaaagtgagggaatggatagaatatcttggaaaaagaatgctttccccgcttcattgggtctctcagcatgtaaaggttgatga

SEQ ID NO: 516172 - DNA, 215 bp, Homo sapiens
gggccggtatatagcctataactccggcctggccaggtatggtgcgatctcatagaggtaccacagcgggatggagctgggccgtgatcgtaggttgacacggcagagagccatcctctataagcggctgaaagtgcctcctgcgattaaccagttcacccagaatggctcaccgaatgacccgcagcatgtcccaccgaatgcctccccgaatg

SEQ ID NO: 516173 - DNA, 558 bp, Homo sapiens
aaagtgtacggataaaacctcaaatacaggatcatattttaggattcacacgacgtgctatgtgtaaaatgcatcgtgctaggtatgtaataactagaaagtaatagtggatgttgtaatgggggtgatacttattttcgcatcaggtaagtttgagttgataaccttaaaatttccttccaaataacagtccattagaaagccactagttaatctataaaaactttcaagtatatacatagtccaggcttgaaataatgatataaagcgcccagaagcttcccacacgaccctttcttatctacatcagccagccgctttatcatcagcaaccacaacattactaccgactacactagaagatccatatgataggccacatctatagctatagtcacaattccaactgagtaaaaactacatattcttttattaacataaaacactaaaacatttaaataagagcacttatagcattttaatgcccattcattcattcaacaaacatttactgactacctttggtataacccggcactgtataaagtgttgatcatc

SEQ ID NO: 516174 - DNA, 391 bp, Homo sapiens
caaactcaaattacgaacgccctcccagtggcatcataatcctttttcaaggggttcaaactttactccccctaaaaggtttttgaggaattttagcaagcctcgttaacctccccttacccccccctattaacctattgggagaactttttgtgttagtaaccccgttttcctgatcaaaaatccctttcctacttacagggctcaacatattagtcccagccctaaactccctttacaaatttccccccccccaatgggggtccttccccccccccattaacaacataaaaccctctttcccccgagaaaaccccctcatgtttatacccctagcccccattttcttcctatccctcaaccccgaaatcattaccgggttttctttttt

SEQ ID NO: 516175 - DNA, 894 bp, Homo sapiens
ttaggtgtccgaaaatgatgcgtatagtcgaattgaagtagtccgtttatacatctgtttataccatagtgatgcaccttgtagactacctcaatgggatctatagttctgtagtattcataggtctacttattagaccagaatggagtcttgtgaatattgcgtcaatttagtatactgagttaagtaattgccacgagatatgttgggctagtatgcatattgatattaggtatatgagatagaatatttactcgtataacaatagtatagctcaaggttgaagtcttcttgtgtcggaaaatagcattgtatatctaggaattagcaatcaaaacaagtgatcgagcaagagatgatggtcattgtgtcaatatgcttaggtggcacccgtgtgaaaataccgataggtttggccgagaagtgttctctatatactgtatcatatacatcgtggtggatctctcatatccagtgtaggggtagaaatctgtaggaatcgcagtagtaccatctaggatggaaactgaaggtcacgagcaatgtatagtatacctttcctaggattgagacaaatactatttatctcatatactcgtttgctccttatctagtactggcttgatcagcggcaaaatattgtagctgagaatttctctaaacaattccttgtcatgagacgattcaccaagatcaaaagccaggctcaggttaatacgaatgtgtggagaacggatatgatggatacgttgacgttccagaagcgctgtaggtcctgatagtgctaaggttttatggttgagccatcttaaaatgtgccgcttgattaaagtctagagcatcatttggaatttgctatctcgcttgtcccaaaaattttacgccccccccggg

SEQ ID NO: 516176 - DNA, 154 bp, Homo sapiens
  misc_feature (50)..(50): n is a, c, g, or t
tgccactccccctcgcacacgtcatcagagaaaggtgttctgaataacantataccgcatgcagacttcatgttcacacaggcacacacacacacgtctgacctctcacccccaccccattcacctttgaatcccacttggcacctaagcacag

SEQ ID NO: 516177 - DNA, 357 bp, Homo sapiens
tgagcgatctagaggatcccatctcaggcaggacgacaagggagtcactatctcaagaaaaaaaaacacaaaaaaaagaaaaaaaagaaaaaactgatagttgctaaaatttctcctttttaaccctgatccagctctacacacccatggcccttagttggtgccccaggaggccgaacctggttcttttcccttctggttcccaggtggtttgggccattggaaggaagtttaacgagtgaaagaagagagatagtcagagattgtattcctcgtagtttctctccaagcccattagttccccattcaagttccccagaattccaccagctcgctccttggccttgagattgggat

SEQ ID NO: 516178 - DNA, 515 bp, Homo sapiens
  misc_feature (133)..(133): n is a, c, g, or t
catcacctcgctctggctcccatgggctgattacatcattatgaactactcagtcaacattccaaataaccacctcggaaagattggttcctgagctgtgtccatccagagggctactcatcagagcacaggnccaagagctggtcatcacctactggccaggtggacccaaggtccttaccaagtgggtggtgataaatcttctcagttcctggtcccaaggcatgaagaagatgtacaagcgtggctcaagtaccccgagtggaaacagaagcactgctcacttcaagccggtggttgggccggagcagagaccgttgcgagcctggcgctgtcggagctgtcggtgcagcatgcggacctcactggagaacatccgacgagagcgcggtgggcgaaaacagagaggaacggatgggggggcgggccgggaggcagcgacagacgaacaactcggctcacctgagcgccgaccgttcagggagaggagaaaggaccgggggaaccctggggcg

SEQ ID NO: 516179 - DNA, 264 bp, Homo sapiens
tcttactgtagggggcagtaacatttcagcttaaacttagttactgcattcatttatatcatttaacaaatatcatcatgtgtggcttaagggcagggatacattctgagaaatgcatttgttagataatttcattgttatgtgaacacctggttggtataacctgccacacacctaggctacaagcctgtacagcatgttactgtactgaatactataggcaatgttaacacaaagtatttatgtatctaaacatagagaagg

SEQ ID NO: 516180 - DNA, 178 bp, Homo sapiens
  misc_feature (54)..(54): n is a, c, g, or t
  misc_feature (132)..(133): n is a, c, g, or t
ggagacactctcacacattcagatacacaccttctcatagctcatacaacattnccttgaagacacatcttaggacaaaaaggagcttatcaatttttaacaagtaaatttctatgaactacattctatganncaaatggaatgagacgtatacacgataaaagcaaaaaaaaaaact

SEQ ID NO: 516181 - DNA, 178 bp, Homo sapiens
atcctattgagaaacactagttctttctctattgaatggtcttgacaccctgtttgaaacatcagttgaccatagatgcatgtgtttattatctgtactgtcatgagtatgcgtcgtgtggtgatggttgtactgagcacaataatgctactaaaatacgcattcaactgtttactgt

SEQ ID NO: 516182 - DNA, 286 bp, Homo sapiens
gcgacgctggagtggcaagaggaagggtatggtaatccacacactgcaagagaaaaggagcagtcgcggaatagttgattatgtattagtctcacgctcagtaaatcggcactttatgtaagctgtggtgaacatggagcagctacctgtggggatatttaaccttttatctgtagctgtctgattaggaacaaaaggaaaggcagcttcttgcatgactcagctttcagctgaatttgttttcttttggcagagtgaactgaggtactccagcgtgctgatacaa

SEQ ID NO: 516183 - DNA, 490 bp, Homo sapiens
ctggagttctggaagggacttgtctgattagagcagggggagggccaagcatgtcctggggtcagaggagatgcttggccagagcttctgaggaattcggctgtgctgtgggggtggggaagactgcataggagaagtgggtagggccgccatgtagagcctcatcaagattggggccagggctcagtgggccacccctgggccgctccctgggggtgggatttggaggcggtccctgccatgcaccctgtggtgggtcggaggtgagtgattttgttttcttctaggtggaggcccccctgcctcccaccctcactccccaccccactctccagctgcagaggatggtttaggagcaaaaatggtcacaactttaaagggtgtcccatgttaatgctggctttttttttctttaaaaaatttgttcttttgaaatttatatttgtttctccacagattttgagatgtttactttaaaaaaaaaatctaa

SEQ ID NO: 516184 - DNA, 363 bp, Homo sapiens
gcgggggctcacaactgtgatatcagccttccaagtagcagggattacaaagccagctagctttaagatacggtgttgggcatcacgttttggcatggagcaggcactcttttctttgcccccaggtgggactaagccaccacaagccttccctggtgtgtgcagtgggtgatgaatgcttgcctgctcagcacccacttcctggtgggctgggtcacattactatgactcccccttgagcttcagtccgcgcctggttggagattattgactcaacccggggatccagaggtgggatgtagctctggcctggccagaggaccgaggatgctgcatgccatggctacagctactggttcggct

SEQ ID NO: 516185 - DNA, 884 bp, Homo sapiens
catcgagaccgcggtggatgcctcggtccctgcagtgcctgtctgctgaggaggccaccgaagctcggggacgcgaggagccggcgtggccctggagaattacgccccgattcctggacgctggtgcacgcgcatctcactcatgctgcacggctgcagcgcgcgtctagggcgttcctgccgagctggaggaaggccaccgccaggtacctgcgcagcgggccctgtactagcggacttcgcgcgctaccggagcactagtgcacggggtgacccaggcctttcgccggcgcctcgcgggaggtgctggcggttgacagcaagagactgggcgagcctcgctaggcagccgcttctcgcctggccagagtgcacagactgcaggagctggagcatacgcggttgggcacggtggcctctgactgcatttgatggagactccatagctggctggggcagtgaggacggctgtacgtgagttcaacaactgaaaatgacaggtaacttacaaaccattggaagcgatcaacggaagggttcatccaggacgcttaggtatgactgcgtgaatctgccgatgtgatggctggattccccagggcattgcgccagagtcgagcatgggcaaacggggcggatggcgccgagcccaagcccttaactggcagctggctgtggttgcgccccactgcgctgctgaccttcctgcagttcctagagcagccttcccatcaaaataaaggaagcttcctccatcttgttaacaaacgttgacgagtaaacgaataatgaggggaggggcggaaccaaggaataaccactaagtggggccaagattttaaggttaaacaccagatatatcagttaataatgggtggttccca

SEQ ID NO: 516186 - DNA, 188 bp, Homo sapiens
ctctgtgagtgctgtcttctggtgcttgaccatgcctggccattcaacgcctccgtgaccatttcaacgcctaccgggccattcaacgcctccgggccattcaacgcctccgggccattcaacgcctccgggccatacaacgcctccgggccattcaacgcctccgggccaattcaacgcctccgggc

SEQ ID NO: 516187 - DNA, 292 bp, Homo sapiens
attgtttttttaattttagtttacataatatatattataggaagttatggatattggatataggggaccctattcttcattatcttaatatatttgctatgttataatttatctatatattctttattaacatttaggagttttgtttatgaattttgtttttgatattgacggtaccatttcatttgatggttatcatgttgatctacttattgaagaacgtatttttaaattacatcaacttggccatcaagtgatatttgcatccgcacgtccaattagagatttgcta

SEQ ID NO: 516188 - DNA, 193 bp, Homo sapiens
  misc_feature (41)..(41): n is a, c, g, or t
tgtgcacggatcactgctgtgaccgagcaatacaggagcgngtgcgttgctccagatactgagagctctgaaaagggaacggaggtgagaagaggtgtggggagcgcgagtaaagttgcattggtcatgccaggccagtcatgaacttgagcacaggtgcatgtggagctggaagggaagcaacagtgggagg

SEQ ID NO: 516189 - DNA, 182 bp, Homo sapiens
aagaaataagcaaacaagaactagagttactatacaagaaactcttcttagtttttaaaccttaagcataaggattcagttgaccctttcttgggtcatcaatcttgaaagaacttacataatgcgccatttacactttcacctgggagcaccatggccgtaagtcttgacagccaatctat

SEQ ID NO: 516190 - DNA, 221 bp, Homo sapiens
  misc_feature (180)..(180): n is a, c, g, or t
gcactccagtgtgggtgacgagcgaaaatccgtctcagccaagaaaaaagaaaaaaagaaaaagaaaacttaactggcctttggggcacatgcctgtggtcccggcttcttgggaggctggggcatgagaaaaaaaatgggcctgggaggtggaggttgcggtgggttgaggttgtgccnctgcactccagcttgggcaataaaacaagactgtctcaagg

SEQ ID NO: 516191 - DNA, 398 bp, Homo sapiens
  misc_feature (10)..(12): n is a, c, g, or t
  misc_feature (27)..(27): n is a, c, g, or t
  misc_feature (49)..(49): n is a, c, g, or t
  misc_feature (55)..(55): n is a, c, g, or t
  misc_feature (61)..(61): n is a, c, g, or t
  misc_feature (76)..(76): n is a, c, g, or t
  misc_feature (80)..(80): n is a, c, g, or t
  misc_feature (124)..(125): n is a, c, g, or t
  misc_feature (191)..(193): n is a, c, g, or t
  misc_feature (199)..(199): n is a, c, g, or t
  misc_feature (215)..(216): n is a, c, g, or t
  misc_feature (367)..(367): n is a, c, g, or t
  misc_feature (370)..(370): n is a, c, g, or t
cgaagtcttnnnggagcccatgttcangtggacgcgggttgggagccgnctcctnggacgntcagcgtacgagttncgancgggaaggagtggtcgtcggagcgggttcccgccgagctcaatnngctccatgtatcgctgcaccgcccagaacccactgggctccaccgacacgcacacccggctcatcnnntttganaacccaaatatcccanngaggaacggaggactctaatggttccattggcccactggtgcccggctcaccttggtgctcgccctgacagtgattctggagctgacgtgaaggcacccgccccggccactccatcaggcactgacatctccacggccggttttcatttcnttncgtaactatttccagtcttgttcttaag

SEQ ID NO: 516192 - DNA, 985 bp, Homo sapiens
gcctccatcatctaccccaccacctatgtccagttcctgtaccacggccgtgcgcgggacacgccatcgccgacaccttcttctcctgcatcgcgtgtgtggcttacgccaccgaagtggactggacccgggcccggccggcgagatcactggctatatggccaccgtacccgggctgctgaaggtgctggagaccttcgttgcctgtcatcatcttcgcgttcatcacgcgactcccaatctgtaccatgcaccagccggccctggagtggtgcgtgggcggtgtacgccactctgcttcatcctagcggcagtcgccaggtcctgctgaacctgggggagtgcggccacacggtgtctacccatccccttccccagcttcctgtcggggctggccttgctgtctgtcctcctctatgccaacgccctatgttctctggaccctctatcagttcgatgacgaatgtatggaggcacgcactctggtagctcgagagatgtaagctgcagccgcaggcatgcctactacgtgtgtgcctggggaccggcgactggctgtggccatcctgacggcatcaacctacgtggcgtaatgtggctgacctggtgcactctgccaccgtggttttgtcaaggtctaagactctcccaagaggtcccgtgccctctccaagctcttgttcttcttgcggcgaggtttcttagtggagtacttctatcctccgctttctctgtgtcctcttcctgtttccgttccctccagcgttttctttccgtcccagtcgtgagcgctaaccagtctggaggcgtatttctacatcctttcactggcgggactcccggtggggttggcgcatctggttccccggcagggccctcttcttttttttaagaggttccctggcgcgggagcgcgggtctcggacccctggtagatttccgccttatttgagtatgccaggtccccatgacgcgaagacgaagc

SEQ ID NO: 516193 - DNA, 184 bp, Homo sapiens
ggagcaggtatttcgaagaaagcggaccatggcaagagtcattgatgtagccatagccagctaaaacactagaatgccggtccaaggctaccatgtgtggcacactcagactgagtaaagaatcacacctggcacagtcctatagcagtgcaatggccctacatcgcagagccttgagagacat

SEQ ID NO: 516194 - DNA, 973 bp, Homo sapiens
ctgaagaggctatgctaggtgtctctagcttaatggaggggacggcattcatctctgtctccctctgaagtgctttcgatcatccatctgatagtctcgtcataactagattctctctaagagtggggatcggcgtactcgttcaggtcctctggtgggagtggccaaagggacatgtgcccaggcggtctactgggggacatctggtttttcatgaatcagagagatctggatacctatcaatttccctgaagcactggatgcattgataggcttatactgcccatgtgctgctgcatagtgctccttacccactacttagctaaccatgatgggtttgtaagtactctggcagttgttcttaagaagaacaatgcacccccgttgagttatacttcaagggcattacaagaaacgtgcatgatgagtacatgtggatgtagagtatagaacttgaaggaatgtagatgttgaaggatttagtaggtatctctgtgctatttaatggtttatatggcagggaattgtaggctataagacaatgtgaattaatggcagttatgtcacatcaatcagagaaacatgttacaaatgaggcaacgtgagaaggataacttacccaggaggaataatttggatagtaaggcgttatatagcggagagtacataggtggagttcaagcctaggatagggaatgtaaccacttgcttggaaatttactcttcctgaggtagtgggctggcgagaggaaatcaagtgtaagtgtggataaaaaaacccttgccccggtatattgcgagggctgtggtgttatcttagaataaggtgcctagatattgtatgcagtggaatggtgggtagttaattgtaacattgtagaacagggtaaggaggaaattgaaaacattggtccaaatcaatagttacgaagatgggggggggtaaaatcagtgcagacaaagggtggaaaat

SEQ ID NO: 516195 - DNA, 151 bp, Homo sapiens
gtcggacctccaaatctatcattatttttggaggacaggtggcaaccttaattatactttggtggcattcttcccaatgcaagaaaaatttaatactttactgcttcccagctaaattaaaaacctatcacacactaacacatgtagtctt

SEQ ID NO: 516196 - DNA, 216 bp, Homo sapiens
ataaactgcatcaactaatgggcaaaataatcagctagcactcattatgacagtgatcaaattaccacataataatcttaatccttacatgcttgatgaggtaaatgccccgaattagaatacacagtacaggcaaatttgtgattagagagccaacgatgccagtcgcgtattcagcgacgacccactctcacactacaaacgacacactgtacg

SEQ ID NO: 516197 - DNA, 131 bp, Homo sapiens
  misc_feature (83)..(83): n is a, c, g, or t
  misc_feature (115)..(115): n is a, c, g, or t
taccctccttatgcaaccttgttgtcccccgctccctgggaatgtcaccatattgatgcctgaacttagtgctggacacccanatctggcattgctgcactacatgcccagaacntcctgtggctcaatgc

SEQ ID NO: 516198 - DNA, 549 bp, Homo sapiens
tgggcttgacccaggatttaaaaactggaacggtgaaggtgacagcagtcggttggagcgagcatctcccccaaagtttcacaagtgtggccgaggactttgtgatgtgcacattgggttgtttttgtataatagtcattccaaattatgagatgcatttgttacaggaagtccctttgccatccataaaagccaccccatttctctctaaggagaagtggcccagtcctctcccaagtccacacaggggaggtgatagcattgcttccggtgtaaattatgtaatgcaaaattttttaaatcttcgccttaatactttttaatgtggtctaatttggaatgatgagccttcgtgcccccctttccccctttttggtcccccaatttgagatgtttgaaggctttgggctccccctgggagctgggtggaggcagccagggtcttacctgtacactgatttgagaccagttgaataaaagtgcacacctttaaaaaaaaaaagtaaaatatatactaaaatcacacatcaagaaaccaatcaaaaaatg

SEQ ID NO: 516199 - DNA, 173 bp, Homo sapiens
ggagacgataaagattccagcagattttggcagtgaatattctcatctcccagaacaggccttctatatggttgaacccattgaagaagctgtggcaaaagctgataagctggctgaagagcattcatcgtgaggggtctttgtcctctgtactgtctctctccttcagactt

SEQ ID NO: 516200 - DNA, 106 bp, Homo sapiens
cggggttctctgacggatactcccaggaccgggggtcggagcgagatcggggggacacggaggtcttccgggctcctttacttctttctggttcttttatcctccg

SEQ ID NO: 516201 - DNA, 661 bp, Homo sapiens
  misc_feature (326)..(327): n is a, c, g, or t
  misc_feature (338)..(338): n is a, c, g, or t
  misc_feature (354)..(354): n is a, c, g, or t
  misc_feature (357)..(357): n is a, c, g, or t
tggggatattttccaggaaatctaagataggtagttctaggaaatttctctgccctcagcttcttttttttttgccaacacagacccacccagagatgaaaacatgaatgttttacaaggatgcttggtcattagtttgtgactcacactggcaaattctaaacttcagcttgctacctgggatacctgcatgcatgcagttcctccaaacctttggccaagagctcttcacttaatattttaaagagatttttgtttttaaaaagaatgcatttcatttttattttttgaaatggatctcgctctgtcgccaggctggagtgcannggtgcaatctnagcttactgaaacctntgncttctgggttcaagcgactttcctgcctaagccttccaagtagcttggactacagacatgcaccaccctgcccagctaattattggatttctagttgagacggggtttattcatgttgggaaggttggtcttgaactctagaccccgtcatccagtctcatcctatcctagggctggaattacatgcctgacccactcaagtctaccttggaatgcttacccttataacgggtgacctctccctaggctcctattaatacccgctcaatcgctcacctttgactgttcctgcaattttactgcc

SEQ ID NO: 516202 - DNA, 730 bp, Homo sapiens
taatggggcttgggtgagggaggtagtgtggtagttgtgtgtttaatattttaagtggggtgatgaggaatagtgtaaggagtatgggggtaattatggtgggccatacggtagtattaaagttgggggcattgaaaatgatgtgtgtgaggctgtattataccatagccgcctagcttcaaagagtcactggcggcaagtcactattggacccagcgatgggggcttcgacatgggcttatagggagtcataagtgggagcttcctgtaaagaggttatcttgtacttataaaagcttattggttgtaacgctagtctattattaaatgttggtgggctccaggagtttggataagtttcttggggcatgtgagggtggagtagtagaaatggtttagtggacgcctagggtggtggtgtggagttgtcaaattagtggcgatcgaagtagggagaagggacgcctaactaaggggtggtgacgaatcaggacagtccttgtcgttgcgctccacaattctatcgttgcttttttgggaacagtcattgctcaggggtcagtcaatcatacttggtgggggaccgatctcgtttaagcattgtgaagtcaggtacagggtaattgtacgtagtccaaaggcccatattttcgttgggcggacttggccctcagtggggcttagggccacgggtggctcgcaaggcggcaagacttagttttgccttggc

SEQ ID NO: 516203 - DNA, 769 bp, Homo sapiens
  misc_feature (7)..(7): n is a, c, g, or t
  misc_feature (66)..(66): n is a, c, g, or t
  misc_feature (71)..(71): n is a, c, g, or t
  misc_feature (101)..(101): n is a, c, g, or t
  misc_feature (227)..(227): n is a, c, g, or t
  misc_feature (251)..(251): n is a, c, g, or t
  misc_feature (267)..(267): n is a, c, g, or t
  misc_feature (285)..(285): n is a, c, g, or t
  misc_feature (306)..(307): n is a, c, g, or t
  misc_feature (316)..(317): n is a, c, g, or t
  misc_feature (321)..(321): n is a, c, g, or t
  misc_feature (323)..(323): n is a, c, g, or t
  misc_feature (329)..(329): n is a, c, g, or t
  misc_feature (331)..(331): n is a, c, g, or t
  misc_feature (352)..(352): n is a, c, g, or t
  misc_feature (391)..(391): n is a, c, g, or t
  misc_feature (394)..(394): n is a, c, g, or t
  misc_feature (398)..(398): n is a, c, g, or t
  misc_feature (408)..(408): n is a, c, g, or t
  misc_feature (432)..(432): n is a, c, g, or t
  misc_feature (465)..(465): n is a, c, g, or t
  misc_feature (467)..(467): n is a, c, g, or t
  misc_feature (533)..(533): n is a, c, g, or t
  misc_feature (689)..(689): n is a, c, g, or t
  misc_feature (718)..(718): n is a, c, g, or t
ccaggantccctgctgccagaacaccgtggactggggtacaggagttgttgcatagtccatgaagntagantcgggaagcagggactcacagttgccaggntgtccatctctgagccaatttccctccacaacccaggggtttcagtctcatatcaactatcatgtttgaaacagaaaacaggcaaaatgtttggctaaaataaaatgaaaacactgcagggaaganaactgactgtgctggtggacaggngccctgctcacctgtnggaagggcagggccagcnagggcagcagagctccctggnngtagctatnntgtntntgcatntngtcctccagctggtcccaggngagatgcggggacaggggacagttcaggtagacaggtanagntgantagggctctncctgatgtgttctggcatcaggangttgcctgatccccaacatgtatgatatgttcnangtagcaatgggacatctgcccaaaggatcaaagtccaacttggccagatcccaagcttcgcctgcntcatgtccctggctctgcaacgggtacccccaactccggggacgagccatggcctcaagcagcagctggctacgctgccgaaaccaggacacatctgcatcacacagaaagctgcgccaccctggtgtgacaggccctacttggtcaccctagggntaagctggagaagaactccagatgtgccntggagaggccccacctctcaggggccactcacagggtgccccccaccaccc

SEQ ID NO: 516204 - DNA, 894 bp, Homo sapiens
tagacccattttcttatgatgtcctgcttgggtggaccacgaaaacgtgtttgcaacgaacgtgcttcttggaaccgcgtgttgtacgcctgtctgcgtctttgtggtgacccaggcgcgcgccgtgccaataccctctccccgagggttattccctgccgcgcgggttactactcaccgcccctattgggggctgctcccgagaccaccccacgtgccaaacagggccgggtcccacagacaacgccaagggaaacgtcccccacaatttgggggcgcccacaacacgtcccctaaagggtctaatccggtaattctcttttccccacggggaacatccatctcccctgtccctaacttccatttccctaccccgccgccccccctagtagctaacacccacccctcccccctagaatggaggtcatatacacaggtctccccctttatcaaccctcctcaacagggaccacattttgggctccacataacccatcacgcaccacttttaaccaccttgccaaatgttggacaagatccccgtatgacaagtagagtttctttctgtaaaaaatctacacagcgcacactctttcttttaaagacgccaaggtctgggcgccctcactccccggcttgcacgccccctagcccccgtcagtaagccccacgcccgcccatgacacgccctcgggtgcccaatccagtttctccccccgctccgccggatgcctgagtcctccttgtgcctcgcccgttccaattagcttgtggaggcaagggggctcctcctgtggcttcccctctggtgtccgcacctcagcggcccccgagctagtccccccccgcctgggccccccagcgcgggcaacccgcgccgacccccacataaca

SEQ ID NO: 516205 - DNA, 855 bp, Homo sapiens
gaaattatcccgattggaaagagcgatctgtgtggatttgtttgttctcgtctcgatactccgttagcgtttgcattatggtttatctaatgtctgatgagcagtattgctcgtaaattcaggagaagcatattattgagtattgtgataaaagactagtggtcgcatgggtacttatcttgcaaacatggggtgactgggaatactgtcattgatgatcttcttgtggacatgatatcccgcatgaagtcaagtagattactatgtcatgattgatgagttcagatgctgatgcggtgattgtgctacatgttgatgtcccctgaaatttactcgacagattgatggtcaacgaccaatatgtattgtgagcacaagtaactttgttgagtgaatgataataacatgaatgagttccggaggtgttcggattagaggcgagtggtcacattggcctgattagtttatgatcgctttgctccaatctctcgtacacattgtgtttgaccacatctttgggaagacagttgtctgttgataggagaagtagatcgacatatttgattcacgcgtgtaaatgcctagactttattggtattgggtagaactcgagtcaaagttacgtacctgattggaaactgaggctggtggtacgaaaagttgaattgattctagcaaaaggtggaaagatgcctttgaaactacggagaactggtggttattcacttgcattgggttcgccatactttgcttcgaatttttcccctttttgctactaggtttcggtaaccttgattcctggtaagaagggattcctcccctaactggttcaacaactcttttgcttgctatcta

SEQ ID NO: 516206 - DNA, 514 bp, Homo sapiens
aacatctatgctgtgaagacagccgtgtcagttgcccaggggggccacagccgcaccagctctccaacgcccccttcctctgcaggctctggcggctctttcaatctctcaggatccggagacatgtttctggggatgcccgggctcaatggcgattcctaccctgcttcccaggtggaatcactccgacactcgatggggccggggagctacggggataacattgggggaggtcagatatacagtcctcgagaaattcgggccaatggtggctggcaggaggctgtgaccccgtcctcggtgacatccccgacagagggaccaggaagtgttcactctgacacctccaactgaccttgcccctcaaggtcgcggggctaggggcttccaccaggcaactcttaaggactctgggcatctagaggacaaaccccacagaagcacaaaacagagggcgattggggttgtgccctccccgaccagacgcttggtgctggggtgctgacaacatggc

SEQ ID NO: 516207 - DNA, 99 bp, Homo sapiens
tgtggggattacaggcatgagccactgtgcctaaaaatgtctggctacacagatcatctttgggcactctggtgcacttgttagaaacgatgctgtctc

SEQ ID NO: 516208 - DNA, 124 bp, Homo sapiens
cataatttagggacacaggaccctctcaagtagcaggactacaggcgtatgctaccacgcgcggctaatttttctatttttttgtggagacaggatttgcgatgttgcccaaggtgttcttcaa

SEQ ID NO: 516209 - DNA, 931 bp, Homo sapiens
  misc_feature (1)..(1): n is a, c, g, or t
nacaggagaaacaccactcgcagctccccttgtcgctatgtgtgggcgtgtcgggtgttccatctcgcgtcgaccattttgagcgtgcgcctctctacctcgggcgcggcctcgtccacctgggtgtcaacgtcccctgtgccaactctgttcgtcgtcgccaggcgtttttgccccacaggcgctttttggcctgtaaggcggagtgttcaagaccccgcggcgtgagacttgtcgaaaattggcagttctggccctttcaatacaatcgaagtccgggcaacgtctcataataggccctccacagccctccttttcttaaaaccaccctgtccctgcaaacggtttctttcttgtcactcccccgctgaaccaaccaatggggcttcccccccccgtttggggctccctcgagcgcttagttcatggacatgccccaggcccccccccgtgggggaaccctggggcgcgcccctttttccccgggtctattttttgctctccgggctcgttcatgctcttggtttgttagcaccccaggagccgccgctcccgagtcgggttcgcgccgcgggacgggttgttgcccccggacgtttctctctttgtctgctgcgcctgtgctccgcccccctcgtgtgtgtgaacaacccccccccctgatatgctcacctcctcttaaaggccctccctacgtctgcaaccgcctttttagatacaccaccatctatcgggtttttacacccccgcctgttcaaaagacccctgagatgacccctttttctttgataccgcatggccctaccccgttccccccacgcttcacccatcacgttgttcactccccctgtagaggtaaaattccctgaaccacctttttttaaaacaaatctttttaaaaaaccctttcttaaaacgcccacaagacaaa

SEQ ID NO: 516210 - DNA, 305 bp, Homo sapiens
  misc_feature (145)..(145): n is a, c, g, or t
ggtatgtgttccaccctggttcctagagtttctctgcaggattaaatttgagctgaccacagcggtaatttgcttgacaacatatcctttagtgcctttcagtccttatctgtcttgcattccactctgttaatggggtttactngggtcaacctcaaaatttaactgtaatgacaatccttgtcctatgggaatgttcctaggggcacccaaattaaggataggaggtagtggcaacacattggaacatagtcattggctaaaggtcttacattattaaccgtgggacacaacatgagtgtcct

SEQ ID NO: 516211 - DNA, 133 bp, Homo sapiens
tcagcaaacttcgggagcctaagaggagtccccagtgtgggcaggtggagcagaggtaagagaaactgtggtaaattgtccacctataaagacagtatcacactgggatatcaatcccctattcaaattccca

SEQ ID NO: 516212 - DNA, 216 bp, Homo sapiens
accctgcaggatgttgcgacaccttttcactgtatatggtcagtatcattatctcattgaaagttagtaggctgaatacttatacaatgcagatgagatagaaatgagaactctctaaatgtgtgaaggcctacttagccataagcttattattattatttaagagacagggttttgctgtgtctgcccagcgttggtcttgaactcctggaagct

SEQ ID NO: 516213 - DNA, 1659 bp, Homo sapiens
ggggccccccgtgggtcgactcggggtggtggcactgttagtttgctgtgctgactcctgtgttggggtgcgctgtggttgtctggtgtagttggctcgcgcgtgttgtgctcggtgtggttggcctacgagtgccgccggcggggggagcgcggctgccgctggcgggaggatgtttgtgctggtggatgcttctcgccacgggtagggggggcctgctgggtgaggtgtgtgtcggcgcggggcgagccggtggtcgtggagtgatgtgttgctacagacctgcggttgtgctggcggcgcaagacggcgtgctgttgggggcgcctcgcaccgccgtgtttgctgtggaggagaagaaggtgggcgaatgaataagtagtcggggtgccgacggtttggggccgccccatagtgtcaaggtgcccacaccattgggggggtgtgcgaagcgaacgcgtctgtaggggccgtgacggccgtccggtgtgtgtagatttggtgccgtctgtagccgcgccccccagtgacgtatggtgtatgcaccgcgaaggttgtgggggtggtaggtgtattacaccagtgggggcaaccaagggggggatttttttgtggcggggggggacaatggtgtgacgaaacgtgcttcttggttgtggggagaaagacaaagtggaggcgtggttggcgcgggcgtgggcgtgcagtagttggggtgaggttatgatcccggcgccgtatgtgggcctccggaggtggggcgtcgggccgcgcggtccctcgggaagtagtggggttgtgtggtagaagggggagcgcgccgtgtgtgtggggtggtctgggtgcggtgcggtgcggtggggcgtgtagaggagcccccggtggcgccgtctttcgcgtgggcggtggtgtcccacgtggtcttgtcgtgggggaagagacccgttgttgcgtctcgctccgcagagaaagcctcgcacagagatgagtcgccactttatgtgggcaacatcgcagagatggtgtggccacactcgtggagcgccacaaagtgtcagccgggcacaggttcacacatcatccgcggtgtagaaatggagatgtccccacacgtgtcgttgagcgccacactgagaccgctttctgtgtgtccccatgggcgtcacctgggagatgggccacaagcgtgggcctggtgtgaagggtggtgtgtctgtcgcacacttctcgcgcttctgaagtctcacacgggtatatgtgtgtgtgagcgcacacctgctttgagcgttaagcgcctccacgccacatgggcgcgcctgcggagatgccacgcaaggaggctctcgtggccacgaacaccctctccgcggaaggcccgcgcccactgagaatcacgaaggcccgcggttcttctccctcttctggccgctgaggcggggaactcacccacggccttcacgaaaccttcacgtacacgccctccgcgcacgcaccacgcacctgggtcgtgaggggccacacctgtggccctgtctccttagcagagaaaaagcacttctggaagttgaatgtctgttcccagaagccacatgtgtatcctgccgattgttctccctggttcccaccaaattgcccactaataacctgtatggaaaccga

SEQ ID NO: 516214 - DNA, 682 bp, Homo sapiens
catgtctctagtgatccctgagaagttccacgcatatttcgcggagtactcaagcaccaagctatcgatgggcggcggaaaatagcctttgccatcactgccattaatgggtgtgggccgaagcatatgctcatgtggtgttgaggaaagcagacattgacctcaccaagagggcggtgagaactcagctgatggatgaggtggagacgtgtgagtcaccgagtcagtgcagaatccatcgccagtgacaagagtcccagaactgggttcttgaacagacagaaggatgtaaaggatggaaagatacagccaggtcctagcccaatggctctggacaactacagctccgtgaagcacctggatgcgactgaagaatgattcgggcccatagagggtcgtgcgtcacttctggggccttcgtgtccgaggccaggcacaccaagaccactggccgccgtggccgcaccgtgggtgtgtccaagcaagaaataagctctgtaggccttgtctgtgaatcaaatagtcatataccttagtacagacaaaaaacccaaaacccgaaggccacaaatgtggggcggcgcgaacggggtacgacaggggatcgggcctgaactgtgctagaaccgagcgagcttggccagggggagagaactaccggtccccagagcgcgggccaatg

SEQ ID NO: 516215 - DNA, 453 bp, Homo sapiens
aaaatgcgagtcaagcataggacattgcctcatgtaactgataagtctagaggtatgtaagttttaggcacagtttgatcagagctgtggtcctgatctcagtgctgcccatattttgtgtgtgttagctttgtctccaggatacttcttcatggtcacaagatggctgcctgccacaaatagggatatggtcactttccacaatcatttttcaaagggcctgaattttgttcccgttgaactatccctgactcaatccctgtggcccaggaattccgtctactgactgatgtaggcctggattatatgatgcaatcattgtggtgaaaaaaaggaccctctggagttgggagtgaggtcatttcacataaaccacatgacttccacataatacttgtgcttatttgccatctctatatatatcttctttggtaaaatgcctgttcaagtctt

SEQ ID NO: 516216 - DNA, 242 bp, Homo sapiens
aaattggagaagagaaaattttgcccaccagcgagactaaacagtgcacaatattggatacctaccctggcgccagtgaagctgatagcaggagaaactctatcttctactgggccttttgctctggaacctgatgcaacaggaactagtaaggctatcagaatttaccacagcatctactctcagcttagataataaatgtgatgttgacttatctttaactactcaagatactgaacatg

SEQ ID NO: 516217 - DNA, 852 bp, Homo sapiens
tgccctcatttacatgaatattatactagcatttaccatctcactgctaggaatagtagtatatcgctcacagctcatatcctccctactatgcctagaaggaataatactatcgctgttcattatagctactctcataaccctcaagacccactgccctcttagccagtatgtgcctatggccatactagtcttgccgcctgcgaagacacggtggggctagccctacgtagtctcaatctccaacacatatggcctagactagtacataacctaaacctactccagatgctacaactaatcgtcccaacaaatttatattactaccagtgacatgattttcccaaaaaacacacattaattgtgacattcaacgacagacaccccacaggcctaattataggcactcatccctctacgtatttgttcaaccaagatcaacaaacaacctgatttaagggtcgttccccaaacttttttgcctgcgaccccccgtacaaaacccccctcataaattactaaacttacctggagttcctacccccttcaccaattcatggaaaggccaaaggcccacatttattccagtggaaccagtatcacggagaaaaaacttctagccgtctctaataataaatctccccctaacaaatcttccgtgatttcataaccatccacaggcacagaactactcataagagaatatctgccttcggaaacaaagttattcccaacttgggtatatataacgccggatggaggcaacaaggccagaacggcggacgcggccatcttactattcacaactaagaggcactattccaatcatgcctatttacagccagaacctag

SEQ ID NO: 516218 - DNA, 414 bp, Homo sapiens
gcccctttcccggcccttccccccttttgccgggggggggggcccccaattcaaattttcccttttaccccccccggggtcgccccctttatgccccgcggtcctccccgggattcatttggaatttcctttttggggccccctttgtttttttttttaaacccccaaggccccccccctgggggggtgtttccgggggttttttttttttttgggggttgaggggtgccccccccccaccccttttagagaacccttttatgcccctgggggggggttgcccccaaggttccttttttccagggttgcccttgggaatatttggcccccctttcccccgcttttggttttcctctaaattgaggtttttttttttatgctttttttccccgtttaaaaaaaagggttttttta

SEQ ID NO: 516219 - DNA, 83 bp, Homo sapiens
cccaggagctgctacaggcagagccagcactgatagccccccgcaccggccccgccaccccaggccacatccccacccatctg

SEQ ID NO: 516220 - DNA, 156 bp, Homo sapiens
tcatcagatgctctgacacaactgttagaccctggcaagtcatcatgcactttggattgtggaggctatgacacagtcatgcatactgcaccagagactgtggatggccctcggaaactgtgggtgatggccggggggtttcagacataatccttg

SEQ ID NO: 516221 - DNA, 1702 bp, Homo sapiens
  misc_feature (1)..(1): n is a, c, g, or t
natgtagtttcgaacggtaaggtgggtagtatgaagcttctggctgggcgtgtgggagagtggagaatatggtttatgagaatgagcgtgatgtgtgtctgtctgcttaggtaggtgtggttttgatatataagatggaggggggatgtagtgaagaaaggatgggaggagggaagtaggacgtggtgtggtgtttgtgtgcgctggtggggtgctgtgtttgttgttggttgacctcacgtgctgggtgggtctacccccatcctcgtcatatcgtgtgtggtgttcgtagaaataagacaatatattatggggtgtgctcgtgctccttcgtcctggcatgtgtgctgtcggtgtctctggtagggagttgtgttggttggctggctattgtggtcggccatctgttcgtttgtgttgtgcgtgcgctccctgtcttttttgtgtagtagtgcggtgggaggtggtggcttgtctagcgccattctaaggatgagtaacagacgactctagtgtgttgtttggtggggtggtcaccgcccaccagccgtctgtgtgtggtttgcttatcgagaggagtgtgtggctgtctgtgtttggtgttcgactagctgcatgcgagcagtgtggttgtcggtcggtcgttgtgtgatcgaacagctgccttcatagctggtatgcaaccatctagcggcggttcgtttagtagtaggggggggggggaggaggagaggaggggggcgggtttttgttgttgaagagtgagtgggtggtggtggtgtgagtaataataactgccgctgggtgtggttctttcgaccagagggggggcgcgtctgctgccctccggcgggggtgagaggaatgaatgtcattcttgggtgagttagttagtgtctcggtgtgtgctgtctgtctgccttcggcgttcttacgtgtagttggtgggacgccgccaggctgcatgctcacggtcggctccgcatatctatgttgggcggcgccatcgccgccggcagcatgatcgacgagacgccgcctcgtctgcgtcgtcatcttcttgcttcttctcctgcttgtgttggtctatgaggaggaggtggtggtaggaagaggtgttcgtcctgcgcggtgttctcgtgtgtgaggatacaccacggctctctcacgagcacagcagctgcggggggggtgtgtcttctcgtgtgtggggagaaacactcgtgtgggcgcgtctggtgtgttgtctgtgtgtgtgtgtagacaccacacgctctggtgtatatatatgtatgtcgtgtgagacacgaccgccagcagtttgtataccctcgcccgcgcgcgccccgcggggaggcctcttttatcagattttcccctcggtatttttataaacatctgtgttctcttgtctcccgcggacatttttttacacccgcgcgtagaggaaagagagagagagagagagagagagagagagggggagagaacacccaacacctcttctttttttccacggccctctgcgatgctccctcttggggtggggcccacgaggtgtgttatagtcgccccgccccgcgccctggctcccgatagccctcccggtgccctcttttttttggggtgtaggttatatctcgcttgtgttttggggtgtaaacacctacccgcacccattaaggaagagaattgtgggaga

SEQ ID NO: 516222 - DNA, 101 bp, Homo sapiens
acaccatgagtattgagaagacacatacccacaccatcgcagcaggcatggtgctcagtctggttttctcttactggcagggcattttggaagtgtcaaag

SEQ ID NO: 516223 - DNA, 221 bp, Homo sapiens
aacgaggtgttatggcaacatggaagtacccatgacttcgaaaagcagttttcaactttaagtgtgtgaaagctttatggtggcgagttcaagtgtgaatggaagagatgggggcaatgatagaagcatagttttgggatcttcctgaatggctacataaaaatagcaactagatagcacaatcaaaaatcaaaagctgggagagctgaggaccatcgtgg

SEQ ID NO: 516224 - DNA, 147 bp, Homo sapiens
gtattttattcagattcagctacttaacgtatcagaaacgggcactacaaagaatcgcccatgcggttgcaacctagcagtcgctttatgattggtgttggtgctacctggaccactactcaattttaaccaaagcattctatagat

SEQ ID NO: 516225 - DNA, 434 bp, Homo sapiens
gggagaaggaggccgggcacagtggctcacatctgtaatcccagcactttggaggccaaagaggaaggatcatttgagtccaggagtttgagaccagcccgggcaacatagcaagaccccatctttttttaaaaaatgaagaaataaattagccaggcgtggtggcaggtgcctgtagtccaaactacttgggaggctgaggccggaggatcacttgaggctgcagtgagctatgattatgccaccacactccagcctgggtgacagagtgagaccctgtctcaaaaaagtgggtgggagccaggggtagtgtcacgcctgccatcccagcaccttgggcggcctaggtgggtggatcacatgaggtcaggagttcgagactagcagaccaaaatggctaaatactagatctctacagaaaatacacacaatca

SEQ ID NO: 516226 - DNA, 234 bp, Homo sapiens
cctcgtgatgagtcgccgtttgattcatcattatttctcgtttatcaaccgtgagtgccttactaagaattataatgtgattggtctgttctgtaacattatcttctccaaggtcaactcatcgactctcatcacctttggcatgatcttcatcttccctttctcctgtgttaaattgttctccactaagctcatctagatccgctacagttcctccttttggcccttatcgag

SEQ ID NO: 516227 - DNA, 464 bp, Homo sapiens
  misc_feature (87)..(87): n is a, c, g, or t
ctttttaatcacctgggtgcaggcggcctgagtcgaaaaagagagtcagcaaaggaaaataggggtgggccgttttatagaatttgngtaggtaagccaaaattacagtcaaaggggttgttctctggcaggctggggtgggggtcacaaggtgctcagtgggggtgattctgagccaggagaaggaatttcacaaggttaatcgctcagttaaggtggggcaggaacaaatcacaatggtggaatgtcatcagttaaggcaggaacaggccattttcacttcttttgtgaatcttcagttacttcaggccatctggatgaatacgtgcagacttgggctcagaggcccttgatcccaggaggtcaaggctgcagtgagccgtgcttgtaccactgcactccagcctaggcaacagagcaagacccgcggacagctggagaggccgagtagtctcgctttgatt

SEQ ID NO: 516228 - DNA, 360 bp, Homo sapiens
cccaagttacggaaggcgtgttgtggtcacatctcaatgcagcttgagtcctgggctcaggtgatcttcccttagcctccagagtagctaggactaccggcactggccactactcccggccaatttttagctggggttcaccatgatgcccaggctggccgcaaactccttggctcaagcgatcctcttacctcagccttctgagtagctgggactacacatgtgtaccaccatgcccagctatttttttgtttgttttgtataggtggggttcactatgtttctcaggctggtcttgaactcctggactcaagcaacccaccttccttggcctcctaaagtactgggataccagcatga

SEQ ID NO: 516229 - DNA, 372 bp, Homo sapiens
agtcaattttaagcacctttacaaatgagccttgggttacaggattgttttttgtatttatgctgattttgtgtgtattcagtgtgcaaacctaacctttcttatattctttaaaaaggagctgtgatgtgagtcaattcaatttactaagcatcagagcgtcctgttatctagcatgacagtcacaaaggggaatgaagcaagggctctgccttaaaaggagatctttaatcagaaatgatagtaatacactgtgagattgaaataacaagagtaggcacagggttttttgcacacaaagagaagagtggaaaaatcttgtgagcggaaataataaaaacttattcctttaggagtttaatggatctgaaa

SEQ ID NO: 516230 - DNA, 881 bp, Homo sapiens
  misc_feature (874)..(874): n is a, c, g, or t
gagaagccgggagaactggttgcgcctgcgtggatcggaagccggttgggtgtgagaggttatctcgctctagggagattcttcaagcaatcactatgtcaaggagacacaggtgtttcccttccttcatatgaggaagatcagggggtcaaaatgcatgcgaaagagctacatagagtgcaccattcgtacccgtttgaatagcgggtttggcagcaatgggttggcttatggatgatataaatgaagagcagggtgaagtactaaaatgtccattcatctgatccatcatgcgtgggcagcccaagggttgtggtaggagcaagtgactgtggtatgggctattgccatgtatcggaaatgctgggcaaaactaagccttagaagaagagatgctgtctttggtctgtgtgtggaggagctttgttttagtgagatgtcttatgattaaagtatacctattatgtgtgggaagataaactaatgtgtatgggttagatggtaaccatggcatttctgaatatgtgggttccctttttgtgcaaggcttgattggttgggtgacctgattactagtgaactagtttgacttaactagcgtcatacaacgacgtccaggttaactaaacatgtatgtaaatggactgatggtgtgttgaaatgtcacttttaaatttgaagatgactagtgctaagagatagggggcaatctggagtatcccgttggtggaatgcgaatttgggttgaaaagcaattggccagtaaaacttggtggcgtttggaggggggtaaacgttcaaggggaaatttgggcaggagattttttgtaccacagaaagggtgtttaaaaggaacatttggaagaagatgtanagtgtga

SEQ ID NO: 516231 - DNA, 819 bp, Homo sapiens
  misc_feature (232)..(232): n is a, c, g, or t
  misc_feature (486)..(486): n is a, c, g, or t
  misc_feature (724)..(724): n is a, c, g, or t
  misc_feature (747)..(747): n is a, c, g, or t
cctgtaactgacagaatgggctccctgatggcccaattactagaaaataatgaacttggtctactgcatctctagggcctcgtggcaatacagagcactcataagagcgaggtttgctcatatcatccaaggacgaatgtactgccaaattaaatgcttctgaatgtttctacggcgcatccattcgacactcgacatggcccatcagtaactcgacacatgatcgataaanacatctatcctgacactaatagactcaaagaccgtcttgtcaatcagtagccctgcactaaatccaccctactagagactacaaaaagggtctgcctgtgatccaaagcactttaacacaggcgcagatagcatggccgggccgatacataatagcaactctagactggttcgaacatatggtatctgcacacactgaagctcaaattgcgattgcttgctatgtaaaatcaattaacacatacactggcaatntatagacaaggtggggcgtggtaacacccgtaaactgggacatcatacaatgtttaaagaaattccgaattctgactccatggtaaaatataacgagcaagttactgcacacatatttaaatgaaggccggccaaaaagagcggggggaacccataattttattatccaataaacctctcgggcagatttgaactcttcggccggttggaaacccaaacttgtaaagatcggcaaaantcccttttataaaaaaacaattnacctattttgggttgggtatggggcgaatttataaacataacacacaggattggaagctcatccaccgtgcc

SEQ ID NO: 516232 - DNA, 116 bp, Homo sapiens
agatggacagcccagcgaattcggatatgtgattgtgtggttcgttgcgaactttcggttcgtatcatcttcaccaccgcaatttggctgacgcacaaattgcttgggtgttatat

SEQ ID NO: 516233 - DNA, 924 bp, Homo sapiens
  misc_feature (10)..(10): n is a, c, g, or t
  misc_feature (229)..(229): n is a, c, g, or t
  misc_feature (370)..(370): n is a, c, g, or t
  misc_feature (381)..(381): n is a, c, g, or t
  misc_feature (440)..(440): n is a, c, g, or t
  misc_feature (530)..(530): n is a, c, g, or t
  misc_feature (540)..(540): n is a, c, g, or t
  misc_feature (542)..(542): n is a, c, g, or t
  misc_feature (550)..(551): n is a, c, g, or t
  misc_feature (554)..(556): n is a, c, g, or t
  misc_feature (576)..(576): n is a, c, g, or t
  misc_feature (579)..(579): n is a, c, g, or t
  misc_feature (595)..(595): n is a, c, g, or t
  misc_feature (597)..(597): n is a, c, g, or t
  misc_feature (625)..(625): n is a, c, g, or t
  misc_feature (662)..(663): n is a, c, g, or t
  misc_feature (685)..(685): n is a, c, g, or t
  misc_feature (698)..(698): n is a, c, g, or t
  misc_feature (736)..(736): n is a, c, g, or t
  misc_feature (750)..(750): n is a, c, g, or t
  misc_feature (756)..(756): n is a, c, g, or t
  misc_feature (784)..(784): n is a, c, g, or t
  misc_feature (787)..(787): n is a, c, g, or t
  misc_feature (793)..(793): n is a, c, g, or t
  misc_feature (807)..(807): n is a, c, g, or t
  misc_feature (834)..(834): n is a, c, g, or t
  misc_feature (893)..(893): n is a, c, g, or t
ccgcagtggncggcgagcgcggggctcggcccgagctcaggagatggggaaactgaggcacggagctggacagtgactcagacaccaggagctgcctggagtggagctgagagctcaggtctgggctcagccagtccagagtgcaaatcttactgtccctttctagctgttgttgatcttgacaggcactggacggggcctgcaggggtctccacagagaccatcatgnttgtctgttttgtggggagcatgtgtgtgtgtgggcgagaaaaatcatggctttgagggtcctgtaccacagcgtaagcaggggcccatctccaccaagggaggtgggcggacttcatccgggagagggccaccaatcganggaggaccgtncgtcgaaggcgaatggcgaaaactctcccaagctgggccagcaaacgggaacccccatnggggacctttcgccccgcgtctgggagggtcttccgcggtctcctcggacaagctggcgctgtgccacctgggaactgcacacggaattnacaggatctncntcaagggnnttnnnccgctgacggcgagggaacnagngcaagaacccacaatnanttgcaaaggaggaaagtggtgagcaccnttggaatgctgtgcagggtactctcggggcgtcacannctcctgccccaagtcccgcganaaataactggaancgttgcatgggaccaggagcgggtggcggagggagagnaccagccagaaggngatggncaaaggcggagactaaaaccaagaaggnggnagagancgtgcggcgctcangtggaaaaatacaactcagcccgagcngactttgagcagaagatgctggactcagccctgcgcttccaagccatggaggagacacnactgagggacatgaagggaactgctgggctc

SEQ ID NO: 516234 - DNA, 566 bp, Homo sapiens
  misc_feature (481)..(481): n is a, c, g, or t
gtggtaagtggcttcgtggtcttatagctgtcactcttttgtactttgtcttaactcttttattccttttgagcgattgtgcgaacatagcatagcacgcactatgccttctgtgttgtagctgcctggccagggcgactggcgcgataacggtacttgtagcagtgagccgtcgaggtcttatagagtagcatgtgggcgctttgatgaaggacaaaatggcgatggcgggccgtgtatgtcccccttcctatgatgaggaccttttcacagacctgtactgagtctccgtgaggataattaactctgaggcagatgggccctgcaaagccttcttgcttagcacgtctgttcagtaaaatcagcgttattgctaaatgccctgtagttgactctaatgtcttattgggctcctgttctgcatggactttatcgctgcacgctgggaaaccgataggagacgtcctctgtagtctgcaantgttccagtcccagctaagtagccttagctgggtgcacacggacatggggacaatgatcctcgattctttttatgccagaagcca

SEQ ID NO: 516235 - DNA, 323 bp, Homo sapiens
ccttatatatctctgggattaattatgtataagcaataattaataacaacaaccacgtctccatccaaccattttatgcgggatgaattacctgacaagaaaaaggttatgacggggctgatgtgaacatatgaattgcttttacaaatgtaaaatgccgactgacaatttgttcatttaacatggtgggatatttttgtgtgcagatataatgtggtcttcccactacgactcgggaaagcatgcagtttattagcctacagatgaaatacattcacaaggtggtgaatgtgcaaggtgatgacgagtttggggcgttaaga

SEQ ID NO: 516236 - DNA, 560 bp, Homo sapiens
  misc_feature (16)..(16): n is a, c, g, or t
  misc_feature (81)..(81): n is a, c, g, or t
  misc_feature (103)..(104): n is a, c, g, or t
  misc_feature (108)..(108): n is a, c, g, or t
  misc_feature (121)..(121): n is a, c, g, or t
  misc_feature (144)..(144): n is a, c, g, or t
  misc_feature (178)..(178): n is a, c, g, or t
  misc_feature (192)..(192): n is a, c, g, or t
  misc_feature (205)..(205): n is a, c, g, or t
  misc_feature (214)..(214): n is a, c, g, or t
  misc_feature (274)..(274): n is a, c, g, or t
  misc_feature (285)..(285): n is a, c, g, or t
  misc_feature (364)..(364): n is a, c, g, or t
  misc_feature (400)..(400): n is a, c, g, or t
  misc_feature (462)..(462): n is a, c, g, or t
  misc_feature (559)..(559): n is a, c, g, or t
aacttcatggtataangttgggagagaggaggaggaacatggagccagggctccaggcctctccagagaagtcctcacccncgaagcaccccctcgggggacnnccgncccaggccacgcncccccccacgcccagcctccgtntgagggagaggggagattaacagtggtgcgaggncaagaggggttggngggggcaggggcngggcggggncacaggaagtggtgggccacgggcttttgggaggggatgccccgtgtttttgggggagcngcctcaaagangaggaaatctttctggagaggcccgtccagccccaagagggctgccacagtcccacagcggtagcggtggtggggtgcngaccacacagtgagccccgtctcactgaagtcccantggtaaccctccatcaccagtgggggggcacggcagaccaggtcaatgtaattggctgcgtngaactgggccaccacgtaactcccaaaaaggtagcgcgggtcctcgggggcccaggcgcaaccctgtcgtgtctcctgggttagaacagaggaggtna

SEQ ID NO: 516237 - DNA, 159 bp, Homo sapiens
  misc_feature (50)..(50): n is a, c, g, or t
  misc_feature (55)..(55): n is a, c, g, or t
  misc_feature (61)..(61): n is a, c, g, or t
  misc_feature (135)..(135): n is a, c, g, or t
gtgctggtgtagaggatccccgagacggtggggatagaaggcagaagtangggtnagaatngaagtgagattcttccattctaccctctctctctcttcctctctctggcctcacctccccagccagcccaggcngcgccagcatcttcttcctctcca

SEQ ID NO: 516238 - DNA, 165 bp, Homo sapiens
attactatgtggagagcatcgcagacttgacagaggggttggaggactgagcccactgcacctgcgccacagcccacccctccccactccctgatccgtagtggaggcgatgggtcacgagccatgttaagtcacaacctagctccttggtcagttctcgaccgg

SEQ ID NO: 516239 - DNA, 339 bp, Homo sapiens
gtgacttattgatatgctctttctcgattccgctgtcgtgtgtgtcatgccgttcttagttcgtggatgcgatattgtcttggttcattccgataacgaacgcaaactctggcatgctaactatttacgcgactcccgagcggtcgtcgtgcttcaacttcttagagggacatgtggctttcagccacccgagtattgagccattacaggtctgtgatgcccttagatgttcgtggttgaacgcgcgcttactgctggctcagcgtgtgcctaccctacgccggcaggcgcgggtaacccgttgaaccccattcgtgatggggatcggggattgcaatt

SEQ ID NO: 516240 - DNA, 379 bp, Homo sapiens
catgtgcaggtttgttataaaggtatattttgcgattctgaggtttggggcacgattgaacccatcacccaggtagggagcatattacccaataggtatgttttcaaccttttctcccctccctcccgcttcttatagtccccactgtcttttgttcccatctttctgtccatgtggactcagtatttagctcccacttatgaaaacatgcggtattcggttttctgtttctgggttaactcacttaggatactggcctccagctgcatccatgttgctgcagaggacatgatttcattcttttttatggctgcataatacttcatgggtgctgtgccgttcctggtcagtgccacctttggcaccactgggctagggg

SEQ ID NO: 516241 - DNA, 112 bp, Homo sapiens
tacaccttttttttacttactttatcgggcctggggcgcgttccctggagatgcatccttgttgaagcatgggtgtttctcattcctcagatctcaccccaggaggggtagg

SEQ ID NO: 516242 - DNA, 521 bp, Homo sapiens
  misc_feature (129)..(129): n is a, c, g, or t
ttaaagtcttaacacagaaatcctacctcctagttttaagatataaatacttgaatgatataatcaatcaagagggattaattaactgtgcagttgattgattatatcatgcaagtatttatatctgtncataggaggtaggatttctgtgttcaaagatcttctgtatttgtgacccctataattaacacgtaaaatgtcctatttatggaggtatcccgttgtgttttcccttcttaagatttggttagtcaaagcaatttttctataaatgataactctatcttggagataattagaaatgaaaaatggcataagggtatttatgtgtactgttgccataatttagaactcagacttaagtattatgtagttttacgatggcctttttaacccattcagtggagaatgtcagcttttctcgcaagttgtatgttaagtctattctaatatgtactcgaacatcaagttataaacatgtagataagaacatggacaagtaaagtttgagctcttattga

SEQ ID NO: 516243 - DNA, 792 bp, Homo sapiens
cgccgccgccgctgcctgggctgggccgaggatgcggcgcagctgcctcggcggccaggcttgctcccctccggcacgccgtgttaacttcccccgctatgtccccgttctgcccgccgggccgccccgtctccccggctgccgctcctgtggtcagggtcactccatgtgagctgccatggcagcgtgcctgaccgtggtgcccttcacgacggcttctgccctgctgctgcccagtgtctcccacgccatgcgcaccagcggcccacgggccctgcggcccatgtcgctcaggagcggagtcattgcgtgcaccgctcttgacctacgttgtgcctgctccatgcatgcgtgtgccctgcctggtgaccctgtggcctgatgtcctgtggccgaccgacagccgatccaccttgccctgccactgcttcacgcagtgcagcaagctaagctggcagcatgaactgacacacacacctggtgaggcatgctgcagtgcagcttggatagcagaagacagccagagagctagcgcgactagtatagcagccaaaattgcagccccatggagctatggggagatgcccactgccgagaagctgtaccaacaccaaccgaatagcagggactcggagacctgacgacttgattaacccagaccccgaagggcttggagaaagccccttacacacaacttgcatgcacgggcaaggacgtgtgccatggacgctgtctggagatcgaaggccaatccagtgaacagcctgcagaccctttgacaaggaccaggag

SEQ ID NO: 516244 - DNA, 197 bp, Homo sapiens
ccgggctctacggatttctgcgcttggcggcgcgctgttgcaagaccctgggctgtccatggaactggcacacttgcacagcacgctggcacagggcatacccgcgtcgcccttgttcgtcgagtcgcaatggctgacattgctcggccgcttgttcagcgaaacccgcatggtcaagcagcagttcgtcaaaggca

SEQ ID NO: 516245 - DNA, 325 bp, Homo sapiens
gtatgcattcttggagtcggggctgaactagctactttgctcagggagcaccatttttattggcaaggaactgatagacaaccacggatctacagatgtgggtatgtggcagacatttcctcaaaaatgaagtaaccctgtcacttcaagaaaaacaactcaggactggcggcaacagaaaacatgtacgctttcaagctgaacaagcgattacaataatccctatcccaactactggcctgtaaggctgggactcgcttcgggtactccaacccagaaaacactgcaacatacctgaacacagaagcatatatgagaacctagc

SEQ ID NO: 516246 - DNA, 259 bp, Homo sapiens
ttccaaggtacttcgcatgctatttgagctgtcagcccagcacaggacaacgtcttgttgatgcggatgacgtggaaggaagtggaagcaacaccgggatatggaagcatctttggcacagctttttaccattgtacttattgggaccaattcgggcaggctccagggcttcagaggacagctggtcaaattcatctgacacacatgtggccataaagcggaaactcattcacttttaccttccttccggcccaggtca

SEQ ID NO: 516247 - DNA, 109 bp, Homo sapiens
atctgttcatactgcaggtcatgctgctctcttctgccattagtattatgacatggatctctgtaacatcgctttgggaacaatgcatgtattacttatactttctctt

SEQ ID NO: 516248 - DNA, 381 bp, Homo sapiens
  misc_feature (144)..(144): n is a, c, g, or t
  misc_feature (149)..(149): n is a, c, g, or t
  misc_feature (160)..(161): n is a, c, g, or t
  misc_feature (168)..(168): n is a, c, g, or t
  misc_feature (170)..(170): n is a, c, g, or t
  misc_feature (316)..(316): n is a, c, g, or t
actctggttgtgcagcggtcagcagtacataaacgtactgtatgagaggcactgatgcacgcactgtctgagggcatagctcatgtctctgacatcctggtgtccaagatagcaaaagcagttgaatataatgtaacttatttnttaantgtggacaggnngacttgnanaatcactaagttatcacaaatgtggatgtgctagaattggatatgtccaggaacatgggaagggctcactattggaatcccatgagtctcccatttgtctctacccaaacgtattccaaagctgactgcatatgtaccatcttatntcttttggggattatacacctcagccgcctgagatgggggtcagctctttagacaaagggaaaca

SEQ ID NO: 516249 - DNA, 234 bp, Homo sapiens
  misc_feature (212)..(212): n is a, c, g, or t
  misc_feature (221)..(221): n is a, c, g, or t
taatttggtataagaaacgacatatccctaaatagtgcttatttaacttcattataaatacatctacttaacaaaaaaatatattttgtgatcttgaggtcacttcgtttaggtcattatctcaacccaacctccccaaactctggtttgagccaatatgtgttttattgttctcagagcaccagcaaactgtccaccaattgttgttatangaatgtatntagttttccaaaa

SEQ ID NO: 516250 - DNA, 344 bp, Homo sapiens
gcacgagggcaagtgtctgaaaataatctctttgcaaagttcaaagggcactttagaaaggccggctagttttttaaagaactcatttgaaatttaattatgtattggcaggaatcaaagatgcaaatgtaatgagattaatgagtgtccctttagataagaaaatttctgctgttgttgagttcactgctttgaaatacctgctagtggaaaggctttaggtttaaagtatgcatgttggttgtgtcgaatgcaattcaagaatgtgaaattgattggttccctctgtagcctcagatttagtgtcagttcttaagtcataagaattaaagaaccatgaactc

SEQ ID NO: 516251 - DNA, 323 bp, Homo sapiens
  misc_feature (12)..(12): n is a, c, g, or t
  misc_feature (19)..(19): n is a, c, g, or t
  misc_feature (31)..(31): n is a, c, g, or t
  misc_feature (95)..(95): n is a, c, g, or t
  misc_feature (132)..(132): n is a, c, g, or t
  misc_feature (225)..(225): n is a, c, g, or t
  misc_feature (263)..(263): n is a, c, g, or t
  misc_feature (293)..(293): n is a, c, g, or t
agaaaaagctcnggaagcnaaaaacgtggcnctaagtgactgtcatctaagtgttcatgaaaaggactcctgtttagagtatgagagctgaaacnaataagaaggcagagtgttgctctctctgacctcagntgaggatcatgcatgtcaggcaacacaaatttttcgccactgtgcccagcagacagactattttgggtcctgctctgctctctccccagctgnctgatctgggggagatgacttcagcttaggggctcagnttcctcatctgcataatcaaaagaataggntttacttttggatggatgttggggactttt

SEQ ID NO: 516252 - DNA, 105 bp, Homo sapiens
  misc_feature (2)..(2): n is a, c, g, or t
tncaaccccacgatcaccagccatggaaacgtcacagttcatccaatcaagcaatagcactgccaataatctcttgtaaaacgatgggtgatcgtggggttgtaa

SEQ ID NO: 516253 - DNA, 165 bp, Homo sapiens
cttatcagtgtcgacaattagttattatttaaaaaaaaaaaaaaaaaaaatgttaacactgaggtaaatcaattttcacatgattaccagtgtaacagaaaaatgcagttcgccctgatggtgctcatccaaatgttttaatagaaatacacaatctttcacttt

SEQ ID NO: 516254 - DNA, 357 bp, Homo sapiens
ttaaggcaaactacagcgcccggcctcttacaactacagaatcagattctacaagagaatggggccaggcaatctgcatactaatgcgctcctggggcaatgcatcagatgcgaagaagttgaggaaccaggtgcctggtccaggtcagcagagctacctacgataaatgctgaggtatcgtaatgtggagatgggaagctgaatgcaacccccacagcaggccaaaaccttgacctccatcgacaaagttgtatacatctagggccccaatactccattccagagccatgtgaactcaaagacaccttcaggctgtgaggtacagaactctctcaaaaggcgagcactccatgtgt

SEQ ID NO: 516255 - DNA, 282 bp, Homo sapiens
aaaaccccaagactgaccaaagagagatcagaaataaaacagacgacacgcagcgcttaacgtcaatcatttccaaaagcgcacttgccaagaactctaacccgctaagcggacagggcgggggcaaatacacacgatctcccgctggtcagggttttttaaaaaaaggcccagcaacttatttttcacctccctttttccattctagattttggcgaggtttcttgccccaaagccccagggggggctgcttccccctaagcaaatgcttctcaggcacgc

SEQ ID NO: 516256 - DNA, 765 bp, Homo sapiens
cggacgcgtgggctcggttcacatgatttgtcctagttttgtgtatatatgtgttaattagacatggcatgctaagaaggttgtttgtcataatgttgcatctgtctaatttgtcttctgaccaatatgtcgggaggcattttaagaaacaagcaggctggcacttttattctcttacaaatgatggaattttttgcacttgtacattcattttctctgattgagtttaatatcagtatgttaaactttattgccacatttaaaggactgtatttcatacttttttgcattttacctttcatctaccaatccatgtgcatggattgcacactaagatgtatttcttacgaaatagtctgtgtcatttttgaattatagaaattccaaagaacagcacatcagaatgctcctctctttcagtaatggtttagttcagagatcttcccgctcagcctccataaatctaatgtcatttttttttgaataagtcctaggagctgggcttcattcctccagcgggagtccagtcagggtcctgaagttggctggttcaggacacgaacggaaagagaaaagccttctgtgccaggctaaagctgtacatttcccacagtgtggatgcagtcaagaatccctgcacattctggtcataaggattagagtccaccagatgaggctctaaaagatcgatcccttggaattagaaagcagtggaaaaccgggcgcagtgactcacaccttgtgatcggcacttcggaatgccga

SEQ ID NO: 516257 - DNA, 304 bp, Homo sapiens
aactgtgttggatgccttcgagagtggtgcgacgccttcttgtgatgctttttgggaagcttttaatccccagcccttatccaaagtttgcagccgagtagggacttcttccctggcctttaccaaggaaaagattgctattggcgtactcaccttccacgtactccggggtcttttgggagttttctcccctaaccatttcaacttttttttggattcttgcttttgcatgccttccccgtcctttttcccttgccagttccctggtgacaggtaccagctttcctgaatggattcccggccc

SEQ ID NO: 516258 - DNA, 135 bp, Homo sapiens
acgcagtaagacgaggaggatgaaggccattcaactcctccccacgacactctgaagcagcgacggcacaacgggaagatgaaatgtttataggaggccttagctgggcactacaaagaaagtctgaaggctact

SEQ ID NO: 516259 - DNA, 351 bp, Homo sapiens
caatttctagaggaactttttctctgttaattcctggaactgtattttgaatccttaaaggtgagccctcatagggagatccaaagtcctgtggttaacgccttcatttatagatgaggcacctgaggcctggggatgtgaaccacctgctcacagtcctcatttactggatttgacttcagccaggtgacctggaatccttggggctcgaagccattggatttccatcgctatgtgaatgctcatacaacaacgtcacggaatgaacaccaccacctctcagtggtgcctccacttctaactatttatgtcaaagcccaatccatgtacagcacattcgctataagaata

SEQ ID NO: 516260 - DNA, 372 bp, Homo sapiens
gctgggggaagatgggaaccacagtggatatgagaggaaaccagcctgttaaaggaatgcaggagcctcccttgactgaaaacacagccacagcgtctggaaccccccctggcggcccattgtctacaccgtcggggatcctttttcctaaaacaaaatggggtatgtgttctgacactgaaatacgttttagaacccacagccaggcccgtgcagtccctcggtggcgtccagtcttttggaggtacagatgctcacacagtcatggctcaggtgttgcattgatttgataactcagccaaatatttatagttttaaatatatatataggtgttattaaaaatgggaaaatattaattttcttgtttaaaa

SEQ ID NO: 516261 - DNA, 1511 bp, Homo sapiens
  misc_feature (1345)..(1345): n is a, c, g, or t
gcgtatgtgttgttggtgctgctctggtttgtgtcacgcccagtgtcgtgggaatgcacaccagtttggggggagtagtggctgtcgttctagctacagtcgtgcgtgaggtcgggcacacaccctctttcgtttatcatgctcgcttggtggggagtttgcgtgcgtgcgacttgtcctcctgctcatcgcctcgcctcgtccactgtttcgtgatatgtctccttgtctccgctgtatgcagctccacgctgttagaccttgggggggatcccgtgttttgtccagccactatccccggttctgggcgccacttttggtatcgatatatatatgcaatacagggtttttaggagaacactcacacaggatgtccctatggtggatgtatggtttgttcttcccaaggaagtgtgttgtggtaactccgttggactgttatagttccgcccggtgttgttataagggaatcccgtcgtgtgaagaaaagtttgagttccccgtggtgggagctccacacgtagaagttgagccggtataagataaattaggggtttgaagttcctgttgtgtgcttgcgctcccccgtgatgttttgctctgggcgcctcctcttgcccccccctttaatgttgggagttatgtttgaggagagtaatagattctttagggggaaagatataatatttggggagcacctcgtctgttaatatttctctctggggggagctgcttataataaatatgttgttcttttaagagagactgttaaacctcgcgtctgtgaaagagggaggagataatgatccactgtgccctcgtttaggaacacccccaagcgccccccggggggcgcttgtgcagtgaacactctggcccctttataggaacggttttgtggagatatgcccgcagtatatacgcccggtggtgttttgcgccggtatctctctccgcgccatcttgttatagtcgcgcggggataccaccaaaaatggcctatttttgtttctggtccatacacctgtgttgttccaccccaggcattggagccccgctccccctctccagaccgcgcgtatcttgtcctccaggggacacctgcccctaggcgccccacacgccgagggcgctctccccaggggttggagaatattctgcccggacctcataagacccccacccctttaggtctcctcgcccctcatatatatagagagatttccctctctttcgcgggaagactctttgatataagagaatattctccacggaccgcatatagggatagttctctttctgtgggctctttctctccggcaccacgtctttacctgtgggggcntaaggggaaaccccaggaagagtatccgactccaaagaagtaaacccaccaccccggagtaactccacgttactcaagggatggaaggtttgaaggcctccattatattattccttttactgttgtacaatgatttgtgaaatgtttataataccaagccttttta

SEQ ID NO: 516262 - DNA, 651 bp, Homo sapiens
gttttcattttggtgacccggcccccgtccccttacaagggtcctctcccccctctctttggccctcccccgccttcccacttgggtggtcaccttcccccgcctaacgcgccctcattattttggcgcgttcttcgccacaaccgcctgacgcaaaatccgccatggtgtggcgccgaattgtcccccacctcctggtaacacaatcccgtttgtatcactcgcgcctcgaggaagtgttccatcaccctggcggctccccccaataggtttttatatgtgaacaccccccggcacgcccaattatattctcacgccccgcccttatttcaccacaatttatctggggtctttttattttacccccctccagcctccgagtatcttcgagtctcccctcacccatttccgacggcattttcggctcaacattttttgtaaccacccaggcgttccaccggaacttcaacgtcacttaattggctcacactttcctcacctaatctgcttcaatccccccacttattagtttcacccttacaatccccacaatcacctttggctttgaaagcccccccctgataactggccttttttaaaattggtttaatatttttttaatttccccttttttgatgagggtttttaaaa

SEQ ID NO: 516263 - DNA, 373 bp, Homo sapiens
ctgtgtggagtgagtgcccctctacctgtccaccagccatcgccccacatctggctgggaccaggagcctccctcatacaggggccagggctgggtgtgaagctgttttcaggactgctaaaggcaaggtgcagtatcccagcacttgtcatcatgtgtttccacctgcacctgtctgggagctgccttgctgcagagtgctgacatgacagggatccgcatctgtcctgggctgggtcaggccaggggaggagaggcagccctctgtcccacccctgggctcgctaacacgagatacccaagcccctcaggctgtgcccgcctggtctgggagccttgcctgtcctcgcctgggtgtccaagttggagggtc

SEQ ID NO: 516264 - DNA, 700 bp, Homo sapiens
tagatgggtaaaaggggtttatttgcgggggagccggaatttaataaaaagggccaaatcccatggaataatttgacttttaaaactcctcctttttttaaatttttttttcctttggtgcaacaggggcaaaaccaggagcaggggctgaaaagcctggggcagcaaaaacgggtacaggcccaccagggggtacactggcaagcttgccaaaaccctgggcaatgacgttttaaagggtttttccattcaggtcactgataaccttggtgagccggtcgtcgtccgccttgatacccacgctggccaagaactttttgaaggccttggccctgggggaggagttgccccctagggcagccagcaggttggaggggacgtaacgcattgggggggggtttgcaggggaaaagtctcacgcgtgcgacctcggagaaattttttctatatttttattttattatataatatttattatatttattttatttctactatttatatttactatacctatattttaataaatttaatatttattctcaccccacctccttattcattatacatttatactaaactttttctatctaattaatcttcttttaatctaatcttaaatacttattaaaatataatttagacatactttccttaattatatataatcttatatatttatatctaatttcccctcacg

SEQ ID NO: 516265 - DNA, 964 bp, Homo sapiens
  misc_feature (7)..(7): n is a, c, g, or t
  misc_feature (393)..(393): n is a, c, g, or t
  misc_feature (433)..(433): n is a, c, g, or t
aagggcnacaacggctggtaacccagatcgctactaccccgcagttcccgaacatgatcctctccgcctctcgagataagaccatcatcatgtggaaactgaccagggatgagaccaactatggaattccacagcgtgctctgcggggtaactcccactttgttagtgatgtggttatctcctcagatggccagtttgccctctcagctctgggatgaaccctgcgcctctggggtctcccaacgggcaccaccccgaggcgatttgtggcccataccaaggattgtgctgagtgtggccttctcctctgacaaccggcagattgtctctggatctcgagattataccctcaagctatggaataccctgggtgtgtgcacaatacactgtccnggatgagagccactcagagtgggtgtcttgtgtccgcttntcgccccacagcagcaaccctatcatcgtctcctgtggctgggaccagctggtcaaggtatggaacctggctaactgccagctgaagacccacccccttggccccaccggctatctgaacccggtgactgtctctcccgatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatccttgtagatgaactgaagcaagaagttatcagtaccagcagcaaggcagaaccacccccagtgcacctccctggcctggtctgctgatggccagactctgtttgctggctacacggacaacctggtgcgagtgtggcaggtgacccttggcacacgctagaagtttatggcagagctttaccaattaaaaaaaaactggctttt

SEQ ID NO: 516266 - DNA, 1020 bp, Homo sapiens
  misc_feature (7)..(7): n is a, c, g, or t
  misc_feature (393)..(393): n is a, c, g, or t
  misc_feature (433)..(433): n is a, c, g, or t
aagggcnacaacggctggtaacccagatcgctactaccccgcagttcccgaacatgatcctctccgcctctcgagataagaccatcatcatgtggaaactgaccagggatgagaccaactatggaattccacagcgtgctctgcggggtaactcccactttgttagtgatgtggttatctcctcagatggccagtttgccctctcagctctgggatgaaccctgcgcctctggggtctcccaacgggcaccaccccgaggcgatttgtggcccataccaaggattgtgctgagtgtggccttctcctctgacaaccggcagattgtctctggatctcgagattataccctcaagctatggaataccctgggtgtgtgcacaatacactgtccnggatgagagccactcagagtgggtgtcttgtgtccgcttntcgccccacagcagcaaccctatcatcgtctcctgtggctgggaccagctggtcaaggtatggaacctggctaactgccagctgaagacccacccccttggccccaccggctatctgaacccggtgactgtctctcccgatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatccttgtagatgaactgaagcaagaagttatcagtaccagcagcaaggcagaaccacccccagtgcacctccctggcctggtctgctgatggccagactctgtttgctggctacacggacaacctggtgcgagtgtggcaggtgacccttggcacacgctagaagtttatggcagagctttaccaattaaaaaaaaactggcttttctgaaaaaaagaaaaaataaactcgagcattcagctcggtcgagaagggatagccc

SEQ ID NO: 516267 - DNA, 1006 bp, Homo sapiens
  misc_feature (1006)..(1006): n is a, c, g, or t
ctactctaccatcttggcaggcacactcatcacagcgctaggctcgcactgatttttgacctgagtaggcctagaaataaacatactgagcttgtgattccagttctaagtcaaagaaataaaccgctcgttccacgagaagctgcgcatcagagtatttcctacactgcaagcaacctgcatccataatccttctaatagctatcctcttcaacaatatactctccggacaagtgaaccagtaaccaatattaccaatcaatactcatcatgaattaatcataatggctattgcaattaaaactaggaatagccccctttcatcttctgagtcccaggaggttacccaacggctacccctctgacatccggtcctgcggtcttctcacatgacaaaaactagcccccatctcaatcatataccaaatctctccctcactaaacgtaatgccttctcactcatctctctcaatcttgatctcatcataggcaggcgagttgaggtggaggttaaacgaaagccagttacgcagaatcttatgatatactgcctcgagattaccgcacataggatgaataataggagttctaccgtagaagcctaacataaaacattcttaatttaactatattatgttatcctaactactaacgcattcctactactcaaattaaggtccagcaccaagaccctactactatctcgctgctgtaaacagcttacatgactgacaccttatgcttccaccctcgtctcctaggaggctgccccgtaaacggtgttgccgaatggcatatcgagaatacaaaagttgctcatctcccaccatatgcactgactcctacttattactagctattatcaccaaaatcccttacaggaataagagtgggaaaaccctcccaagatctaagccgcttccttatttaagagaaaaaagggtccagggccaccagactatatcgccgggacttatcatatagataatatcccaccaagagagan

SEQ ID NO: 516268 - DNA, 410 bp, Homo sapiens
gtggggggggaggagaggagagctgagggaggggggggggggctagttaggcacacgccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatccttgtagatgaactgaagcaagaagttatcagtaccagcagcaaggcagaaccacccccagtgcacctccctggcctggtctgctgatggccagactctgtttgctggctacacggacaacctggtgcgagtgtggcaggtgacccttggcacacgctagaagtttatggcagagctttaccaattaaaaaaaaactggctttt

SEQ ID NO: 516269 - DNA, 236 bp, Homo sapiens
actacatacttccgagggaacgtgagctgtttctagaccgccgtgagacaggctagatttacggctactgatgatgtgaggcagccatggccctcctgctcattacgagaggaaccgcaggttcagacattaggagtatgagctaggctgaggagccaaaggggcgaagctaccatctgcgggaatatgactgaacgcctctaagtcagaatcccgcccaggcggaagtatgtatt

SEQ ID NO: 516270 - DNA, 188 bp, Homo sapiens
ttatttaaatgggttggttatgtaatcacagaggccagtatgtacagacaaagaaggaggagatcatcaagactttatccaagggaggaagagaccaagaaataaaacccccaatttggtctggtaatatgggcctcggtgattacatagatcagccattaaaattaaaacaaggccttatcggcggg

SEQ ID NO: 516271 - DNA, 200 bp, Homo sapiens
  misc_feature (66)..(66): n is a, c, g, or t
  misc_feature (184)..(184): n is a, c, g, or t
  misc_feature (196)..(196): n is a, c, g, or t
ctgggctaacacagtgagatcccgttcaaaaaatcttataaaaattagctgggcatgggggcgcanacctgtagtcccaactacttgggaggctgaggtgagagggtcacttgagcccagaggttgaggctgcagtgagctatgatcatgccactgcatcacagcctgagtaaaaaagcaagancctgtctcaaanaaaa

SEQ ID NO: 516272 - DNA, 270 bp, Homo sapiens
  misc_feature (42)..(42): n is a, c, g, or t
tttgctggggtgatctaacgatccggtaggcactgaagctangacgctcatgtgcacagtggccaggtctgtgcaaacacgcgtggtggcacggggataccccaggacgcgacatggatcccatctcacgggctcacgtgcgtaactgttgcagctgggataggcagaggcagaatacaggccaacctctggggcaaacctggccactaatcacctctggaaataaagttttatagccaggcgtggtggctctcgcctgtaatcccagca

SEQ ID NO: 516273 - DNA, 152 bp, Homo sapiens
  misc_feature (7)..(7): n is a, c, g, or t
  misc_feature (14)..(14): n is a, c, g, or t
  misc_feature (34)..(34): n is a, c, g, or t
atcgagntaagtgngacaccccagcaccagaagnctaccgatacttcagatattagtatttgcttggttgagcacagtctcaactaaaagtcaggtacacctgtcctcagaccatgggctttttgaaccttaatgcaggatttcactatcag

SEQ ID NO: 516274 - DNA, 113 bp, Homo sapiens
tgtgtgaccaggttacctgtggtcatgcagcatgcacctggcctgacccgcacctgtcacctgtctggcatgcgtgggtgatccgtctagaagtcgaccctgcatggcgatgc

SEQ ID NO: 516275 - DNA, 400 bp, Homo sapiens
ctagtcatctagaggatccctgcggatggggtctgtataagtataagtacaggtctatttctggagtaatgtcatttttttgctgacctgggtattctaggactgggtatctggttggttttatttgatatctgacctggatgtctttgtttccacttgaaagtggcatacagagagtcggtaaaaatagctatttaaggcaatcttttggtagcccaagtggttgctgctattggccattatgatgggaacgaggaacacaagtggtagaacaggtagggaggcagacacgagcagagcaggagagatccccatcccccaatgaggagtggcaggtgaccctcaggtaatgctcagcagttgttaagctgtctctttaaaacaataattggtcacagct

SEQ ID NO: 516276 - DNA, 1789 bp, Homo sapiens
  misc_feature (382)..(382): n is a, c, g, or t
cataaccgtcttgttttggttgggtccttcttgtccccgacatgtgatgtaccgacatacccactgtggtgggggtggcctcctcttataaccagcctgacttccttcgttgtgatgtgactcaccaccaggcgtttggttgttagtatatatctttcttgtgtcggagcgatctcgtttctctgctcttgttgatttacggcaactctgtctgttgtactgacatcatatgttggcttgatcagtgatcacggtctctatgatgggtgtgcgggtcatctcctgcgcccacccccctgtatgtggtgttacctccccttggtaacacaacaccctcgtggtggtgtgtgcgtctaagtcacattgtgagtttggggtgggngtgtcacatacaaacccacgctggcccctgggaggcgttgttatcaccatgggcccccaacggccgtccccaaaagtctgtggtgaaccccttgcccggggaataacctcgggccgtggatggggaaaaaacaagagggtgtccaccacgccagtgtgttgccccacgccgcgccggtgccacacgatgttcgttgtgcgatgaagagcgccccgcggagtcgtgttttgttggccgcccccccccagcatggtaacccacatagagcccagggggggcctaagtacccccacgacccgaatgtttactaccagcgggggcgatgcttggagaccacaccgtgccgcccctcgaataggcgctctcaccaccccccacacgcccaaggaaagattgtgttttgtgaaagttccccccctcagagagaaccacatctatgtatttggggctgattcgccccagttgtcgagggaccatctcctccccccgctccctcaatatggtccctccccgcgtgtatcacctcgttgtacaccggcgatttgctgctcccgccgcgacggcttgtgtttctcataggggcgcctcccgcgcagagtggccccacatcgcaagagtgagtgcttttgtgatatgaggcccacacataggggcttgtaaatatgtgttctcccactagcccccacatataccacgccacgcgcgtatatgtgttgtgtgtgtagagtggggattgtgcgctcccacaccccatatgtgtggagaataactacgcgcctctgtgttttgtgaaaaacttcgccacacctctcgggggggcgtttatataatatggtgtcccgcccacccttctgtcacatttgcgccacacacaggcacaccgggccactctcccacagcagagctctgtgtgtcacaagcgcgcacttttttcccagcgcacagttgtcacccgcgccacaagtgttccgcggcccacaaggcgctctgctctcgcacacttggtgaacacacgcgggcgaaggggcacttggaacgcaagaatggagatgttcacccgcagaggccgcagagagaggcacacacactcgagaaggacacctcggtgtgttctcgagagtgagaccacccacgtgataccacaggagatgccaccacacccgaaggaaggaagggcgagagtttcgaaggaaggaaggctgaaggaaggaaggtggcctatgagagccttcacagtcacactggggaaaagccacagggaaaccacactgtgaaactctttaattcacctcccacagcctgtcctgtggcctgtccccactgtgctgcaccttgctggtttcccctgtccaacacatccacatgctggatcccgagcaccaccccattaagcacattttcaataaa

SEQ ID NO: 516277 - DNA, 480 bp, Homo sapiens
aacccggacccctttgatgaggttgtttgcttttttcttgtaaatttaagttcctgttcattctggatattagccctttgtcagatgaatagattgcaaaaattttctcccattctgtaggttgcctgttcactctgatgatagtttcttttgttgtacagaacctctttattttaattagatcccatttgtcaattttggcttttgttgccattgcttttgatgttttagtcatgaagctttgcccatgcctatgtcctgaatggtattgcctaggttttcttctagggtttttatggttttaggtcttacatttaagtatttaatccatcttgagttaatttttgtgcaaggtgtaaggatggggtccagtttcagttttctgcatatggctagccagttttcccaactggctgtgacatctgtcacccattgatctccaaggttgatttgggcaatctggctcgctaggcgggtgtc

SEQ ID NO: 516278 - DNA, 804 bp, Homo sapiens
aactaatctccagttttttcttctttttggcttactatactttattggtattaatacaggcaatctccataagcaccaagctaacattttacccctacaccagagaaaccaagtccaaagaattatatattaatggcaagagataaaccccgaatggcttccacttcccacctcactagtcctctataacaaaaacatactaccatactttggacaatttggcttataattgggttaacatcatttgatattgacacccagggtggatattttaatcccaacttctatttctccatgggaaaaagctctcttcatcacaaggtgggttgagtttcccggacatcaaaccatccatttcccacagggggggttattggagagaacacccatccagggtatacgggccggtctgtattattatattccctttgtaaacgcaacggggtccccagtatatcatggttatggtctccaaagtaggccctccccaaacaaggccacaccaataagcttttgcaagtgtgagttgacttcccacagtcttcaatggccaatggctttttaatatagaggtatcctaccaaaaccttaattctggcaccatctgtggagaaatcttgaaattgcaatgtcccaataccaccaaactcgtgaaatagtccggaggaacgcgacccgaacggaaccccccaaaggcgccgagaggcccaaaacttccctccccaggaccgtacccccgataacccccccagagacaccaggcgagggggactaccccacgcacaagcacccaactccacgctc

SEQ ID NO: 516279 - DNA, 258 bp, Homo sapiens
  misc_feature (30)..(30): n is a, c, g, or t
  misc_feature (91)..(91): n is a, c, g, or t
  misc_feature (115)..(115): n is a, c, g, or t
  misc_feature (160)..(160): n is a, c, g, or t
  misc_feature (171)..(171): n is a, c, g, or t
  misc_feature (216)..(216): n is a, c, g, or t
  misc_feature (225)..(225): n is a, c, g, or t
cttccaggcccggaagcatcggcccaagcngcacctggacagcaagatgctggctgcctggaatggcttgatggtgtcaggctatgctgtnactggggctgtcctgggccaaganaggctgatcaactatgccaccaatggtgccaagttcctgaagcgngcacatgtttnatgtggccagtggcgccttgatgcggacctgctacaccggccctngggggactntggagcacagcaacccaccctgctggggcttcc

SEQ ID NO: 516280 - DNA, 189 bp, Homo sapiens
ggcattcacactgtgtgagatgctggtgactcatactagtcatgagatatctacgtcacaggctgtctgcgttatcatacacattctccgctagcgtgataggatgatacacgactaaggatacctgctgatgcagatgcgaacatcttcagaggaccgccacaatccatgatacgccagatacaggcg

SEQ ID NO: 516281 - DNA, 2331 bp, Homo sapiens
ttttaaaatatgtaaatttgttaaattagcatgcagaatatggcagtaatacccaattgaaacactagttggttgtatattaaatctaataataggaaatatgaatttgcctttaaaatgtatttcatttcacttctatttatctaagaagacccgggcatacacaacagtggtttttaaaaatttaccgtcaacttgaagtattttcctttctcttccatgaagagcagtaacattttttctcttttcttatttttagtaacttttatcttcctgacttccatagccagcatcttattttcttcttggtgtcctttttcccttatcaaatgtaaccaggatctttattatagtggaaatggggccagttgatgaagtctaatatgaaacgaatattttaactttcaaatgcagaagagctaagttgcaaagatagcagaactgtccaatctgtctaccttcacagcagtgcttcttacatttaagaagcagtctgttgaagaccagttttgttttttaaaaaaatgttcaattcctcaccaaaaatacataaaaacatacaatccgattattttattaggttaattgacataaaaatagtcatttttccatgaaagtttctaaatatttactttcagtttgtataattacctcatggtggactggtagtgaagtttgtggtctggcactgatatgtagaccatactttgggtagcattgctctagattttctagcaaatcaggaaagccaaggatgttgagctcttgtttacataaccagattgaaagctcttcaaaagcaggtccatatgctgttcatcttatttgaaggattgggacagggcctgatacatagtaggcaggtggtgaaaactataacttaggccacagactataagctgataataagtgggatcataaagctgaatgggctagtacaaattctgcgagtattccaaaatatgaattgtgaaatattaatagtaatttaggagggtttccatatcagagtatcatctttttctttgctttaaaaaatgtctgataaagtgtattcagtcctgaatgtcaattgagaactggctctcatcactggctttcataataatgttaaacattttgctctattttaagaaaataggctgggtgtggtggctcatgcctataatcccagcactttggaaggccaaggctggcagatcatctgaggtcaggagctcgagaccagcctggccaacacaatgaaaccctatctctactaaaaatacaaaaattagccgggcgtggtggcgtgtgcctgtgatcccagctacttgggaggctgaggcaggagaactgcttgaacccaggaggcagaggttgcagtgagccaagattgtgccactgcactcctgcctgggtgacacagtgagactccctctcagaaaaaaaaaaagaaaacaaaagccgcttggtgccaaacatagtctataggggaaaataaaatttaagagatttagtaaggttgaaccatttgaaattagcatacttgtgagtccaaaacagttgaatactgttgtatttatatggctcaacctacagatatagcaatatggaatgtaattacttgggggcacatgcagctcatatagcaaattctctttgcttaattttagggaaattgaagcccagagaatacatttgaaacagtaaaaccatactataattaattgtacagtaaatcacatttcacaaatttactgaaggtgaaaagaaaggacaaaatcagtttgcttttctttttggactatatctacttagagttttggaccattttccttttcttgatggaggggagggagggagggtatcactctgttgctgggctggagtcccatggtataattttggctcactgcagccttggccttctgggctcaagtgatcctcctacctcagcctttccagtagttgtcaccacaggtgcatgccaccatgcctggctcattttttgtattttttatatagttgagatttctccatgttgcccaggctggtttcaaattcctgagctcaagcagtccatttgcctataatcccagcactttggaaggccaaggctggcagatcatctgaggtcaggagttcgagaccagcctggccaacacaatgaaaccctatctctactaaaaatacaaaaattagccgggcgtggtggcgtgtgcctgtgatcccagctacttgggaggctgaggcaggagaactgcttgaacccaggaggcagaggttgcagtgagccaagattgtgccactgcactcctgcctgggtgacacagtgagactccctctcag

SEQ ID NO: 516282 - DNA, 768 bp, Homo sapiens
ctgaggtgggagaatgtatgaacctgggaggcagaggtagcagtgaactgagatcacaccactgtactccagttgaggcgacagagtgagacccagtctcaaaaaaaaaaaaaaagtgtgtgtgtgtgtatatataatctatatgtttgtacacacacgacacactttccaataccagtcggaataaacccgcccttagggttgcttgggcttgggatctcgagcccccatatcatttctgggtaacgagagcacagcaatagaaatttctggggaagcagacctggtgaatcgtgcctgtgtcttaattcacaaggggtaagtgaatgccgttgaagggtgtttcatacacttacgccagaaaatgagagcctgtctcatgcaggagtcgggaggcagcgatgtcagggaacggggacatatgtctttatgactgtgatggtggtaaccaagtggggtggtcccctcgtggggagctgagtaagaacgcaaaggttggggtcaggattaggaagactataatatgacttgtgtgcatgcccgggaagggtctgctttgtaaagaggatgtgagcagtttagtcgctcatgtggcccgtgttgattcaggcttatggaggcgttaaaaaataagccggtgtcaaatggcctagacttggtaaacgcccattgtgtggtaggtggaaattctgaatgggttcctttctggagacctggtacttctaagaaggtttgaagaaaggaattgtcttaaaattgacctgttat

SEQ ID NO: 516283 - DNA, 124 bp, Homo sapiens
gatggcgaggcaggacactgacggatttgcttaggagccagagtagctgccgccaccagagctcggagccatgagcagggtttaattttggcaggcactggggcccctacatggcgggttcacg

SEQ ID NO: 516284 - DNA, 128 bp, Homo sapiens
ctgaggtcaccattttacagaggttctgactgctgtctgcttacttggagcgtcgatgattcacaaagcttccagaacttaagcaactggtagaaagatgtcatatattatgcagatgtgaaagagcc

SEQ ID NO: 516285 - DNA, 359 bp, Homo sapiens
  misc_feature (119)..(119): n is a, c, g, or t
ggatgtttttgcgttcgtttaaagcgcgcagccggccaacgacatggcgatggccagcacaacgctcctatgtagggacgaagtcattgtctactcctggattattgagcgcgctggcnggattcagtaacgcgaagtacgcggttttccgtgtacagcactactttcaggtttacgtctgaagtcgaaagggaaaggaaaagtaatttcaccgcacttttaaagtcgctgtttaacgacgcgctaactgttactggaacatccactgacgcatcccacgaaagttgccaaccttctttggtagcccacttaaccaagacacgccgcagcgtcacatcactaagcgacacaacccacgg

SEQ ID NO: 516286 - DNA, 714 bp, Homo sapiens
gtgctctgctcgtgctgcacccacgcctcgctgcgcccgcttcctgccctcaacctgggcatgctgcccagaagccttgcttcctgacaacaagtgcatacgaggactacatatgctagaccaaatagcagcactgtagacgacacatcagggacccacgaacgtgcatgcacgaccatagcgcttgacgacatgagcaagactgcaggcaaaacatagactacgaaaactgaggagatgccagcggcctccgagaaacagaagccacagggtcacacaatacagagagaaccattgaatacgacccatgagaggactatcgagagataagtacgaagcacacagacgatatggataccatacacgaaaatacgatacacataggacaaaagtaggtagacgacatcaatggagactcagatgagacagaggagcacacaccgaattgcaacacacaacggagcacaaagaaccaggagttacgagacacacgaaggagatatcacgagaggaaacataaacgcgagaccacataacacgacaacacagcacaagaccaagtagcagatagcgcacacaattaaggagaggcaggaaaacggggcaccagaacgaaagacacaagacaatagcagaaataacacccacacagaaaaaaagccaaccagggaacagaggacacaatgccgacgaatacataagagataacacaag

SEQ ID NO: 516287 - DNA, 459 bp, Homo sapiens
caacagaacaggaagcaacagcctgggctccagaattgaccagtagtccgtgcacagacgaggagaggtcccatgaaacttcggcgcagtctgggaaccgagctctttttgtaacaagttgtttgtcaggaggcccggtcatgaaagcccttcctgactgggctcaaggaatacaaaaaggacaacttgtttttgccattgtctgttgtttttcaataactagttctccgaaacagcactggatgaatgcctcaaggggctcacacaactcgttccaggacttagtgaccattgtttctgtccctgttcaatagagttcaaatttaatatttaaattttgctccacaatgtgccatattatctgtatccaacctgtcattgggcatttaggttgattccatgtctttactattgtgaataatgctgcaataaacatttacgtgcttgtgtctttaaaaa

SEQ ID NO: 516288 - DNA, 174 bp, Homo sapiens
acaacgaagacaacatgtcttcaagacaattacattggcaatgtgtaaatgtttaaacagttcagtgatctttgctgcattgctttatgtgtgggtttctctctcccctcccttggtcttgtttcttacatgcaggaacagctcagcatgacacacgtatgcgtggccagaagg

SEQ ID NO: 516289 - DNA, 461 bp, Homo sapiens
  misc_feature (160)..(160): n is a, c, g, or t
  misc_feature (408)..(408): n is a, c, g, or t
  misc_feature (448)..(448): n is a, c, g, or t
tgatcctcactcaaggtctggcccccagacccaaacctcagggaaactgggcttgttggggtgaaagccctgaaacctctggctctccatactcgcccgtgttggacacccgcaatgttctgacgagctttcaatctgcttcaatcggtccttgtccacnttcctgcttggtgaggacgaagaagaggataccacaggggagaccgatggcccaggctaccccacggctttcatggggttcttgcccctctttctgggaatgtattctagctcaggggagaggggctcgggctcctccttgcattctggtgagctgtggctctgcagtgctctggtcctgttctgggaagccttgttagctgtggctccagagaggatcccccggaggacgcgggcatttctcgccgncccggcccttcagcgccgtagcagctaccgaccgccgccnatgttcggctagt

SEQ ID NO: 516290 - DNA, 1231 bp, Homo sapiens
tagggttcgaggggggaaggcgggaaatgggaaggggtatggagacttttcctataagtaagtgctgaggggtggaggtgggtaggaagttttttctcatagggagggtgcatagtgaaggtgggctcgtaggcggaactgcgggggaatagtgcgtggtccgaaattcataagaacacgaggggaggttagaaagatagggtctggggtgaccacaaattgtgtgtgggtggtagaagtttcgagggggagagaatgtgcggttcccattgtgtgtgtggttcctctgagagaaagaatgtggtagagtggggagagaggggtggtatatatatatcaatagagtggtggggtgaatatctcgggcttcattgcaagaaaaataggggggcagagagagagggcaccgagcggagaggatatctccgagagctggtatagaaccgcctttagaagcacatagagtgagcgagcggacctccctcacttctcgcgagcacaagtgggggcacgacaggggaggggtcacggggggctggggtccctcaggggcacaacggggggggggaagagacaaaaaatatcacatatattaagtgggcgcccaaaaggggggcacaccgaagaaggtggggcacagaagaggcataaacccaaaagaggggcgggcgcccccacggagaggtgccgagagacaacagcggggccgcggaaaaacggggtacacaaagaggggacgcccccacatataactacaaagacacaagcgggtcagagaaatagcagccaaaccaccagacgagcggggccgccacagagggacagacgagcaatctccatcatatgcgacacaaaccccgggcagcgggggcgccataacatatagcactcccgaccacggtggcgcgcccgaacacaaggggacacaggaaacagcagagacgacacacagagagagagcacaccaccccttaagaatccaagaaagagaatttagcacgcaaaacagcgacaaacgacgcgcaaagacagggggtcgacatacacaaataacacacaacgcaagcgccccaaacgtcatgcaaaggttcgcccccacaggacagacacggcaacaaacatgctgaacacgacgacgagccaacaccgctgaccaacacaccaaagccacactacgctcaccacgcaccacgcaccggcgtcggccgagccaagcaaccaacgccgtgac

SEQ ID NO: 516291 - DNA, 175 bp, Homo sapiens
ctcagagccagagtgcctgaggtctgcttgagaacctgccccctggatcttggacacttacagagtgagctgtatgaattcagcgggtctcacgtccagagggtcagaacgtttgctttaggttttttcatctgtttgttccttgagtcagtgctattgaaacttctaaaactag

SEQ ID NO: 516292 - DNA, 658 bp, Homo sapiens
  misc_feature (142)..(142): n is a, c, g, or t
atgcaaaaaggaggcgagcagactagctggctgctagccaaacaagcaaggcagagaagcacgcagccaatcaatagctagagtagggccaggtcggcacggtaggggaggtagggaggttatgcacgcaacgcacgacccnactacgaccacgactgagcgcagtaacgtaccactatctactacgacgtacccagctagccaggcaggcacgaagaactaacttctgcgtcgctcctatataggaagtcagcagaaggacgacttctggctcagcaagcgtaggaagaaggagcggcggtgggagtagcagcaacagcatcagcgcagcagcagcagcaccacagcagtagtagcaccaacacacgacagcagcgcggagagaagcgcgcccagcagcaggagcgcttccactccactactaaggtcacgcacacacgcgccacatcacacacgtcgcagcgcagagagaagcatagaagagagcagatcgtcccacgtgagaggtgagagagagagagaaagaagagcgagaggggagaaaggagagggggagagagagagggagcagaggcatctccagcagagagcagaagaagacagagataaaacagaagagacacccacccgcaagcccgcccacaacaaagaacaggaa

SEQ ID NO: 516293 - DNA, 333 bp, Homo sapiens
  misc_feature (41)..(41): n is a, c, g, or t
cttcatgtagagatatactcaccaatcatatggtgcccacnaaagggtggcatttcttggatctaaaatagaagtccatctttactaacctgctttttgacggtcatacacttagcaaggggtatggccataattgaaacccagacaaacgggataggtggagctttaacacctactttatgtagctgttctgtttattaaaattcagtgtaaaaagtgcaaaataaagaggtaatacacaatgagatcaaaacctaaaatattgggagaggaaggtgttacagaagctttctgcaagaggtaataaactgatttttaaatgatatctggtag

SEQ ID NO: 516294 - DNA, 766 bp, Homo sapiens
  misc_feature (13)..(13): n is a, c, g, or t
  misc_feature (61)..(61): n is a, c, g, or t
  misc_feature (72)..(72): n is a, c, g, or t
  misc_feature (82)..(82): n is a, c, g, or t
  misc_feature (94)..(94): n is a, c, g, or t
  misc_feature (133)..(133): n is a, c, g, or t
  misc_feature (139)..(139): n is a, c, g, or t
  misc_feature (161)..(161): n is a, c, g, or t
  misc_feature (166)..(166): n is a, c, g, or t
  misc_feature (176)..(176): n is a, c, g, or t
  misc_feature (209)..(209): n is a, c, g, or t
  misc_feature (220)..(220): n is a, c, g, or t
  misc_feature (236)..(236): n is a, c, g, or t
  misc_feature (242)..(242): n is a, c, g, or t
  misc_feature (254)..(254): n is a, c, g, or t
  misc_feature (277)..(278): n is a, c, g, or t
  misc_feature (302)..(302): n is a, c, g, or t
  misc_feature (333)..(333): n is a, c, g, or t
  misc_feature (336)..(336): n is a, c, g, or t
  misc_feature (390)..(390): n is a, c, g, or t
  misc_feature (415)..(415): n is a, c, g, or t
  misc_feature (460)..(460): n is a, c, g, or t
  misc_feature (479)..(479): n is a, c, g, or t
  misc_feature (499)..(499): n is a, c, g, or t
  misc_feature (501)..(502): n is a, c, g, or t
  misc_feature (536)..(537): n is a, c, g, or t
  misc_feature (540)..(540): n is a, c, g, or t
  misc_feature (547)..(548): n is a, c, g, or t
  misc_feature (550)..(550): n is a, c, g, or t
  misc_feature (572)..(572): n is a, c, g, or t
  misc_feature (574)..(574): n is a, c, g, or t
  misc_feature (577)..(578): n is a, c, g, or t
  misc_feature (620)..(620): n is a, c, g, or t
  misc_feature (633)..(633): n is a, c, g, or t
  misc_feature (635)..(635): n is a, c, g, or t
  misc_feature (649)..(649): n is a, c, g, or t
  misc_feature (652)..(652): n is a, c, g, or t
  misc_feature (656)..(656): n is a, c, g, or t
  misc_feature (658)..(658): n is a, c, g, or t
  misc_feature (660)..(661): n is a, c, g, or t
  misc_feature (666)..(667): n is a, c, g, or t
  misc_feature (681)..(681): n is a, c, g, or t
  misc_feature (726)..(726): n is a, c, g, or t
ctgggcagttccntccccagaaggagagattcccccgccatggagtcccacgatgtgatcnccaaccagccngtcgtgatcnacaacggatccngtgtgattaaagccggttttgccggtgatcagatccccnaatacngctttccaaaccatgtgggccnacccnagcacgttcntgtcatggcaggagcccctgaaggcgacatccncattggccccnaagccgaggagcaccnagggcngctttcaatccnccatcccatggagcatggcatcnncaaggattggaacgacatggaacncatttggcaatatgtctattccaaggaccanccncagactttcccagaggagcatcccgtgcccccgactgaggcgcctttaaacccncgaaaaaacccggaacgagctgccnaagttttcctcgagacccccaatgtgcccccccttttcacccccntgcaagctgtactcagccnttacgctacaggcaggaccncnngggtggtgctggattctggggatggagtcacccnngcngtgcccnncnatgagggctttgccatgccccncnccnncatgcgcatcgacatcgcgggccgggacgtctctcgcttccngcgcccccacccncntaaggagggctacnacntccncncnnccccnnagtttgagattgtnaaggccataaaagaaagagcctgttacctatccataaaccccccnaaggatgagacgctagagacagagaaagctcagtactacc

SEQ ID NO: 516295 - DNA, 212 bp, Homo sapiens
atctagaggatccctacgtaatatgtaaccgatttcagtataactaaatattggtcatgaactgtgtaagggcatgcttattgggatcagttttaaagttaattcttttgatattaataccagaccatagacatattctgtttcctggaaaaaaaaaatgaatcatgtaaggctttaggtgagagtagattttttacagagtagctatagtc

SEQ ID NO: 516296 - DNA, 193 bp, Homo sapiens
gtctactcgagtggcgcgctttgtgcctgtggtcaacatagcgtcccacctgtaacagctgcccgtggtgatggcgcctgggttctgcctgtgatcccagagcatggtgccggggtcagctgggatcttctgccaccatcagggacaaaccgggggcagggggaaagtcactgatgcccagctgtttgcatcc

SEQ ID NO: 516297 - DNA, 100 bp, Homo sapiens
aagaggcgagaacgacccccggaaccggaccaaagccccgcgcgccgttgaattcccggggtccagaaccttacgttcccgtttgccgttggccgccgcc

SEQ ID NO: 516298 - DNA, 115 bp, Homo sapiens
  misc_feature (33)..(33): n is a, c, g, or t
  misc_feature (72)..(73): n is a, c, g, or t
ggaagaaccatttacttttctggggagtcctgngcggtgttcattaacgctagttcatagtaaaagcccaannagatgctacggcactgttcttgttgacaacaaatagtaaagt

SEQ ID NO: 516299 - DNA, 1002 bp, Homo sapiens
gcttggatttgacattgataacgtgctattgaattaatagaacatttggattcaggtgatctggccagatttcctgcaagctggtattcgggtacctgtctccatccatgatggtcatcagcacaccaaactctgaattcaatcccctgctttccatcagtgaccttaagagattcagatcataaatttgacgtggaccacgaatggcagctttcagacctgggctttatatgtggcaaatcgctatgattactctgctggagctttactggtgtcggggaaaccaccagctggagctgagaatgtcggatactgtacccagataggaatcttccggaaacatggagcgcaaggcaacagaatcatgtctttcagaccagcatgatcagcatgctcataaacgctcgtcacacccaccctcatacccaagctcacagccaggacaagggttctcaccacctagcgctaggctcaaccgacgcgtgctcccacacaagctgcgacacgcctaaagcagtgaagccaaccctgccacaagggcggaacagacacaggcctgccgcaccgggcggcggctaacgacccaacgacaccggccggcccacacggcccctagacccactgcctccgcaccacgacaccacagacggccgacacccgcccaagatacgacgaacctacccccacaacacccgaactggcgccgccacgctcaccaactcgccgaaacccctagcacacgagcaaacccatcagaaacccccacgataggcagcacggttaactgtcgcacaccgtggcccacagcaagaaggcgccacacgcacatagccagacccaacacgtccactggcacagcaagcagttcgacacgacaccgcacgaccggagaaagaaaacgagaacaacacacagcacctacaccactcgacacaccgaaaaccacggccccacagacacacaggaccacaaacacaaacgccaagcgcaagaccacacacg

SEQ ID NO: 516300 - DNA, 807 bp, Homo sapiens
  misc_feature (31)..(31): n is a, c, g, or t
  misc_feature (63)..(63): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (111)..(111): n is a, c, g, or t
  misc_feature (116)..(116): n is a, c, g, or t
  misc_feature (141)..(141): n is a, c, g, or t
  misc_feature (145)..(145): n is a, c, g, or t
  misc_feature (151)..(151): n is a, c, g, or t
  misc_feature (161)..(162): n is a, c, g, or t
  misc_feature (204)..(204): n is a, c, g, or t
  misc_feature (207)..(208): n is a, c, g, or t
  misc_feature (222)..(222): n is a, c, g, or t
  misc_feature (224)..(224): n is a, c, g, or t
  misc_feature (228)..(229): n is a, c, g, or t
  misc_feature (237)..(237): n is a, c, g, or t
  misc_feature (239)..(240): n is a, c, g, or t
  misc_feature (251)..(251): n is a, c, g, or t
  misc_feature (258)..(258): n is a, c, g, or t
  misc_feature (266)..(266): n is a, c, g, or t
  misc_feature (268)..(268): n is a, c, g, or t
  misc_feature (273)..(273): n is a, c, g, or t
  misc_feature (275)..(275): n is a, c, g, or t
  misc_feature (281)..(281): n is a, c, g, or t
  misc_feature (289)..(289): n is a, c, g, or t
  misc_feature (292)..(292): n is a, c, g, or t
  misc_feature (319)..(319): n is a, c, g, or t
  misc_feature (366)..(366): n is a, c, g, or t
  misc_feature (375)..(375): n is a, c, g, or t
  misc_feature (381)..(381): n is a, c, g, or t
  misc_feature (398)..(398): n is a, c, g, or t
  misc_feature (439)..(439): n is a, c, g, or t
  misc_feature (480)..(480): n is a, c, g, or t
  misc_feature (492)..(492): n is a, c, g, or t
  misc_feature (536)..(536): n is a, c, g, or t
  misc_feature (540)..(540): n is a, c, g, or t
  misc_feature (570)..(570): n is a, c, g, or t
  misc_feature (596)..(596): n is a, c, g, or t
  misc_feature (640)..(640): n is a, c, g, or t
  misc_feature (694)..(694): n is a, c, g, or t
  misc_feature (717)..(717): n is a, c, g, or t
  misc_feature (723)..(723): n is a, c, g, or t
  misc_feature (730)..(730): n is a, c, g, or t
  misc_feature (798)..(798): n is a, c, g, or t
gtcgagtatgttgggcctcctctctttcccnggagggctgaggtattggcaacagtcagtcgnccantgntgngggggcttgggacccagcagaagtcaagggtcattagngcccngcagcggcagggatagcctcacttngggngggganggggtagcgnngcggggcaggacagggcctagggaaagagggagggtgcgggngcnntcctgggtgcagtngnttcnngtttgtcngnnggcaggaaatnggagctnacggagtntngggcnanaggttntcttttanatngggcataggatcagggagctgggagcntcactagccactgataacttccaggcgtccacccgggtgacagaaanggcgcaganatggantgtgttaggttcagggntagccaggcaggcccctccttttctccccgcagagcgtgcnggggggaggccgccgtgggttggtgctcgcggtgcctggcnctctcttcactntgccgttgcttggtcactcggccccatcttcggtgcggtatgtntcgnagggaggaagaagggcagccggtgctggcncgcacaaaatcacttctagccacccnagaaaggctggtgctcgcaactgtgagtgtcttggtcaatgggngctgaaggggcagccccagcccagaaaagcccgccccacatgtggcctatgagntcccacaaatggcggtggggagngtgccnacacaangtttgggagggggcactctcggtttggctaatgactccaaaacaggggcaaatgggggccaatacganggagaaacc

SEQ ID NO: 516301 - DNA, 110 bp, Homo sapiens
cccaccttactgccgtgggcccaccttatgccgggctggtagactgggaacgccgactacggatcactttgtggatgggcgcgaagagaccaaacttgggtgggcactgg

SEQ ID NO: 516302 - DNA, 135 bp, Homo sapiens
cacgtggccgaagggtgcacttcgcattcccgggcgatgtcgctgatccggtcgaccatgatccggtcactctgctgactcatgtagctggcgatacgcttgagctggcgcggcaggctctcgtattcgtcggtg

SEQ ID NO: 516303 - DNA, 218 bp, Homo sapiens
gcgacgttagaggatcccaaataatactggtttggagaattagtacagatggtcataagatgccgcataaagtccgtaggattcggtacaggtatttccaaatggtcgataggtaatgcacagcagcttgacgtggtcacaaatcaggtgccatgatggcgtgggccacatggaatgatgccatgacgtcttgacgaacacttcggtacgcgagctct

SEQ ID NO: 516304 - DNA, 124 bp, Homo sapiens
agggccacgccatcctcgcagccagaagcctgtgattgctgaatcaggatcagggaccctcccccccaagagctcctgagccccctgcccccagagcaataaagtccgcgggctttctcaaaaa

SEQ ID NO: 516305 - DNA, 351 bp, Homo sapiens
  misc_feature (334)..(334): n is a, c, g, or t
agactgcttagtatgctaatgtgaacacaaaatatctgagacaggtctcagtcaatttaggaaagtttattttaccaaagttaaagatgcacccatgacacagcctcaggaagtcctgagacatgtgccccacggtggttgggggtacagtttgcttttatgtatttcagggagacatgagacatcaatcaatatgtgtaagatgtacattggtttagtccagtaaggcagcaacaacttcaaagtgggggtttccacgttagacatagataggagacaaaaggtggccttcttttgatcagccttccactggattacacattgtagtctgggnttgagtgtgggagccct

SEQ ID NO: 516306 - DNA, 1012 bp, Homo sapiens
  misc_feature (780)..(780): n is a, c, g, or t
  misc_feature (1012)..(1012): n is a, c, g, or t
aggctgagacaggcgaattgcttgaacctgggaggcagaggttgcagtgagctgagactgtgccattgcactccagtcgggttaacagagcaagacactgtctcaaaaaaaaaaaaaaaacatttttcacccatactaattgttcccaagataagggtgacttcatgagggaaaatgtcccttttattttgtcattaccattttccaaaagggggcttgggtgctttgccaccattaacatgttggacaacccgcggttattgtttacctcgtaattgtcaagttttcaacagaagatacggggctattttggaacatgtggcacccttattatattatttgcttgaaatatcctgtttaagaattattggcagattgagcgatttggttttcctccaattttctctgggtcgccgattttcgaagttgttaccctttggagcattccgagcttttagacgagaattatattaaggccacccttgggcgtgttcaccctttgaatttgccttatactggacgatgttgtccatggtttggacttggagtttgaccaccagaaaagtttcacgacacgatggcgtccacaagaaatgctccaggtttcaccaatttctttccaaagctcttatagggcacagtgttttccaaattgggtgctccttaaatttggatcaacgtgggcgcttaatccattctggaaaaactccaggatacacagggtttaattacatacgacattggggggggtctctccagttaaagaagagattggttaanaaacgttttggtgccccttttgctgggtgtgtgttcgttactggcaacttttcgtcttaaaccaaaacttcgtttttggggacgaaacggtttaaaacactaaggtttacaaaggtacggggttgaaaaaacctgtgacggtggtctttcaactctaaaaggattaaacgccctgtggttttttatcccaatattctttttgggcggggtcaaaatactgtccttctctcan

SEQ ID NO: 516307 - DNA, 551 bp, Homo sapiens
  misc_feature (76)..(76): n is a, c, g, or t
aagctgaacactattggctgcttgtgtgctgattacatcactgacagtgtttcaagctttggagaaagcatttaanaacatagtcaaatcagctgatttatcagcggattaatcactcatctgcaaggttccagtggatagatacacagagagtttttaatttttgtaattgtataactctttgaaataaaactaacaaataacaccctgccgttttctaactatcagtttatttctttctgacattgtaattttttttattacaaaacagtaaagaactgagcatttctgccttaaatacccatattggttaaagggcacctaggttaccccttttttcagatttaatataagtcttttgcgtctctagaatgtgtatataaagtttcagatcaaaatacccatcagatttttcattataccttttacaagatgctgttttatactgatttccagcagggggtggttttgtcttagttaaggctaacctcaagtactgtgtggatatctgttatgctaatgtacaaaataaacctgatttaacttccaca

SEQ ID NO: 516308 - DNA, 1095 bp, Homo sapiens
gcggcgagccaggcgctaaaccagccgctactagcgccccgcgccctagctatagcccccatataataccagcctatagccccggcgccctagacctagacgccctaggcctagacgccctagctatacgtacgcctaccttatactactacccaggtagctaggaccagggactagagcgtacccccggcacgagggtaccggtagtagaccaccgaacacacgaacgcacgacaacatgggcgacacgaaaccatggacatcatttccaacgccatcaccatgacatgaatgaacggccccacggcacatgatcatagggacacgcataggacttcaatcgacgaccatatctcggaacccatcccgacacgggaccaccgacacgaagtgaaactccggccaatcgaacggccagcatactgacactgcggtgcacaagcgaccatctacaccgacaccgcgacacaccgccatcacacacggaaccgcgcgacctgcctatgaccatatctcccagaacccacccatggcccccccactaaccttagcaccaccgggaaacggaaacgcgcgaaccgtaggcgcgaccccccggcacctaagcgccccttagtccctcaacgaccgcccctaaaacccctgacgagcctaggccctacgtaggcttacgcacaataattaaactggtctccgacccacactggcgggccccatgagccaggacccccctatagcgcgccaagcacttaggattaaggtgagcccccccttaccctaattacccaaagcaaccataaggccccacaacaccacccacgcgccattagggcccagcaggcccccccagcccgagacgtacccccgcgaaccccccccccgtgatgcccccacagcgggccaaaacgccgcccaaagccgggggtccccgacccctagggcggcccacaaattaccgcttaggtcgctgccacgcaaaacaccccgccgccgcagttagagatccagctccaccacaatacccccttagggtgtgaccctcccacaggctcacaacggcacttctcctggcggttagcgatcacacgcagcgca

SEQ ID NO: 516309 - DNA, 106 bp, Homo sapiens
tgagactgacagtagggatggcttagtgtttggcttggctgtagaggttagagatacagaggtgtcatgacatgatggacttacgaggccaagagaacagacagaa

SEQ ID NO: 516310 - DNA, 457 bp, Homo sapiens
tataaaatacattatttggctgggcacggtggctcacgcctgtaatcccagtgttttgggaggccaaggcaggtggatcacgaggtgaggagatggagaccatcctggctaacacgggtgaaaccatttctaccaaaaatacaaaaaattagacaggtgtggcggcgtgcgcccgtagtcccagctactcgggaggctgaggcgggagaatggcgtgaacccgggaggcagagcttgcagtgagccaagatcgcgctactactacactccagcctgggcgacagagcaagactccgtctcaaaaaaaaaaacaaaaaacaaaaaactatttataattatctagactaccaagactcacttcaattcccatcataccatgtttatagtattacctaactgttggtttggaatttgagtacaattaagaaacaaagaggctgggcgcaatggctcacac

SEQ ID NO: 516311 - DNA, 779 bp, Homo sapiens
gaggaaggacctggtgtttgatgaccggtgtactgtcgagcagatacttgcacgggtttacagaaaattgggtgccctgggtagtgttaggaaactggagcgaagagaggtcataaggatgaagagcagttcagttggccagcgggggtgctggcacggctcttctcatgcaggagttaagatccaaggatgtaatataactcaaggcctctatagccctcaaaccaaagagaaaccaacttggaaagttgagtataaacaaacgacatctgaaagaagagtctcgctattgggcaaaagaagctagtggacatggatcccggaatagtcaaattggtataatttgccagttctgagaaagatcaaggacccgagacacattaatgacaaagcatacattcagcagtgtattcgaaaatctgtgagtttcttacagaatatggtaatgcacataactgtgtcccatgacacatctgtaccagctccctctgttcacagactttcctgaaagaatctttccacatattcattttatgggcattacctggtgcccctcattacgaactttcactgaggacacaagttctgaagaaagaaggttccacacaaatcttaacagaccttgggtatccttttggcactatccaacacgctccagtgtaacaccgggtgggggctccttcatacatgggctgtacataggggcacagctatagcttggtaactcaaattgattaagatacatactgcacatgacaacagccaccctatggagacgg

SEQ ID NO: 516312 - DNA, 181 bp, Homo sapiens
  misc_feature (165)..(165): n is a, c, g, or t
aggctcatccggtttctctatcaatcaatttttcttgagtggcttctgaaacagatactgtcttgccggaaaagtggttcatcaaaaccagtgatagctttttctggtgcatatatctgctgacggtcatcgaacgtcaactgaggtcccgacgctatggcactngtcgacaggtcagctt

SEQ ID NO: 516313 - DNA, 658 bp, Homo sapiens
  misc_feature (532)..(532): n is a, c, g, or t
tagagacggggtttggcgatgttgcccagtatgggtctcaaactccggagctcaagtgatctggccggcctcagcctcccaaagggctggggattacagacgtgagccatggggcccaaccgggtggtctatctggatatcactttttccactttagaaatggggagtggggggcaggtttcctatgtcctgggtcccaggaagattgagggaggggatgctgcagatgtggaagtccagttttcttaccaccttgtcagaattttttcccttctctggggtcccaggaacggtctcctacttcataacttgagttcggggatttcacgggggataatctgggggcggggtataggggtagggtaccggggaggaagagtgaagccagctggcttctacacggccatttgggaaccagaagtccctattcttagatacttaatcctttagggggctgttgtgaatgggaatggggtatatcattttgacatgtggttggatgggggcaagtttgtagaactaaaactaactntcgggtatggatggggtattctgtgaccttactaaacgttgggaataagttctagtaggatcaacattggataaaggtcacgggactgctttactcctcctctttgtaagacacacacacaaaaac

SEQ ID NO: 516314 - DNA, 100 bp, Homo sapiens
ctctgaccaacacattacacccttatacatctctagcactgtgtcttcgactaacatagaccttaataaatgggggaaagcaaatcagatgacaccatgt

SEQ ID NO: 516315 - DNA, 438 bp, Homo sapiens
gtttagatggtcatccgctggttctcgattcaagagccaattacacgaaactatgaacttgacctaattctggtttctgacaattatgagacagaactaacgaatggcacagcagtgcttttcgttgcacactgaccatttttaagttacatcatcctctatgatgatggtgctttcacaactgcagctctcctgtatgtcacaatcattctgtatctctaacattaaggaagataactccatttacagctggtatagccttaacactttcccaacactcgctaatttcccctatgtaacagacagacagtatttcactacaatttcataacttcttaatctcagttcgttccttcctactgattactcacccatttgtggcaagtggcacgggcttcccattcaccatcaggatcacgtctcaaggcacccccttta

SEQ ID NO: 516316 - DNA, 265 bp, Homo sapiens
tacaacggacctacatggaggccacaccaaagttttatttccctctctcgtgagatgggggatgctgtgcaggctgatgaggcacccatgagaaaagcccaacaagattgcttattacagataccccctcaattccaggagccaacatgccaaagaatgatgctggatacaggtatctccgagggaggacttatgggatgagatctcggcctggcaagcccagcatccacttatcccatacaggctccaccacgagatcaagcaa

SEQ ID NO: 516317 - DNA, 338 bp, Homo sapiens
caaggggaatatgaacccatgcaagtatctagcgcagttagtctccagtagtataacccagttggcaccggcgactctgttcttcctgctgtgcactccccatatgctaaactcacacctgctccctcatccctcctcaccatgctgccctgggaatatcccctacaggacctgctccctggccctgcatgcaagccccattgctctgtctctcactagattccggactcactgacgtagtcatgaaactttacatccacataactagaatattttccacaaattttaatttgctcattactactactaagaagaggataatcaaaactcaggctgta

SEQ ID NO: 516318 - DNA, 332 bp, Homo sapiens
gccccccatggggctttgggggcccctttcctcctgaacaagggcccattgggcaaaacaaatggcctgtttcaaaccggggtccctgtaggttcaaaggccttaaagcctttttggaaagggggcccttatccctgggccttttttatggcccggggcccctgtttaaatgcccttccaaaactgggggatgcgggaaaaatccggcccgttttttaaccaacccttcccttttttaaagttcccaaagccctccttaagggggaaaaagggccccccccaggaaaaactgtaattaatgttgttttaataaaaaagccgttttgggttta

SEQ ID NO: 516319 - DNA, 100 bp, Homo sapiens
gcccccggccagcggggggggcccttttttaaggctttttggagggccaaaacttccaactaacctttttaaagaattaaacttttatgagggggcccca

SEQ ID NO: 516320 - DNA, 939 bp, Homo sapiens
gaactgatggaaggaatgcgtgtcagcctgagactcagtgaagacaacttctggcagggctcactccctgggcttctggaggaaagagaaggagcgcagtgctccagtggtacagaagtgagacataatggaatcaggcttcacctccaaggacacctatctaagccattttaacccatcgtggattacctagaaaaatatgacaagtttggttctaggcgactctgcagagaagccagattcttaagcaccttctgtaaaaatcttttgcaagatattctgcctaggacggtgtgaagggagacctgctgattgacatcggcgtctggaccccactagtctattcagtctcctctctggcttgttgaatcctttaaggagatcgtcgtcgctgactactcagaaccagagacctgcaggagctggagcaagtggctgaagaaagagccagaggccttggactggtcccccagctggtgacctatgtgtgtgatcttgaagggaacagagtcgagggtccagcagaaggaggagaagttgagacaggcggatcaagtcagcgtgctgaagtgtgtactgtgacgtcaggagccagcctactggggtgccgtaccccttatcccctcggactgactgccgtgctgcagcgacactgtgtctggatgccgactggcccatgacctcgcccaactactgcaggggcgctcaggaacctcggcagactactgaagccaggggtgcttacctggtgatcatggattgcgctccaagagcagctactacagtgatcggggagcagaagttctccagacgtcccccctgggccgggaggcagtacgaggctgctgtgaaagaggctggtaccacaatcgaatggttgaggtgatctcgcaaaggttattcttccgccattgggcacaacgaaaggactttttctcc

SEQ ID NO: 516321 - DNA, 1131 bp, Homo sapiens
  misc_feature (158)..(158): n is a, c, g, or t
  misc_feature (183)..(183): n is a, c, g, or t
  misc_feature (189)..(189): n is a, c, g, or t
  misc_feature (206)..(206): n is a, c, g, or t
  misc_feature (208)..(208): n is a, c, g, or t
  misc_feature (219)..(219): n is a, c, g, or t
  misc_feature (223)..(224): n is a, c, g, or t
  misc_feature (238)..(238): n is a, c, g, or t
  misc_feature (293)..(293): n is a, c, g, or t
  misc_feature (311)..(311): n is a, c, g, or t
  misc_feature (315)..(316): n is a, c, g, or t
  misc_feature (328)..(328): n is a, c, g, or t
  misc_feature (333)..(333): n is a, c, g, or t
  misc_feature (348)..(349): n is a, c, g, or t
  misc_feature (364)..(364): n is a, c, g, or t
  misc_feature (372)..(372): n is a, c, g, or t
  misc_feature (374)..(375): n is a, c, g, or t
  misc_feature (378)..(379): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (416)..(416): n is a, c, g, or t
  misc_feature (441)..(441): n is a, c, g, or t
  misc_feature (452)..(452): n is a, c, g, or t
  misc_feature (500)..(500): n is a, c, g, or t
  misc_feature (517)..(517): n is a, c, g, or t
gctgtcctccgcggcgcccccttccgcctgacggcccccggcggcggccggcagccctggctcctcgcgggctcgggcggcggctgcggcggggctatggcgagcggcggtggcgggggtaacactggcgcgggtggggggccggggatgggcctgangcctgggcctgggtctgggtctgangcctanggctgagtgaggccccnangtgaggcagangganngaggcggccacggncgaggcggtgggacgcctggccacgacgctgtggctgcggctccgcggctggganggcggtgctggcggcggngcanncggttgctggtntgggngaagccgctgcacanncctggtcacggcggncgcgctcnannggnnctcttctggttgctgtcntncntcgtccctccggccnttcttcctactcagcgtctcacttntggcctatttnctgctggatctctggcagcctcgctttctccctgacgtttcagcatcntccccagaggagccacnctctgacagattcacctgcaggagctgctgcagtacaagaggcagaatccagctcagttctgcgttcgagtctgctctggctgtgctgtgttggctgtgttgggacactatgttccaggaattatgatttcctacattgtcttgttgagtatcctgctgtggccctggggagtttatcatgagctgatcccagaagatgtacactctgcttggagcccctggttcattgcgttgggactacgcctgaaggcagaaagcatgcctgcttccacaaccgaccaaggaaccgtctcgggcaaatggcctccgaggttgtagagcccctgtgaaagcacacgagttgaaccaggtcagacatggtcggtatcccccacagggtagtttgcatgaaaaaaggctggcttgtcgcgatacacaatcaggggaaaaacaaagggcacatagtcgagggagggagcaacaccagccacacaaatgcatcagagtagcagatgagccaccacggtagacaaagcatgagactagtagaaagagagacatcactacaaggcaagcagtaagaaggagaggatccactaacgcaccagcgagtctgtatctcctgttacagttat

SEQ ID NO: 516322 - DNA, 292 bp, Homo sapiens
  misc_feature (36)..(36): n is a, c, g, or t
  misc_feature (59)..(59): n is a, c, g, or t
  misc_feature (98)..(98): n is a, c, g, or t
  misc_feature (138)..(138): n is a, c, g, or t
ccatgcaatctctagctgtggtttccttcagtcctntgaacatactgaggatagccatngtaaagctttttcctgttaaccccaacatccggacctcnccaggcaatttctgttgcctgctttcttcctgtgtatggnccaaggctccttgcatgtcttatcatcttttgttaagaatcagacaccgcaggtgatacattgtagcaacagtggaaagcagttctcctttctctgggatccttgctgctgtcagcttgtttattactcaggtacggagctggactatcttact

SEQ ID NO: 516323 - DNA, 1227 bp, Homo sapiens
  misc_feature (158)..(158): n is a, c, g, or t
  misc_feature (183)..(183): n is a, c, g, or t
  misc_feature (189)..(189): n is a, c, g, or t
  misc_feature (206)..(206): n is a, c, g, or t
  misc_feature (208)..(208): n is a, c, g, or t
  misc_feature (219)..(219): n is a, c, g, or t
  misc_feature (223)..(224): n is a, c, g, or t
  misc_feature (238)..(238): n is a, c, g, or t
  misc_feature (293)..(293): n is a, c, g, or t
  misc_feature (311)..(311): n is a, c, g, or t
  misc_feature (315)..(316): n is a, c, g, or t
  misc_feature (328)..(328): n is a, c, g, or t
  misc_feature (333)..(333): n is a, c, g, or t
  misc_feature (348)..(349): n is a, c, g, or t
  misc_feature (364)..(364): n is a, c, g, or t
  misc_feature (372)..(372): n is a, c, g, or t
  misc_feature (374)..(375): n is a, c, g, or t
  misc_feature (378)..(379): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (416)..(416): n is a, c, g, or t
  misc_feature (441)..(441): n is a, c, g, or t
  misc_feature (452)..(452): n is a, c, g, or t
  misc_feature (500)..(500): n is a, c, g, or t
  misc_feature (517)..(517): n is a, c, g, or t
gctgtcctccgcggcgcccccttccgcctgacggcccccggcggcggccggcagccctggctcctcgcgggctcgggcggcggctgcggcggggctatggcgagcggcggtggcgggggtaacactggcgcgggtggggggccggggatgggcctgangcctgggcctgggtctgggtctgangcctanggctgagtgaggccccnangtgaggcagangganngaggcggccacggncgaggcggtgggacgcctggccacgacgctgtggctgcggctccgcggctggganggcggtgctggcggcggngcanncggttgctggtntgggngaagccgctgcacanncctggtcacggcggncgcgctcnannggnnctcttctggttgctgtcntncntcgtccctccggccnttcttcctactcagcgtctcacttntggcctatttnctgctggatctctggcagcctcgctttctccctgacgtttcagcatcntccccagaggagccacnctctgaccgcagagggttgcggggtcaggcgccccggtcgccacctgctgagtgtgcccgagtttgtgccagatacctggctgaggcggctggtcaccttcccagattcacctgcaggagctgctgcagtacaagaggcagaatccagctcagttctgcgttcgagtctgctctggctgtgctgtgttggctgtgttgggacactatgttccaggaattatgatttcctacattgtcttgttgagtatcctgctgtggccctggggagtttatcatgagctgatcccagaagatgtacactctgcttggagcccctggttcattgcgttgggactacgcctgaaggcagaaagcatgcctgcttccacaaccgaccaaggaaccgtctcgggcaaatggcctccgaggttgtagagcccctgtgaaagcacacgagttgaaccaggtcagacatggtcggtatcccccacagggtagtttgcatgaaaaaaggctggcttgtcgcgatacacaatcaggggaaaaacaaagggcacatagtcgagggagggagcaacaccagccacacaaatgcatcagagtagcagatgagccaccacggtagacaaagcatgagactagtagaaagagagacatcactacaaggcaagcagtaagaaggagaggatccactaacgcaccagcgagtctgtatctcctgttacagttat

SEQ ID NO: 516324 - DNA, 168 bp, Homo sapiens
ccgacggcagtgtgtactccagcaggtctccctgcgttcatctggccctcttgcaggactgctacgtaattggcaggcccagtgcaaaacatgaaacatgcaagtctccttgttaacaaaacaaaataagaatttcaaaatgatgacagcagaacattaaaacaagcg

SEQ ID NO: 516325 - DNA, 149 bp, Homo sapiens
tagacttgtgagcagtcgggcacttgttgggcttggcctctgtagtcgacttggagtggatctgcatctctgacttggtgaaaaagagtcagtgggcatatccttacacctgtacgtcttgccctcctttggagctcgcccctcaggtt

SEQ ID NO: 516326 - DNA, 410 bp, Homo sapiens
caaatcaggcaaatgatttggggtcccagctccatgtctcagtttgctgacatagaagtacctgcagggttaggcaacattgaaggacctactgtgccctacaatgtactctttaagcctgttctgaacaataggagagatgccttagttgttgttaccagctgattgaaagtttgtgtctctccataaatctttaagctgaaacccctgccactcatgtgatgacattagaacgcgggttgtagaaaatgattagatcatagtatagattatacacttcccatccttgtaatagagatcacagagagctcccttgtccctttcacttatgaggatgtagcatgaaatggccatctataaatcaggaaatgggcttaacaaagctctccactcttctagcatcttgtccc

SEQ ID NO: 516327 - DNA, 421 bp, Homo sapiens
  misc_feature (213)..(213): n is a, c, g, or t
  misc_feature (366)..(366): n is a, c, g, or t
  misc_feature (388)..(388): n is a, c, g, or t
tatttccacaggggggggaaaggggggaaagacaggattctcaaccctcagccctggctgtccttaagaaccatctggaagagctaggaatcatttgaaaatacccctgccacccatttttaatgagcagtcagggctgagaatcacaactttaagatattttgcctgtaattaatatttatattttaaatctacattttctgagaagctcgnaattttaaaaaatgtattagtatctttctgaagataatgaaaacttgtgtctttagattagctttacatatctgacacctaaatggtagtgttcattcatattgataggataatgaaggaaagaagagctttgatcaacgcctgggacaccanagatttatctctggtcccaagngtggaaatctcgagagtggccctgtggaaagta

SEQ ID NO: 516328 - DNA, 660 bp, Homo sapiens
gatttcccacgtacactgatgttcccttctctacagctgctggagtgactgcgactgctactactacatcctggcatgtggcagtgagaagaatcctggcacgacagaagaaaaaactatgcgacttggtagcgagaaaagggtaaagagtcagagaaatgagttggctctactgaagaggctgaaaccactgtttactaaaagctttgagagcactgtgggccaggattcagacacatacatctatcatcgttcagaggctgtgccgggaagctggtcgaaccacacttctgggcgcaggcctgcgtcgcaaactcaatcaatacaccgtacatggcgcaacggatgatcacgtgcgtagcggcagactcaacgagactcacatcttcaacggaagtaatcggcatcatgctgatctataaagggggtgatgaatatgacaaccactgtggcgaggagcagctgtcgtgcacgtggtgatgatctcctgcaatcgacacaccctagcggacaattttaaccctgtgtctgaggcagcgtggcgaagtccaacgatcgtctctacctcttggcaactggcatagcagcctggcctgttcaccacgagtatctcccaacgtcagaggtgggctatcaaacttacttgtcaccgttttgcat

SEQ ID NO: 516329 - DNA, 326 bp, Homo sapiens
  misc_feature (261)..(261): n is a, c, g, or t
  misc_feature (264)..(264): n is a, c, g, or t
tgaaacttgagaggttgtgaccagagattagattattaatatttaggccaagtgcagtggctcacgcctgtaatcccagcactttgggaggccaaggtgggcagatcacttgaggccaggaatctgagaccagcctggccaacatggcaaaacccgtctctactaaaaatacaaaaattagccaggcgtgatggtgtgcacttgtggtcccagctactcgggaggctgaggcaggagaatggcgtgaacctgggaggcggnttngcagtgagccaggatcgtgccactgcattccagcctgggcgacagagtgagactccgtctca

SEQ ID NO: 516330 - DNA, 152 bp, Homo sapiens
attccccccccaaatttaaacccttggtttgtttcaacagggtggaaaccctctttttgtagttgggcgaaaggacattttttagtccccttaggcctatagtaatgaacagaatatcctgccataaaaattaaaaagaagtgtttttggga

SEQ ID NO: 516331 - DNA, 564 bp, Homo sapiens
  misc_feature (134)..(134): n is a, c, g, or t
  misc_feature (148)..(148): n is a, c, g, or t
  misc_feature (157)..(157): n is a, c, g, or t
  misc_feature (160)..(161): n is a, c, g, or t
  misc_feature (163)..(163): n is a, c, g, or t
  misc_feature (173)..(173): n is a, c, g, or t
  misc_feature (175)..(175): n is a, c, g, or t
ggaacgagaaggaggccatggaagacggtgaaatagatggaaataaagataccttggactgggccaaacctaagggtgaaggtggcttcgggggtcgtggtggaggcagaggcggctttggaggacgaggtggnggtagaggaggccnaggaggatntgnngncagaggccgngnaggctatggagggcgaggaggcttccgaggaggcagaggaggaggaggtgaccacaagccacaaggaaagaagacgaagattgaatagattaaggccctatgcttatccctcttccattagaaaaaaaggacaatgggggttatactgttacctgaacaatgacagagccttctgaggacaaaccaagacaggatacagtcctgggggctccatggaaaaacgactagtaaaaatttaaagggcaaaaacgggtaaggaatgaatagaaaagtcataaaaaacattcaaaggaacagagggaaaaggagcaaaaccaccaaaacatggaagggaatacaaaaacaaaaaatggagcgtagaaaacccgaaggtaacaaaaaaaacacaa

SEQ ID NO: 516332 - DNA, 603 bp, Homo sapiens
aaaaattttttaaaaaaaatttttaaaaaaaaacataaaaaaataatacaaaaaaaaaaatcttaaaaaaaaaaaattttaaaaaaatttttcaccaaaactttcaaaactattaaaatcccactccacaatttccttcccatataaatttctaataactccccacccaaatgcccaaaatctcataaaaaaaaaaaaggtcacccccccaaaaaaaaaaaaacaactccaaaaaacatattcttttcctttaatatcattaataattccaactacataaaatctcccccatacaaatctcaaatcaaattcttttattccctacattttaaccaaaaaaaccccaaaaaaaatcacccacaaacaacccaaaaaaaccacccccaaaacctctaacaaaaattttcacctattattcacatttaccacatcccctattacaaaaaaattaccaacttatatattcaaaataccccattaaaaaagctcaaaacaattactcataaatttatctcttttaaaaaaattcggccaaaagcccaccccacaactccacaaacaaaaaaatccaaaccttttttctacaaaaatattcctcatact

SEQ ID NO: 516333 - DNA, 492 bp, Homo sapiens
ggacagcaccaaccagtagggttttcactggtcccctgggtttccttcaatacaattaactttaaaatctttaagttaagaatccaggttgaatacctaaacggcaccatgttttccaagagagggtaatagtgaaataaaatctggtttagggaattcctttgaggtccaaacccagctcttttcctcctgccttctaatttgctgcattcacccaatgcatacccaattctatccttccaaacaaaaacctagtttcatagtcaactgaccgaaaatgacaggcagtggatccctggtcctctagagtattactgctactcaagggccagttagaagacattctcattggcaagacaaacaagaaggttattggtattgttcacaagcctttgctaagatcacttctttgtgttatacctggattgcatcactccacactgcctcctttgctcttcacgaatgtgaagaacctcagctactgccaagtca

SEQ ID NO: 516334 - DNA, 394 bp, Homo sapiens
  misc_feature (16)..(16): n is a, c, g, or t
  misc_feature (290)..(290): n is a, c, g, or t
  misc_feature (387)..(387): n is a, c, g, or t
tttttaaaaaaatttnttgagacagggtcttgctctattgcccagcctggagtgcaatggcacaaacactgttcactgtaaccttgacctcctgggcttaagtgatcctcctgccttagcctcctgagtagctggatgtacaggggtccaccaccatgcctggctaattaaaaaaagaaaaaaatttgtagagacagggtctcaccatgttgcccaggctggtcttgaactcctagggtcaagcaatcccccgatcttggcctcccaaagtgattacagggattatcggncatgagccactgtgcctgggccagcctggctatttttgggaataaaaatggggtttcatttacattcttggactacgtttattttaaggttaactcntttaaat

SEQ ID NO: 516335 - DNA, 988 bp, Homo sapiens
gcccagctctgggttacccggctctgcatcgcgtcgccatgatggcgccatcgtgctcagctgctcgtgcttctagcctatgaatacaaagcgtgaatccgtgacacggaacagagtacaatctgtcaaacttcatttgctgcgccatggacgtattgcatgatatcatccgagacatgattatggggacccagagttccagtgactgaaggatgcttagtggaacccattgggatggcattgtgaatgcaatcaagtgactgtgaccacacttgccattcgttcgaagagcattcaattccagtgaatccagcggtcattcgtcctattgatcagtatatatgtaggcccgagtaatcgccagagatcgagggaaggtagagacgattgggagagcgacgagtccaagtccaattgattccgtttggcaagagcggtgcatacattgttgagtctggtgcaagcgtgaggcgacgttcgcgttggatgctatgcttatgattgcaatctcgagacgagggttgagtgatcgatgtgggcttgtagcactgcgaaaggcacttcggacttgattacttgatcgaggtaactcgctatagaggaaagatactaacggttaattccaaggtctgcactaatcaacgttggacgcagttgcatatgcattgggtgagagcactcatcagagcaaggctcgtaatcaacttagccgaaaacgccaatccatgtcagagatgagtcaatcgtaattgggcgttttgcccaattcaaattggcaccgcatgggagattggcttggataccaaaggaaattgggtaaccaaggatcttgcacgcgcaccgaaactgggcttcggagaacacataatgcattctggaacgaactacgatatctaaaacatttagttgcccgaacggaagcatgcggacaaaaaaggatcaacggcacatgagtaaggtgacagattgagatacgcacgaggaacat

SEQ ID NO: 516336 - DNA, 398 bp, Homo sapiens
  misc_feature (6)..(6): n is a, c, g, or t
  misc_feature (292)..(292): n is a, c, g, or t
  misc_feature (358)..(358): n is a, c, g, or t
aaaatntcctgggaatgacaaaacctacgcattcatttacaactcattagccctaaagagcaaagacccaaatttatgcttattcaggcaatgacaacctatgtggcaacacccacaggataaacaatgattataagattttttggggctgggtgtggtggctcatactgtaagcccaacactttgggaggctaaggtgggtggattcgcctgaggccagcctgggcaacatggagaaaccccatctctacaaaaaatacatgtggtggtacatgcctatggacccagctanccagggaggttgacgtgggaggatcacttgagcccaggaagttgaggctgtaatgagctgcgagtngccactgcactctagcctgggcgacagagtgagaccttgc

SEQ ID NO: 516337 - DNA, 159 bp, Homo sapiens
gtcatacctttattgaaaatcctgctacccctgttgtgatcataagacggactcagcacgttggaacctattctgttgtgtagggccttgcctagaatgtcgatgggctgctgcctggggtggttactactaggtgctattgaaacttctaaaactagg

SEQ ID NO: 516338 - DNA, 713 bp, Homo sapiens
  misc_feature (98)..(98): n is a, c, g, or t
  misc_feature (252)..(252): n is a, c, g, or t
cagaattacaatggcatttatctgccttcattaaattaagctcaggaaactaatgcagactccaaattgcccacagtctaacacagtctctgcatctncggttaacaaaattaaatttgggaaaatcaagagtaagacttttaatgtttctaccacctgtcagcctggaaagttttcttagtttttctttttggagaggcatttgagatttgtgttcctgtcaacttgagagaggaatggaggaagtcaaanggaagaagaggagctgatgttgcagtccgaggggaaacaggagtgagggcagggagcccagaagagggtcagggtgaagatgggtgtggggaaggcagagcaaaccagctgctgctgtcaaccctgacctatttcctggagctctgggagccctcccatccctgctctcagcaacagtgatgctgcctttgggcggctgtgcagccaacccacactgatagctgtccctgtcattttcttaaatgtcaccagtgaaagagacatttccacctccctggagtacacatactccacttgtggataagtggacacttggttccattttcacagcttccaaaaattggtcacagatgactaacaattgtgtcaacttctctggtatgagaagccatagatggaggtatacagaaatgatttcttaaaaaatgtaatgtcctttctatgtggcagtaaaacatctt

SEQ ID NO: 516339 - DNA, 157 bp, Homo sapiens
attcgagttcaggcaaaaaaatttttgttactcaattatactgggaagtatagaacttctaaggccttggtctgcttacacatcactgactgcggtgaagccctcagagaggcatctgacacacagcccatgaagacagaacaggctcactaagcct

SEQ ID NO: 516340 - DNA, 135 bp, Homo sapiens
ctcctgcatcaggaaacccagtagctggattacaggcatacagccacatgcacggctaatttgtattccagtagagacggggtatcaccactggttaggctggtcttgaactcctgacctgaggtgatccaccag

SEQ ID NO: 516341 - DNA, 119 bp, Homo sapiens
tttagtctcagctcatgattgcctcagctttgcagctgtcccctggcaggctgtggtctcctctgcaaagcattttacttaaaaacctcaatagagatggccctgcccaaaaaaaaaaa

SEQ ID NO: 516342 - DNA, 210 bp, Homo sapiens
ccgggatggggccctggccaatactttgatttttccccagtgaaactcattggggttcgggcccccagaactgggaaaaaataaatttttgttgtattaagcccccaaggggggggcaatttttttccagcagccatatgaaacaactccagggtttttacaaaacatttcgggcaattaagtgggccccgtttattcagtgccccccca

SEQ ID NO: 516343 - DNA, 559 bp, Homo sapiens
gatgataaatgtccaccatgagctcatatatgcacacgcatacacaagcacacaatagggatctttaaatagcttctaatttccggtatgttatgaccccggcggatcccctatcaagccatcttgggctgtctgatatatatgagcagacttggtaaaaacagattttctctaaaaatgcttaacacttcctgagtccaattacagtagtgttaaggatatgagaacggagtaatgcaccaaaaactgtataatcatgtctgagtcaacaaaaaggcaagtaaaattacacaaacacgaaaataatttgcaaatatattattaaaaaagggttagaagtaaactgaaaaggctaggctcaaattttaggccagtcattgtggttcttgctcctaactcattttcaaacattatttacagaagtccaagctatttgacatcctctgaagtatatttgcattaaaattctattttgagtatagcctttgtttagctgagacaattggcttaatatttgaagccaagaaaaactcccactagacaaggtagagccgagggg

SEQ ID NO: 516344 - DNA, 859 bp, Homo sapiens
ccggttctttaaagagccgtttctgccttcctgccgggtgtccccctcgcccccttgttggtctcccccgtgagggatgtgtcccctgtaagccgcttccactcgtgggtactgttgacaaaagggtaacaccttggtccctgagggagcaaaacaaactgtctgggtgaacccgctggtcattttttctacagacaatgccctaccaatcctttgtgcacagtcacgggcaacatgtaccttcccctgagggaaatggtcgtgacaccccacgagcaccttcccgtctcggccacgtgggggccacctccactgccaccggcggcatcccacaagggtgttaatttctctgagaccccacttcatgctgcaacacccaccccggtgttttgcccttttcctatataaggtccacgtctttctatccccggcacctttgttagagttttgcccgcccccttattggcgaggggaaatcaaccaagagaagtgaatgcttatattcgcatcgtctgcagtaaaagattcatgccaccagaatgggcggaagcgaaacaatccgttgtatcacagtgtgacagggaggcgaggtgtgcttcaagaggcgcctccatgtggcccaccaccgtgctgccattgaggtgtcatgatgcatgtgtcggatcgtttttctccccgaaggaagtcaccctgctggccaatcaggcctggattagctggcgcctgagtataaggaacccaggattcccgtttcgacaaatatttgcgcatggaagaaaagacattgacgaagaaaacaagatggctgatacccacgcccaatagcgtaaaaaaaacaaaaaggcaatagcccacaaac

SEQ ID NO: 516345 - DNA, 1131 bp, Homo sapiens
ggccaagtaaccgctcctgtattaaacgaagaaagtgcttcatgcgtttgcaggaggcccaagctcctatatatagggtttctattctctgatattatagtgcgtatcgtatcagagaatatcggtagaggaacaaagaaagaaggtcatgtttgccaggtacccttctcgctcttatgccacttagaccaacggatagaaagcgtgccgtggtattagattgttgatgatacactctttcaagatcagcttcatgtggcttcccttgatctctagttcaggatgagggccaggagggtgaaacatcacgagactgtgcctaaaacctgtttcctggaggtcagcattgtgactctgtatgccaagaccacctctttgcgttgtcactcactcttctctaccctgtgctcccatgactttgctcctcacactttctggaagccattgccgttccaggggcggtgcgccatcgtctttactggaccagtcgcgttgtcatctgggcccacggttggcagtgtgtgataaatccagtcaagctgttgaagtcttcaggagtctctggctagctcgtgccagacagtaaagcctccatccatcaggagcctttcctcaaaacgtggagtcccaaagtgtcatcaggttctcgtagtcctattcacgtcgcacgtaagaacccctctgctttgaactctagaatttgggcttggaccagatctaacatcttgaatactctgcctctagagccttcagcttaatggaaggttggatccaaggagggtgtacattggagcatctaagccaactcggcggcagcatggagctataactaaggcatcctttagggttcttgctcctccagagcatttaggcctcaaataactctaagtactgggggataggtataaccctgggcaacactttggaggccaatcctaaacctgggaatggggtgcataagacttaggcatatcttgaatttgttgtcacaggccctaattcttccaacgtttcacctttgggaccaataaaaacgtttctgtcacccctatattccggggggaacaacatgttgcgacacaataaacccctatacatattaacacacttgacaacgttacgggcccaaga

SEQ ID NO: 516346 - DNA, 143 bp, Homo sapiens
  misc_feature (1)..(1): n is a, c, g, or t
naccccttttccagctcttgcaccgtttctgcatgagttgcttgcagctctctcatagagcgttctagatctttattaatttcactatctactttcactaaaaaggaaaggtctccatttttttgttctttttgagcctttat

SEQ ID NO: 516347 - DNA, 297 bp, Homo sapiens
  misc_feature (297)..(297): n is a, c, g, or t
gaggatccacaaaccatggaacactctcgcggctgccactcccccatgaccaccctacaggccctaaccccagcccctcacgttatcgtccagccacaaatagctgccgccctgagatctccacctcagaccctctcccgaagcccacagcggcccctgccgggcaccccagcttcctcgcaggcaccaaaagcgcagttccaggaatctctaccctagagtgatccggcgccagttgccagttaagggaccaaacctcgccagaaggcttcttttcgggttgatcgccatctattn

SEQ ID NO: 516348 - DNA, 152 bp, Homo sapiens
ttaaggggggttttggggggttcccccccccccccccctttattttttttcctgggggggggggggggggggcttaagggggtccccccttgcttaaacccccctgggggggttttgttttcccctttttgtttaataaaggggaaccccca

SEQ ID NO: 516349 - DNA, 198 bp, Homo sapiens
tatgtgcgtgtgtgtggtatgtatgacgtatagctatgtgtggtatgtgtggtgtgtgtggtgtgtgtggtgtgtgtgtgtctgtgtgtgttgtgtgggtgtggtgtgccctatgtgtagtatgtgtggtgtgtgtgtggtatgtctgcgtggtgtgtgtacatgtgtgttgtgtgttatgtgcgtgtgtgtggtatg

SEQ ID NO: 516350 - DNA, 210 bp, Homo sapiens
agagatctcccaacttgtgctctcaagtgctggaattacaggcatgagccaccgtgcccagcctgcagttatcttttttacaggaccgcaactcatttgtgtctctacagaccatacgccatctgccttgctgttaggatggaataatttacttggctaattggttttttaacaagttaacatccctagatggagtcgtaaataatccta

SEQ ID NO: 516351 - DNA, 275 bp, Homo sapiens
  misc_feature (4)..(4): n is a, c, g, or t
  misc_feature (10)..(10): n is a, c, g, or t
  misc_feature (55)..(55): n is a, c, g, or t
  misc_feature (89)..(89): n is a, c, g, or t
  misc_feature (93)..(93): n is a, c, g, or t
  misc_feature (120)..(120): n is a, c, g, or t
  misc_feature (127)..(127): n is a, c, g, or t
  misc_feature (241)..(241): n is a, c, g, or t
aatncctggngtgcagctgaagctgagccacttgtgtttcttcacagtatctctntcgggagggtgtattatttccttttatagggganctcntataatgaagtgagaatcttgtaaaanataagtnttatcctagatgggaggtgttaaaggttttgtcctttggaattttgtcatatttgttgcacagcaaggaaggactttcagaaaagcagggatgtggtgaggaagagcaggcaanagagagcagggaggaaaggctaagtagcatctgg

SEQ ID NO: 516352 - DNA, 212 bp, Homo sapiens
gcttatatacacgacgaaacatgagccgtggtatcctgtcccatatttctatgaacacgtatatattctcccagggtcgagtttccactaaaacaaaatgtatccagaaaacaaagcactatgatcagcttgaataaccgccaggcaaaaagaaaaccgactcccaaaaccaaacacccatcaccatcatccactctatccaaatcaagcaa

SEQ ID NO: 516353 - DNA, 1230 bp, Homo sapiens
tatctctctaaatctctttgtcgttccctatggttcgtatctcctgtcgttcgctaactctctacatttctaatgtgagtcctatgcttctgtttgattttttggtgcatcttctcgctgctgttcgttctgtccctgattggagcgtttctatttgcctgtttgcaatcccctgtattgtgtgctctttctgccgattgtggttatcatctacgcacttctcctgggtggcgctacttgttttattgttattgaagcttgtatgtttatagtggtgtgaaaatttgtgttcctatttaggctttagttgttaatactatgtggttattttaggagtccgaatgttatatttccatgatattatttttctatgttttctgtgatgtttggtatggttgaggatatgaaaatttatcgatataatactgtttttttgtggtagtatttggaatggttagatcttgtattggcttttctctgtatgttatgttatggtttgtatatcatgggtggatatcctatgggctgtttattggctgtgtttgtgttacgtgatctattagtgcttatgtgattataggtacttgtgtgtatgttgatatattgttttcgatctcggtcgcttgtcattgtgattgctccccttcttttctctccttcacatgagactatagtaggtcaatggtttcatgatattgtattgttaaatgttagttattggctagtcttatgggctatcattgggcagagatctatatgtgcttggttgtgtttccatttcttggaaagtccattgaattggggtacactcgcatgtagtttttgcatgtttactagagctatagttggttagtgcattgtttgttgttgtgatgtatgctaatgttatgtttacattatatcgctataggttattttattgctgcatagcgttgtatgtctgatatgcacattagctgggtaatttttaagagtatgtactctatctacctatactatacatactatctatatatacacagtacatacaatacgctgtgtgccatagtgacagctatttttttatatacatggtagttcattaaaattgccttagtaatatattagaatatacgaatgatgtgtgtatataataaacatactacacacagcacacaccccgtatgtagtttttaagacactggcaatgacccactccccttgggaatgcatgtatgaagtacatacatc

SEQ ID NO: 516354 - DNA, 565 bp, Homo sapiens
tcctgaagatctgtctgcagaaacaagtggcaaaagacgttggctaaatgtggttgaagccactgtatgggagacctgtcctccatccaacttgatgtctggattggcactgtaggcatgggctggtggctactggacagtccacacgagcagtcatcgcaacccggtactcaatgcctcttggagttctgtgcactgatttggatgttgatagaagggtacgagctatggaggcgacttaatagcatgcagaatttcgttgacaggggtcgtcacttaagaatcttccaagtctcgtgggaagaatgctatggaatggagtgtggaagagtgggcaagagtttgagatactggagcccctcttgctagcatcaggcgatagatctgacgttcataactgtcttctccagggctcagggacctccatgtccttgagatggtctgaggcaatggtccgagcccgtgcctcatgggatggacaatgcatggggtggtctttattgtgtccctttcaaagtaaaacacgtagtcaggtacgcgtggatcccagtcgtactcttccagg

SEQ ID NO: 516355 - DNA, 219 bp, Homo sapiens
aagtaactacgatgaacagagtacagaccggaagtaataccaggtcggatttctatctacatatcaaataccaccctgatacgaacaggacaagagaaataaggcctacttcacaaagcgcctacccccgatacataatatcatctcaaacataagtataatacccactaccctacccatcgagcgtggaggaatccatctcagacgtcgacctgcagg

SEQ ID NO: 516356 - DNA, 209 bp, Homo sapiens
ccacatttgcaggacatgcagcttgtaataaaatgtcagagtgtgtgtgtgtgtgtgtgtgtgtgtgtgtgtgtatataaaaccacatgtaattcataaaatatatagtggtatatatagatggttttaaatgatttcagtgtggaatccagcataagtggaacaatatccaaggtcttcttaaggggaacaatcttatcgctaggcaa

SEQ ID NO: 516357 - DNA, 181 bp, Homo sapiens
tcaatttctacacacacacaatacacatagcacgcacacacacacactatacacatcacacacacatcacaccacacacacacacacacacacacaccccatctgcgagacgagggtgcccgcgggtggtcgcgcagcccgaggtaggggcggcgggcccaggtgggagggtccaggagag

SEQ ID NO: 516358 - DNA, 413 bp, Homo sapiens
cgtgtatctcaaggacccttatctctcctctacacatgcacacgcaaacatcacatgcccacaaactcacacaataaccgtgtgtatctgttctaataatataatattaaacaccaatgaaaatgattgatctctatacacaacaatatagatgactcactctatgtcgatcaatcaagtaagacatcaaagaccatatactgtatcactctacctaaaaagttcctttataaaagaaaagcaaaactaatatatgatattataattcatgatcatggttatcctgatccataaacactgagagggagcacaatgaatgattctgagtggatattgatattctcacactagacctaatgacttactacctggatgtatacactgtacaaacattcatgcctactgagtaacca

SEQ ID NO: 516359 - DNA, 484 bp, Homo sapiens
  misc_feature (34)..(34): n is a, c, g, or t
  misc_feature (45)..(45): n is a, c, g, or t
  misc_feature (68)..(68): n is a, c, g, or t
  misc_feature (475)..(479): n is a, c, g, or t
accctctggtttctggcttttcattctcccccanggctacccatngaaactggaaccctcttccccanggcgggtcatcgggaaacccagaaccggttttaccccaaagccagcccataaaacctaaaaatagtcctctcactccccattcccctttctgtgtaaaaactggttggaaagaaatgatctgacctaccgtgtttgactgtcgtaagatacccattccagagagggtcccaccccgtgcccagaaggaaggaatcctgcacagagaggccaagaagaatctagacagccttgcctgggtttcccctctcagtctattactattagatcatacccttcttgtccaatcatatttctacacagtccataatctgttgaacctaaacataaaaatggacaattcccctgtatcttggggtcttcattctgagggctcacatacaattatgatcaaataaatttgtttgcnnnnnctcct

SEQ ID NO: 516360 - DNA, 607 bp, Homo sapiens
ctgcgcggcgactctagaggacccctcacgcttatacttcaccaaaaagagtagaactaataaacaaattcagtaaagtggcaggcatatcaatatacaacaagcagatagtgtcacaaaatataaaatacttaggaataaatttaaccaagaaggtaaaatatctctacactgaaaactgtaaaacattgacataagaaattaaagtcacaaataaatgcaaaaatatcccacattcatagatgggaagacttaatatggctaaaatgtccatactaaccaaagtgatctaaagattcagtgcaatccctgtcaaaattccaatgatattttccacagaaatcgaaaaaacaatcctaaaattcatatggaaccactaaagaccctgaatagccaaagcaatcttgagcaaaaagaacaaagctagagatatcacaatacctgatttcaaaattactacaaagccatagtaatcaaaacatttttgtactggcataaaaacagacacttaaaccaaaagaataggaaagagagcccaggaataaatccatatatttacagccagctgatttttacaaacgtgtgaagaacttaatgggaacagaca

SEQ ID NO: 516361 - DNA, 828 bp, Homo sapiens
ttttgtcctttccttttgcagctttccgtcgtgctcgctcttgcgcctgttgtagtattctgtcctcctgcggttcccttggctttcctcactgtttctgtccggtgttctgggtttccattctctgtcggcctgtgtcccggctgttgttcccccttctctgttctgttgtgctgcgtctcgtctccatgctcgctatggcttccctcatgtcatgctgtcgggtgctggcaactcgtcgtgccagcgcggcatttctaaggcctccagcccacctgtcccaattgtgatgaagcagagatgcggcttctgtcgcacactgctctgttggctcccctgatgccaggcccagccctcaggccaagtcagccgcagacttttgataattagcccaacgtaccatgtgtagagatgggccgtgtgccatggtggtacggactcccgggtctgggtcttttgaattggtccttgttgtatctactctggctctcactcagctcccacgggtactcagatagtgcgccgccatgtctgcctagggtatctgtccccacatctgtcccaaccctaatgtctggagtcctggtctctccttacaagcccctgggcccagccctcattgctgggggccagggccttggatcttgagggtctggcacatccttaatcctgtgcccctgcctgggacagatatgtggctccagttgtctctgtctctcgtggtcaccctgagggcactctgcatcctctgtcattttaacctcaggtggcacccagggcgaatggggcccaggcataccttaggccagagaccggcggaggagagcc

SEQ ID NO: 516362 - DNA, 372 bp, Homo sapiens
tagacatgatacgacttgagttcggtacctgaacagtcgtgtcaaggagctggaactctttccctgccccttggttctctgtcccttcccctccccgacctggcacagctgtttttcctgctggtaccaggtcccacagaaacctggcacatgcactgctgagagcccaggggcacaggtctgttcttagcatggttcttacagcacaggcagcaaagaagcatatgcaacccatgagggccaggaccacccaatctgggctcccatgcatgagatatccatatggtatttggtagatagggtggagagggtggagagggtgaatagggtggttagggtggataggatggttagggtggacacgaatgttca

SEQ ID NO: 516363 - DNA, 710 bp, Homo sapiens
  misc_feature (34)..(34): n is a, c, g, or t
  misc_feature (82)..(82): n is a, c, g, or t
  misc_feature (97)..(97): n is a, c, g, or t
  misc_feature (140)..(140): n is a, c, g, or t
  misc_feature (204)..(204): n is a, c, g, or t
  misc_feature (241)..(241): n is a, c, g, or t
  misc_feature (243)..(243): n is a, c, g, or t
  misc_feature (252)..(252): n is a, c, g, or t
  misc_feature (264)..(264): n is a, c, g, or t
  misc_feature (323)..(323): n is a, c, g, or t
  misc_feature (521)..(521): n is a, c, g, or t
  misc_feature (650)..(650): n is a, c, g, or t
  misc_feature (664)..(664): n is a, c, g, or t
cacaaacatctcagttcagttaagagcagttttnccgccagcatgtctcacctccagccataaggcggttttctcctatctnagttaatagaatgtncaatcaggttttacagcgagacgttccattgccaggccgagcnggagacacatgccttcctcttatctcaactgcaaagaggtcttcctctttcactaatcctcctnagcacagactctttacgggtgttgggctgggggacantnaggtctttnccttcccatgangccatatctcaggctgtctcagcaggcagaaaccttggacaatacccaggctttctggngcagaggtccctgtggccttctgcagtgcattgtgtcccttggtatttgagactggagaatggtgatgacttttaccaagcatactgcctgcaaacacattttaaacaaagcacatcctgcacagccctaaatccattaaaccttgaatcaacacagtacgtttctgtgagcacagggttggggctagggttacagantaacagcatctcaaggcagaagaatttttcttagtacagaacaaaatggagtttcttatgtcttcttctttccacataggcacagtaacagtctgatctctctttctttcccaacaaaccccttgtggnttggatggaatcangtttcaggggataaaaccctcgtggctctgggatgtgctagacttg

SEQ ID NO: 516364 - DNA, 152 bp, Homo sapiens
gtgatctagaggaccccccaggtggggcatcacggccagcattctggctccggaagcagaaggcgtaattcaaccatctcatcagggtttctagatcttttaaatgctggttcctcttccatatcttctggcagggcgtttaccaaatttca

SEQ ID NO: 516365 - DNA, 943 bp, Homo sapiens
gagtgcgtgacttacctcgactcttatctatgtcggggacggtaagcgtgacccggtgtctgctcctgtcgccttcgacctcctaatccctagccacatagtgcgtgagtgcgatctccagccacggtcgggccaggctggttgtccagattggcaatgtcctgttgggagctctatttgccttggaaacaatgggcaatcctagcctcgatggccaggatgccatggtgacatgacctattgtgggatggcagatgacgtcctgtcaagaaccttccttcagggagacgggcgctggcgaggcgacgtggccccggcgctgtggtatgtagacgtggtaattcctcaggtcattgatgacacttcgcactgggacctaccgcgcaggtctttccatgctgagcagctcatcgcaggcaagggaaagatgctggcaaatatactatgcccgaagaggggcaagtacaagccattggcaaggagatcattgattcttgtgttcggacccgacatgcggctagagcctggatgacccagtgccggcgggtcttcaagggctacttgggtttacccatagagtctggggacgggaacatggtcctgggttccacctcccgtgcttcagtgggaaccgttctcagatgatgatgggcaagaacgtccaagcttgagttgttgcatttatgcccagcgagcccaggtttcccaaggttggagtgagccctagagaatccatttcttgaaggcatgccaagcgggagaacctgatggtgcttcatggattacaatgaggctcttctgacgtttgtgggaaaccctcgaatgaggccagtaaataacttaccgccataagcaaatgtgcccagatggcgggatagtgggggcgctgtctgcaaacaacacgggggccccaactggaggatcgccttgggagacaccggtg

SEQ ID NO: 516366 - DNA, 431 bp, Homo sapiens
  misc_feature (35)..(35): n is a, c, g, or t
tctgatggctgttctccttaaaggagtacgagagnatcctccctcaggattgctatcccaagagagtggaggcttttctcctgtagctccttttcaaaggtgcaagtgccttctgtgctttctgctctcatctggaggaattctgcccttacctactcacctgtttttttctttattacaaagcaggcacagggctgccactgactacacgatgatgggaggatggacgccgccttcaggagctggaggagcagaagacgtgaacaaaggtgctgtccaggcagaggcagaaatcatggtcagatcccgaggaagagcaagacgagttcaactgtgtcctgaggcctccccagaaactgagaagatgccagagtcatgcctcctgtacagccagcagaactgtgagccaattaaaccttttttgtttaaaa

SEQ ID NO: 516367 - DNA, 875 bp, Homo sapiens
aggcccagccagaacaaaagaactaaagaagtaacaagcaaaacgacaacccatgaaaaggggcaaaaacaggagagagcttctcaaagaagacaaacatacggccaataacatagaaaaaaaatgggacatgtgatcatagagaaatgcaaatcaaaaccacaagtgagataccatctcatgcccatcagactagctattattaaaaagtcaaaaaataacaggtgctggcaaggttgcagagaaaagggaatgcttacacaccactggtgggaatgcaaattagatcaaccattgtggaaaatagtttggcgatttctcgaagaacttaaaacagaactaccatttgacccagaaatcccattattgggtatatactcaaaggaatataaatggttctaccataaagacatatgcacatgaatgttcactgcagcactacccacaatagcaaagatatggagtcaacctaaatggccatcaatggtagactgaataaagaaaatgtgatacatagacaacatggaatatgcaacataagaaaagaacaagaccatgtcctttgcagcaaggaagtgaaggagctggagcaagaccatgtccttcacagcaaggatggatggagctggagatcattttcataagcaaactaacacaggaacagataaccaaataccacgttctcacttataggtgagatctaaacactgagtatacatggatacaaagaagggaacaacagacaccagggcctacttgagggtggagggtgagaggagagggaggattgaaaaattacctgttgggcactatacttattacctacgtgataaaataatctgtacaccaaacccttacgacacagcaatttacct

SEQ ID NO: 516368 - DNA, 1011 bp, Homo sapiens
ggtcagcaaagccatggtggtcgccccgatgtgcttcctcagcgattcaagagggattgtcattcaacagttcactgtcttgtaacaatagagtgcttgtatgactttaataagatattagagaataggtaagatccatgggaacgccccttgcaaaaactggtgcatgagaaaatcttggatgatgtagcagcatttggcaacctagactggaaagttgccaaagagtgatacccaaatatgtctacagaggaccttatcgaggaaatgacagttgagtgcaagacgaatttatatgcactgaacgatatccagatcgttcgttccccacgtacgaggtcgaaagaaagcagggcataagccattgaatacgaagtgcactgcgctctcgagaagatccagtaggtgccttggaactcgaaacataggggacgggtaaccctcacctacataattcaacgaggggtacagaggaggggcagcgtcgattcccagaggaatttggagttctacgagaagtggaattcctcgaagacacttgtgagtttgtacgaacgagggcatgaaaatactttcccctgcgaaatgtaacctgattacaagacaagggtatcctagtcggctcgcatcatcaaagggtcggagagacgaatagaatcggtgtatactgggcgaacttttaagtacctagttcctgggagaaagttgggggggccacacacgtaacgcaaacggggaggcccataagcaaccagggaacggctggcaacatagccaaagagaccgaggcaaggtgcccataaagtgacgaatcggtctccataattggcgtgtgcaagtatacttcctgccttggatagataggatgaagggggctaatttgtaaggggaaaaatcatgtagcacaagaaaggaaaggaagagaaaccaggaaaaaagattggatgaagatcgatttgatgagaaggcagtgaaagaatctttggattgtgaagaatagagataatatgg

SEQ ID NO: 516369 - DNA, 507 bp, Homo sapiens
tccaagaacagacactctgggttgtcgatctgcggggcttccactcacccttgtatcagggttctgaatgcactgggggttcccagtctccgtccatctcttcatcccagtcctcgggctcttagcatcagggtcagggatatgctcgggcttgtcccagtcctcaggcttggagtctgtgggatcatcgatcttggcccgctcatcccagtcttccggttttgaagcatcaggatcctttatcttcttgggtggcaggaagtcccattcgtcttccaaggagccgaactccacctggttgttgtcaatcttcacctcataggtgttgtctggccgcacaatcagtgtgtacaggtgtgtaaactcatcatccttgcaagggatgtccttgtggatcagcacgtccttgcccttgtagttgacgatgacatgacccttcttggtgccagcgccacagatgtcggcaccaaacatgatgttgtatcctgagtctccgtgcatgtctgt

SEQ ID NO: 516370 - DNA, 147 bp, Homo sapiens
aaacttatcactatatgcatcttatattttaagattattagaatattctaggtgccacatattaactatatgttgagtgggctgtaattaacgaatgtcctttcataatatatcatactatatgattttacattttcgactgcacgc

SEQ ID NO: 516371 - DNA, 980 bp, Homo sapiens
  misc_feature (980)..(980): n is a, c, g, or t
gcgccctgttactgccctggagatttgggcctctctccctccttcctgcagttcccacgcctgagggaggggatgcggtgcagtgtacatccgtgggcagctgtgacccctctgactcatccgacgggtgcagctcaggctccctgctgccacaccggacccccccaggcggggatttccccaagatgagaaatcagcctaccggaagtcacgccgagacgcttggacagggcatgacatgaggctgggaggagttctggagctgcagagtcccctcaaactgtgctctcatctcttgctctggggtaagccagtggccatgctataaggacactcaagccaccctatgtaagaagcccacatgaagaggaactgagatatctggccaacagccagcacgagtcacttgagcctgccaaccacagctgtgagcaggtacctccagcaccagacaccctgaagacatccactgaaaagctcaatggcaagcctcatgaggaccctggaccggaaccaaccaaacgaagcgggtcctgtattacctgatttgacagaaactacgggatcaataaatgcttgcatgttcagtcaacaaaaaacacacagcaaacaaacgaataaaattaaaacaaaaagaaaagagagagcagtgcgagaagtgaatagacaagaatgtaaaagagagaccagagacgctgagtaacagcacaagaaggcagatgatgatgaacatgagagggtgctcctaaagataacacgcacatataaccgtagcacaagagcacaaaaagccatagaacaccataaggacgcattatcccagaaagaaaaaacgatcagcagcaataaagcctagagagcaactaatacaagcaaatataacatgaagagacgaagaagagaagacagaagcacactatacaaaacatatctgaaagagagacaaaaaacaagataatagcgaacagccacctacaagn

SEQ ID NO: 516372 - DNA, 113 bp, Homo sapiens
ttcatcggcacttagacaattatttacatccccctcccagaagaagtggataaaccttcaggcctttcaggagtcccttctccagattgctcattggtgcctgataatagcga

SEQ ID NO: 516373 - DNA, 288 bp, Homo sapiens
  misc_feature (17)..(17): n is a, c, g, or t
  misc_feature (29)..(29): n is a, c, g, or t
  misc_feature (48)..(49): n is a, c, g, or t
  misc_feature (165)..(165): n is a, c, g, or t
ggggggccgaagaaacncccccccctgancctacatgccaaacggccnnagtgttggctggacctgcgccgaccccttcagccgccccaacagcggcccggcgcccggcgcagtggcccgccctgtggggcgcaaggggggcggtgccttactaccctgtgtcgntctgcccccccttgaggaatactggcgcctgtctgaaaggcccaggccccccgggtcccccccctttagttgcatgagtttttctttgttcatggaatgttttttccttattaaatgttgggg

SEQ ID NO: 516374 - DNA, 593 bp, Homo sapiens
accccggtctctgtggctggagattcgagtccatgagaaccagtctcagtgtaggcagacggaatcacagtgcaagtagtgccaactggtacccatttgagaatggaaaattttcaatgttccctcccaaaggagtccagataaccacacaaaagaggagtttgctgattcagtccgtcgcgattctccaataggatgcatacagactgtgaaataagaacgttatttctgcaaccgattacatggagtaagaggccaagtaactctaccagaccaactcatggttacaagtttatctctagtgtttatagacatcttatggtccacggtatgtgtgggactgcacctacaagcagaagtgttgcattaaatcaacatctaatctttaactagggcctagggtctggaaagatttctctagagtcttggaaagtttctgaatcttaagacaggctgaggtgaatgtgtaagaatgctattattattcgatcagactttaggatctgagaagaccaaggcagggtcttaatgggttcgttttcgcattccatccctgatactcaggcaccagtttctccatttcttcaacgtgt

SEQ ID NO: 516375 - DNA, 242 bp, Homo sapiens
ctcaacattctacttctgacgtggtatcagagacgatgctgtagactggaggtgtaaacatggatcagaggaacagcggcctctcgagtgttcgcagtctgactgggactcactctccggagtacctgggattacaagcgcccgtcatatatgcccagctgactttttgtacttataagtggtgacagggtatcaccatgtggaccaggctgttgtcgaactctgaccccgtgattcaccca

SEQ ID NO: 516376 - DNA, 251 bp, Homo sapiens
  misc_feature (24)..(24): n is a, c, g, or t
gccccacccagcgactggattttnttctgcctctctgtgtgggtactgtgtgtgatatctgtaaaaagtgcgctaattaatttggcctaaagaaagacaagaacttggatcaaattttttttaagggaagttaaaagctgtggtatctttcagttcacatgactttaatctctgagaaataaaaacagccctaaagactattggtaaaatgcaggtgagatgcaaggttttctaagtgttttgaggttaaa

SEQ ID NO: 516377 - DNA, 267 bp, Homo sapiens
cggtctggatcgagaacagccttcacggtgtgtagctggcctggagcagtggctgtctgccatcgaggtggaccccgccattgcccaggcctgcgcgccgccccatctgatacgcatgctggcctttgccgcaggccactgcagcccgtgcgcgccagtggagaccttgcgcgcgatgcggcgctcttccagcatttcggtcccgcctgaggacagcgccatgacacagccttgcaacagacgtactcatcatcggcgccggcctgg

SEQ ID NO: 516378 - DNA, 130 bp, Homo sapiens
gatacatatcccagtacagatgggaaatgaactacatatgagatgctgacagaccactgcctcttacagtaggaaacaagtgaacccatcaataagaaacaaggatcgaaagggacccagcagctccctc

SEQ ID NO: 516379 - DNA, 124 bp, Homo sapiens
ggaatactcctgcggctgctggtcttacattacataagcccaaagacaaactccgagccctgcctctggtggttatctttacaatactatggtgacttgatagggtgtgagtgagatggatcaa

SEQ ID NO: 516380 - DNA, 439 bp, Homo sapiens
actctgttacccaggctggagtgcagtggcacaatcattgcccactgcagccttgatctcccaggctcaagatggtcctcctccatcagcctcctaagtagctgggacttcaggtgcgcaccaccactcctggctaattttttttttattttaatttttttcagtagagattagacctcattatgcccaggctggccctgaactcctgaactcaagcagtcctcccaccttgacctcccaaagtgttaggattataggcatgagcccctcacctgactacctctattttcttttcttttctttttctttctttcttttttttttttttttttttttgttttttttgtttttttttttttttttttttttttttgggggggttttccccccggggggggggggggaaacagggggggaaccgcttgttgaaaaacaaaag

SEQ ID NO: 516381 - DNA, 759 bp, Homo sapiens
  misc_feature (31)..(31): n is a, c, g, or t
  misc_feature (90)..(90): n is a, c, g, or t
  misc_feature (139)..(139): n is a, c, g, or t
  misc_feature (166)..(166): n is a, c, g, or t
  misc_feature (183)..(183): n is a, c, g, or t
  misc_feature (309)..(309): n is a, c, g, or t
  misc_feature (437)..(437): n is a, c, g, or t
  misc_feature (463)..(463): n is a, c, g, or t
  misc_feature (631)..(631): n is a, c, g, or t
  misc_feature (636)..(636): n is a, c, g, or t
  misc_feature (651)..(651): n is a, c, g, or t
  misc_feature (665)..(665): n is a, c, g, or t
  misc_feature (670)..(670): n is a, c, g, or t
  misc_feature (681)..(681): n is a, c, g, or t
  misc_feature (706)..(706): n is a, c, g, or t
  misc_feature (734)..(734): n is a, c, g, or t
  misc_feature (747)..(747): n is a, c, g, or t
  misc_feature (750)..(750): n is a, c, g, or t
  misc_feature (756)..(756): n is a, c, g, or t
aaacgagtttttatttattcaagagtaaatntccaggtgtagaaagaggccacaagttaatgttgttaaaaaaaaaattaaacatctgcnaaccaagtcctgcatttaatgaaaccacctaagaaagaaaaagagaaangagaaaaccactgagaaccagcaaccnggagctcagtttctgcnacagagcacctcctcttcaacgaattattggataccattggagagcaagttactgtggtggaagcagcagaactggaggggctgttaagagttttagcagatttattggccagaggcaccgaactnaatgaggcacttagagatgagaaacgatctgtactgggatttcccagcggaagagactttggtttttgttatcctgaagtggccacttcacctccagttttatagagggatattcgctttttactggnagtttattcaggtagctataggtctngtttttttggatagggcagttaatttcacttttacaaccatcaggctcaggaatgggaaagggaactgggacgcccattaggatgccatggaccagggccttgctgcttttagactgaatattgctggtgaaggtgagattgaggctgtgagaatgttctttgctcanctggnagggttgggtggggnatgggctcaaattnacttnctttataactncatccacagaaccgcagtccttganctgcaccggttcggcctgggcagcggtnctgaccgccaggngcnggaatnttg

SEQ ID NO: 516382 - DNA, 509 bp, Homo sapiens
  misc_feature (1)..(1): n is a, c, g, or t
  misc_feature (92)..(92): n is a, c, g, or t
  misc_feature (133)..(133): n is a, c, g, or t
  misc_feature (279)..(279): n is a, c, g, or t
  misc_feature (349)..(349): n is a, c, g, or t
  misc_feature (497)..(497): n is a, c, g, or t
nttgagcatgggagtgctcccatttgtttgtgcatctatgatttctttcagcagtgtttgtagttttccttgtagaggtctttgactccttngttaggtatattcctaagtatttttttttttggcagctgtngtaaaaggggtggagtttttaattggattctcggctgggccacggtgggtgtatagaagagcttctgattggtgtacataaatctggtatccagaaacttggctgaatcctttaatcagttctaggagctttcgggaggaggcttnagggtttccagggtaaacgatcatatggtcagcaaacagtgacagttggacttcctctttaccagttggnatgccctttctttcttcccctggtctgaatgtccgggctaggacttccagtactatgtggaagaggagtggtgagaacaggcatccttgtctggtactagttctcacaggtaaggcttcccacttttccccatccagtataaggttgnctgaaggtgtgt

SEQ ID NO: 516383 - DNA, 409 bp, Homo sapiens
tcagtataaagtgaaaaattctaaaaaatcacaggaatggccaggcacattggctcatgcctgtaatcccagcactttgggaggccgaggtgggtggatcagtggtcaggagttcgagaccagcctggccaacatggtgaaaccctgtctctactaaaaatacaaaaaaactagctgggtatggtggcgggcacctgtaattccagctactcaggaggcagaggttgcagtgagccaagatcacgccactgcacttcagcctggtgacaagagcaaaactccatctcaaaaaaaaaaaaaaaaaaaattccggggaactactttggaccaggttgtttgacagaacccagtgaccttttccatagtgatcaaggcacccaaaagcgggtctttctagactgatctatag

SEQ ID NO: 516384 - DNA, 581 bp, Homo sapiens
  misc_feature (15)..(15): n is a, c, g, or t
  misc_feature (26)..(26): n is a, c, g, or t
  misc_feature (50)..(50): n is a, c, g, or t
  misc_feature (55)..(55): n is a, c, g, or t
  misc_feature (61)..(61): n is a, c, g, or t
  misc_feature (88)..(88): n is a, c, g, or t
  misc_feature (105)..(105): n is a, c, g, or t
  misc_feature (112)..(112): n is a, c, g, or t
  misc_feature (122)..(122): n is a, c, g, or t
  misc_feature (124)..(124): n is a, c, g, or t
  misc_feature (129)..(129): n is a, c, g, or t
  misc_feature (139)..(139): n is a, c, g, or t
  misc_feature (150)..(150): n is a, c, g, or t
  misc_feature (158)..(158): n is a, c, g, or t
  misc_feature (164)..(164): n is a, c, g, or t
  misc_feature (166)..(166): n is a, c, g, or t
  misc_feature (183)..(183): n is a, c, g, or t
  misc_feature (193)..(193): n is a, c, g, or t
  misc_feature (197)..(197): n is a, c, g, or t
  misc_feature (200)..(200): n is a, c, g, or t
  misc_feature (213)..(213): n is a, c, g, or t
  misc_feature (229)..(229): n is a, c, g, or t
  misc_feature (234)..(234): n is a, c, g, or t
  misc_feature (256)..(256): n is a, c, g, or t
  misc_feature (266)..(266): n is a, c, g, or t
  misc_feature (277)..(277): n is a, c, g, or t
  misc_feature (284)..(284): n is a, c, g, or t
  misc_feature (297)..(297): n is a, c, g, or t
  misc_feature (299)..(299): n is a, c, g, or t
  misc_feature (323)..(323): n is a, c, g, or t
  misc_feature (336)..(336): n is a, c, g, or t
  misc_feature (347)..(348): n is a, c, g, or t
  misc_feature (353)..(353): n is a, c, g, or t
  misc_feature (371)..(371): n is a, c, g, or t
  misc_feature (391)..(391): n is a, c, g, or t
  misc_feature (398)..(399): n is a, c, g, or t
  misc_feature (422)..(422): n is a, c, g, or t
  misc_feature (440)..(440): n is a, c, g, or t
  misc_feature (459)..(459): n is a, c, g, or t
  misc_feature (493)..(493): n is a, c, g, or t
  misc_feature (509)..(509): n is a, c, g, or t
  misc_feature (532)..(532): n is a, c, g, or t
tgggtctacagtaantttattgtaanaaaaaaaccaggccgcaaaaagtntacanggttanagcagaagggggttctttccagtgggngaagcctgaacccagcnagcagcncgcaaagccnanaaaancccctttccnggtaccacccngcgccgcnggactnanagtgtgaaaagagaggntgcacaccanaatnaanaaagggaggaggnccaaccgggcagaaanaacancccaactggagaaacttgcacnaacattcaanaggatgccganaaaaagnacagtttcccacncnccactattctttgctgaaaagggngagggtacggcancagcagaaaannatgtncttcattcttaaaaaaanctcgaaaggatggagtgganggtcaannaagcagtagaatgggatgaaaanctgcaaaagtaaaaaaanctttgcgtgtaaggaaaanaacggcaataacaagggagaaaagagagccttcnctttttcttaaaaaanaaaggaaactgcattatttcccntgctggagtggcagcagcctcattggttttcataaaacatcatttctgc

SEQ ID NO: 516385 - DNA, 769 bp, Homo sapiens
  misc_feature (386)..(386): n is a, c, g, or t
tctcagctactcgggaggctgaggcaggagaatcgcttgaacccaggaggtggatgttgcagtgagccgagatcccgccactgcactgcagcctaggcgacagagcaagactccgtctcaaaaaaaaaaaaaaaaaaaagaaaagggaagggaatcccatttggtgatgattggggcaccctacttgagctggaggcttagcagtcgacaatgattttgggctggtctctgacctggaagcttttggaagtaagggttatggtctcttccctgaaagcttggttaatagtgggtaaattgggtggagttggagcttggagctggtcttagaaatataagactggtccacctgggggggacgggagacgctatattaggggagaacncccggtgtgttaacctcaagaattggctgacagagaaacggtgcgcctttttacgcccaacgccaaaaggtaacagatttaactattttctaagaacgggttgggacacacggaaggtcattgggcttcttggttgcccctctcacagaggcaaagctcaagggttgagagctctccataagggggttttacccccattttgtgagcggtttataatataatttcgccccgagggtttcctttataaaatattagctttaaaaacacccttattatttttgaggagacccattttccccgtaatttcacagggagaaaaagggcacacaaacaagaaaacaaagcgcggtccattttttaaaaaaccccctgggggagatatg

SEQ ID NO: 516386 - DNA, 461 bp, Homo sapiens
atggatcccctgctttgcagctgctgacggcagcacgaaaacggagatgacttcaggtcgtggctgagaatggcctgtgcgttggtattgcagcttggagctggaagaagagcagccagaactgaagatgtgtggctacaatggctctgtcccttctgtggaatctgttacaccaagaggtctcagtcctggtccctgaacccacagtgagctgtttagatgatccttcacatcttcctgaccaactggaagacactccaatcctcagtgaagactctctggagcccttcaactctctggcaccagaaccagtgagtggaggactggatggtattgatgacacggcgctgatgggtgccgcggacaagctggctcttgaagacaggcctgtgatatctggccttgattggccttccctccataatggtactggcttcaattactggccgatgaaaatcaaa

SEQ ID NO: 516387 - DNA, 510 bp, Homo sapiens
taaggttttaaaaaactaatttggcttttgttaaaatcaaaaggggggaaagttgttttttccaaaaaattttgaccaagtttgggtccaaaaaaagcgggataaaagggctttttttctacaattttgtggggacacggattggtggtaaaaaagaataactttttgtcttttgctaaaaaaaaagatatgggggaacaggattttgtggaattcttatagcgggtaaaaaaacctttcttttggggtaacctattagccggggcacttttttgcttctcacatttgggggttcaattacctgggaacttttggacccatgatcctcgttgcctcccaaacgaaacgcccctttgtgaaagtgtcttttgctccggcccaaaaagtatagctcgggcgagaacacgcatgattgcccaggccctttttggcgagtggggggtattaatgagaagaagacctgcgttgtataatcttaacagctgttgtacgaacgcaaagcccgcatac

SEQ ID NO: 516388 - DNA, 1108 bp, Homo sapiens
gcgcccgcgccctccgcgccttctccgccgtggacctcgtagcgaaagacgcccgtccgtccgcccagtccctcgtcctccctgcccacgcgggtcagcaccgcggccgccaccccgaccaccgttgcgcacggacctgtccgttgcacaccagctggtcggccgtcttcgtcgccgcgctcgccccggggctacttcgctgcgcagccacaaatgagctcccgcattcgccagggcgctcgcctttaggtcgtcaccctttctccacttgagccaggctggcgctctccacctgccccgctgcctgctcaactgccccctgtgagtggcgcccaaagtgcgcgccgggaagtcgggcctgtgtcctggcgcacggactgctgagctgctggtacagggtcatagcgccaagcagtttcaacgaggatctgcagcgagaaagcgcagtcccatgcgagcacacacaagggggctggactgcaacttcggcgccaagctccactcgctctgacaggggatctgcacgagctcatgtcaagagggcagacccgtgtgcaatatgacgctccagaaatctaccaaaacgggggaaagtttccagaccagactgtaacacatcagtgcacgatgtattcgatggggcagtgagggtgcattcctctgatgtcccaagaactatctcatccgcaactagggcatgtccgaacccttcggactggtcaaaggtatccgcggcagtgctgcgaggagtggcgccgagacagaggatcgtctcaagggaccaatggaggcacagccacggcccttgcaaggacctagagtacacagacaaccaaggctgagtacatagaccacagggaccgcgtgccaatgcgaaccgcacccacatgaacgagaacacgggattgggagagggacaccgcgatgggacaaccctccaaggcacaaacggctggtcacaacaagagcgacccgggacaagccgaggaagagcaatcaacgaggcacgcacaaaaagcgccaggagacacgcacgtggagcagctgaaacaaacgagaaactaagagtgggcagtgaaacgccagaacaatgagggagtagaaaaag

SEQ ID NO: 516389 - DNA, 306 bp, Homo sapiens
tgcgttcgcaggacgttggacgaaagaagtgactatctcacttgcaggatcaggccgaggggcgatggcaacatgcacatcaccctctgttgacttcatcgtgccctggaacacccttagcagccacccagaagaagagcctgaaccacaggtaccacatgggctgcgagtgcaagatcacgcgctgccccatgatcccgctgctacatctcctccccggacgagtgcctctggatggactgggtcacagagaagaacatcaacgggcaccaggccaagttcttcgcctgccctgcgaacctatga

SEQ ID NO: 516390 - DNA, 1148 bp, Homo sapiens
caatactccgttgcactgggtttgctccctgattaaagatgcctatcaggccaagaccatctgctcccatccttggtgaagtgtgacttcgaattagtttgcacttcctattggataggtagagcccactgctcattgtataatgccccgaggcctagagtggcagacaatgatgccgagtctgaagccatcctctcatgcctgttcctcccaataggccagggtggccaggggtggtgagggcagttctgagccaggcaaacacataacaataaaaaccaaactctgtggtcaggcaaacaaaaaaatagagggagagctagaacataaaacatacactgaaacgacaggggggccggcgctcgcaagcaagcttgccaccgcaggagcgtgtgcaggcctgatatgatatcctggccaccgcacaattgatgaataacaagcgggacccccctgagtagatggcgtcaacataaagaatgacaggtaagaggaggccagagaaggaagtaagtgaacacagtcgagtaggagtactaagtggcgcaaacattgcagttgaaaacgcgcgcggaagattccccagttgttgaagatagggagcagaccactgacatacacaggccgggagggggggggacgacaatacaatgtctttgggagacaacagtatgtatgcctgtataaacgaacgtacatattaacgttggattatccacaaaggtagggataggaaataaaagatagcgacgatcggttacttggacgaacgatgaagtacgttggtgtttgtagaacataagcttgcaagtacggagtgaaagcaatgcgtacatggcagtgaaagttagaagaaaaaaatgagtgagcagcgtgaatgaaatgagagtatatactggttgttgtccctctgtagcaacaaaatttatattctacacagaaaaggtggagcagcgaagtgaacaggagacagtaaagaaacatggcagagtgaaaacgaaatttgaaatgtaaaaagaaaggactatagaccgtccccaaagtcgatggagagagagagacgataacactcgaaattgagacaaggaatgtgcagactgagtagaatgtgaaaatatctaaagagaaaaggaccagtgctagaagag

SEQ ID NO: 516391 - DNA, 320 bp, Homo sapiens
taatacatgggcgactgcttcaacaagtcagtatcacaagtgaacggaagtgggtaggctgttcttgttaaaagagacaaacggggctgggcatggtggctcacgcctatatcctagaactttgggaggccgaggcgggcagatcacttgaggtcaggagttcaaaaccagcctggccaacatggtttagtagaaaccctgtctctactaaaaatacaaaaaagttagctgggcgtggtggtgcgtacctgtaatcccagctatttgggaggctgagaaacggctaccacgtccaaggaaggcagaagtgcgcctgggtg

SEQ ID NO: 516392 - DNA, 725 bp, Homo sapiens
agattcccagggctagtccagttccaaggaagcagggttctacagttgtttgtcctgaagggcaaggtacccagttcagccaatgccgttttcctgggatatgggggtgccatgttggctcatccctggcaggtgtggctgctcagctcagccaagacactgattccctgtgaagcagggcagtgcttcagctctcgtgcagtggggggtgtgactgcttagactggccaagacactgattccctggaaagcagggcaccaagtcagctcaggctccaaggggcagggcacaatggcagctgggaggggaggggcacagcagcgtggccccgcaggtggggtgtatgctgtgatgtggacatcatttgttcccaccagccatttgaaatttcatccatttgaaatttgattccaaatgtggtggtgtgggaggtggggcctagtgggaggtatttgggtcacagggcagatcctttatgaatagattaatgccttttcatgggactggattagttaccaggagtggattgttatcagagtgagttcagcttcctagactctcgtgtttcctctcttgccatgtgagccccttgcatacacctgtttccccttccactttccctatgagatgaagcagcacaagaccctcgccagttgtgctgcccaatctcggacttttcagacacaagcagggtgagccaaataaaccttttttataaaataaa

SEQ ID NO: 516393 - DNA, 306 bp, Homo sapiens
ccgacctgcacgctcatacccctgctgtctttaaaatagccagttggaattatcttagactgtgcggtccaaccctacccaataggggaaaaacaagcagtagggactagctgcattaataataagatccccttctcctcccttgtctggtgtgctcttgccattgctccatccgtgagaggcacccttttatagaagtaaattgccttgctgagcaaacttttgcctgagtgctatattcacttggcagcaccgagcatttacttccaacaacatcaagtctaaaatgttgttctctaaaacctc

SEQ ID NO: 516394 - DNA, 527 bp, Homo sapiens
acggctcgggcgccccacgcccgccttccttcttctcccagcatgccccccccacgtgcagcacagcgcggcacgcagtcgacaggaaagggacggagccaagatggggggcgaggggacgactcgttgtaccccatcgcggtgctcgatatgacgaacgtccgcaattgaggacgttcagtcttcgcctcagacagcgatcaagaagctgtccaccatcgccttggcccttggggttgaacggacccgagaggtgagcttcatgcctttccttacagataccatctatgatgaagatgaggtcctcctggcctggcagaacagctgggaaccttcactaccctggtgggaggcccagagtacgtgcactgcctgctgccaccgtgggagtcgctggccacagtggaggagacagggtgcgggacaaggcagggagtccttacgggccatctcacacgagcactcgccctctgacctggaggcgcacttgtgccggctagtgaagcggcatggcgggcggtgactgt

SEQ ID NO: 516395 - DNA, 424 bp, Homo sapiens
  misc_feature (303)..(303): n is a, c, g, or t
  misc_feature (319)..(319): n is a, c, g, or t
  misc_feature (414)..(414): n is a, c, g, or t
tcgggcctgaccaatccagacgaggcagagagcagcagcgactcaagggccgtgtgtacatatgtaaatgagaaatagacatgtcaacaagatacattcatttctcccggaatgtgtattgtttttattttacaaaacagagaaacaacaaaaggcttggaactccttcattctacgtggaatactagatcccgtttgttagccttcgtgactccgtccttgtctcctgtaatatactgaccctgtgtgcagaggcgtttttgttcccttttgtttttatttttacctacatgtactatttancttcctgtgtcctggncctgccacctggtgtatttttaagggtgccaatgggaaaccaatggaagaggaaaccggggggatttcaagaaggaaaatttgtaaccaaattcnatataccttt

SEQ ID NO: 516396 - DNA, 271 bp, Homo sapiens
agcaaggcaaccttgatatcaccagcgatcaaagaagcatccaaaccaccagcagaactaattttatcgaaggcttcaatcataccgattacagtacccataaaccctaacatcggagcgatagagataaatagggaaatccaagaaacgtttttctctaattgtcccttttggacaccgccgtaagataccactgatttttcgaccatatcaataccttcaccagcgcggtctaaaccttgatagaagatagaggcaacagggccttttg

SEQ ID NO: 516397 - DNA, 424 bp, Homo sapiens
  misc_feature (399)..(399): n is a, c, g, or t
acctgcactagccttagacacggatcttgcgctgcttatgcgatctggtctgtgggtgacaccatgggcatgcctgcgcacatggctgatgacttccctggaccctgccaccttgagtgatccacacatggtcttaactatgcttaacctcatgccactagtgaagagcgctcttggacattacgaggtgatcgccatgctatgcttgctatcgaccgatgtccttgattacgctttgatcttgacggaggagcgggacttgtgcaactgatgagctatttatagcacacctatacagatgctgtgtctatactagcgctagacactcgactaagattgttatgctgtctctccaggggacccagcagtgctcattctcgtgcgtgtgtgtgtgcccgngtccctgtggcctatagtgagtcgg

SEQ ID NO: 516398 - DNA, 146 bp, Homo sapiens
tggcagggaagggtgcctggctgggctttggggctggtgggataggagggtgcccctgggaacacagtgcccaagcgaactgaggccgccaaaggctttgagctgctgtaccagcccgaggtggtacgtctctacctctccctcct

SEQ ID NO: 516399 - DNA, 149 bp, Homo sapiens
cgggtcgggagtgggtaatttgcgcgctgctgcttcttggtgtggtagtcgctccttctgattcccgtcaccgtgtatatgatagggcagacgttcgaatgggtcgtcgccgccacgtggtggcgaccccatttcgtgcatctgaccca

SEQ ID NO: 516400 - DNA, 213 bp, Homo sapiens
aatttccgctctctggggactgagtggggaccatccttctgaccatctaaaacattttaaatcgcgggttttgcccactgtgtgttccttaaccttaggggttccaactgccaaagccaccagagcccccttctgttgaggtggagtactacaccattgccgaattccaatcgtgcatttccgatggcatcagctttcggggtggacagaagg

SEQ ID NO: 516401 - DNA, 505 bp, Homo sapiens
gttgacatgtgagctacagccttcgtgcatcacataaccagcggagagcctgctcttgggatgacacaccgatcatcgagagcatagagaggtatggctctgcaattgtatctctgtctaccatgccacgtgcttcccaactgcatgaggctctgtggtagagttcctgatgactaaagacttttgatatgaagatgatacatcgttgggagtgataattgttcatctagtcacagaaccaaagccaccacagttgatgtgttcttccaggatcacatgaggtctggtatgctataagaccatttgctcattgcgaagagggtgtactgaaagatccagtagcttgacactatccagtgtttcacgaggtggggtgtgtccaataagacactgaggaaatcacagctgatgactgatctctatgactcggttgccagcctacggtctcgtggtagtaatttgagatgcatcatcatactcacagagcattgccggagttatctgc

SEQ ID NO: 516402 - DNA, 223 bp, Homo sapiens
gcatagtactatagtaaaaagtgctacagtaaccaaccacatttaagaaagagtacttagtagagaaacaataagacaaaataccaaaggtagtacacaataaatttatgtatacagctacatgatctaaaagtaacaggtcccaggagacccatcctggaacttagaaagtgtatccttcagcaggtagtctctggtacaacgcttttgatcttcctcttcc

SEQ ID NO: 516403 - DNA, 328 bp, Homo sapiens
  misc_feature (198)..(198): n is a, c, g, or t
cccgggaacccctttgcccccttgggccttttttggggcccttataacccggtttgcccaaaaaccggtgggtgccggggcggaattcccgggttttttttacccccggggccccccccggggcccatttactgggagggggtggtttttcccggggggggaaagcccccaggggtttttggggccccccccaaaagnctaaagaataatgccagggggggggggtttaaaccccccccaaatttttaaatggaatttttttttcccatttttcccaagggggggagaaaaggggtcccggggggcccaaaagcccgggttaaaccca

SEQ ID NO: 516404 - DNA, 374 bp, Homo sapiens
  misc_feature (37)..(37): n is a, c, g, or t
  misc_feature (76)..(76): n is a, c, g, or t
  misc_feature (165)..(165): n is a, c, g, or t
  misc_feature (242)..(242): n is a, c, g, or t
  misc_feature (371)..(371): n is a, c, g, or t
gaggacctgagctcctggaccgcggcggacacccgcntccagatcacccagcgcaagtgggaggcggcccgtgtgnggacagggacagagcctacctggagggcctgtgcgtggagtcgctccgcagatacctggagaacgggaaggagacgctgcagccgcggnaccccccaaagacacatgtgacccaccaccccatctcttgaccatgaggtcacccttgaggtgcttgggccctgggntttcttacccttgcggagattcacacttgacctgggcagcgggatggcgaggaccaaatttaggacaccgagtttgttggaggccagaccagcaggagttagaacttttccagaatttgggcagttttngtt

SEQ ID NO: 516405 - DNA, 967 bp, Homo sapiens
cggacgcgtggtgtcgggccagagcatagtgtcctcgatctctggaggactaaaccacccaaaggccaggcccccactgatagaagctccagagatggaacctccaatgagcctagtcatgaaggacagaaaaagcagaggactataccatggagatcaaagtcacctgagattctgtcttctactaaggcaggctgtcaggatgaggaccagtgggacggtgcgcaggccatggaaaacagaaccacctggctagaccctaggaagccaggagaggatcaggttccaaatggggaactgctagtgatacatgggcatgtgagacaagaagctcatcctagcctccctgaccagctctggcttctgctcctgcccctggtccatagtgtgactagtggggccagtgagaagctggagcagagagctggcatgagtatagggaaggaggatcgtgacacatttgcaatcctctgtcctgtagctcatatccaaatttgtggataagggggccggagtgcagtggcctcacacctgtaatcccagcatcttttgggaggccataggtgagtggatcatctgaggtcagaagtttgcgaccaggctgaccaacatggtgaaatgaaaccccatctcaataaaatataaaaattaggcaggcgtgtggtgcatgcctgtagtccccaggtactcgggagggtgagaccggagaatcgcttgaaccccaggagattgggatttgcagtagggcagatgatgccctgattccagcctgggctacagagcgagaccggctcaaaaaccaatggttggctaagagttcctgcggacgtaatgagaagctgtggaaaaagggtgcttatttaacacaaaagggggccgaaaaccggggccatcacccttgaaggcaagataaaaggcgaacgtgaaagtgttgcttgtgacaaccatttgttgtgtaacaatatgt

SEQ ID NO: 516406 - DNA, 150 bp, Homo sapiens
ctgagcagaagatatactgatattgcaaatacaggtgattgctactttcttctttgaactttcctgattttttaacttaaaaaacacttattcacacagtgttaccataatactattaatttttaaaatgattgtatacctttcccatat

SEQ ID NO: 516407 - DNA, 675 bp, Homo sapiens
attgagcacactttatcagtgtattaggtttccagtggtagcaatgggtgtgctgaagctgggtggattggactgtatcagaaccaaggtactttcagctgcagactgaccatacccctgtccacctggcgttgctggatgagatcagcacctgccaccagctcctgcacccccaggtcctgcagctgcttgtaaagctttttgagactgagcactcccagctggacgtgatggagcagcttgagttgaagaagacactgctggcacaggatggttcacctgtcctgagctcgcaggttatgctacttccctgtctgctcagccttacatccgacacagtgctctgcgccgcacagctggcacactgcacacttctcactcacttcgctatctttgtcacctgcagcgctgctggacgctcacttgctcctccttatacctctgacttcgtgcaacttttcctccccatcctggcagaatgacagcatcgcaggtaccatcaaaacggaacggcgagcactgaccctgtgacggcagctctatagctcactgcaaatctaacttcatcatggtgaactaatttagagcatcctccagagctgaagcagaacattccagaacccgttgtggaaaaaccctttcaagaagctgttccagaggctcgggcagcgtctt

SEQ ID NO: 516408 - DNA, 287 bp, Homo sapiens
tagctggattacagacatgcaccaccatatccagctaaatttgtatttttagcagaaacgggggtttttcatcatgaacaacatgctctcaccctcctgacttaagaagatccatctcccttgtcctcctaaagacctgagattacagccggcccctactccccccccttttctaatttatgaaaaacctcccctaggctgaaaccccttgtttttacactccatccctcatctgatcctcccagagggccacctttgccagcatgcccagcagccccttttccttt

SEQ ID NO: 516409 - DNA, 398 bp, Homo sapiens
gcggttaccgactgcatctgtgctcaaaacagtgctcttaactcacgcctattcccaaatctataagaaccagtgataatcacaccaccctttgtgactcctttttcggactcagcccgccgcacccaggtgaaataaacagccatgttgctcacacaaagcatgtttggtggtctcttcacacagacacgtgagacaggagttcgagaccagcctggccaatctggtgaaactctatgtctctactaaaaatacaaaaattagctgggcatggtggcgggcacctgtaatcccagctactcgggaagctgagggatgtatgaagtcagataggcgagtaatataacaataaatcctagaagtcagatatgtaagtattgagaggcacagattgcagt

SEQ ID NO: 516410 - DNA, 301 bp, Homo sapiens
ccgaggatccctgtgtcgtggtcgcgcggccgctcgcttaggcgggctagagcgattagaatgtgcggccagggactcgactgtatattaaacaagcttcggaagccccgagtgtgttgacgcgatgtgattctgaccagtgctctgaatgtcaaagtgaagaactccaatgaagcgcggtacacggcgagagtaactatgactctacttaaggtaggcaaatgcctcgtcatctaaattagtgacgcgcatgaatggatgaacgagattcccactggtccttaacctactataccagcga

SEQ ID NO: 516411 - DNA, 1510 bp, Homo sapiens
  misc_feature (363)..(363): n is a, c, g, or t
ggctcaacgctcataatccctatctagtcccaaatcggacctattgtcctcctagtctgagacacctgtcaagcactcacagatgcgagcctcagtctatcactaggtctacagctcctgccaaccacatagaaggccttatgatcttactgtcacatgatcctagaacacttactaccagatagctgaagaatcttactctggaccccgaacgtctcatgatctgagctagcagctatgatcctagattgtgacgcaggtccaatcacacttaatgatgacatgctagaagcgaggctagaccagctagacacctacaagtaagtcgaggctagtctactcacgcctactgacgtgatgtcntgtgtagaaccgactagtccaagcacaacacagccgtagtctttacacatgatattgctccgaaaccgtgtttttgcactccgtgagccgcctcgtaaagcaataggccctccatacctgaaatgaactttaattctacccatggctgtcgctaaccacctttctaggagattcaagtgtgtccaaaagtgcccaatctagacctaaagtctaaatcgctatgttctgcaaaccctgacttatatctacacccaattgaagatacatctttctcttcacctatctatccttaatgtacttaaactcttcccccgcttatctcaaatcacttagtccctctctcaaagttaactaaaccaaattctctagaccaatggtccaaccgacgtagaagcgataatacctcctaatataggtccacataaggtaaattccttaattcggtctccggaacaaaacccctaatcaggcgtttgaaattcactctcaaaactcttatggcggacagtgaaatacttattttcgacctcccagaaaattggaacggtgcctagagcgcggattgcaccaaggttacattcagcctccttcgaaacacgccgcccatagaggggcaaccgactgagacattttgcgctttcaaattcccattaacgaaacgcgcttcaatcattaaagcgtcttcccccagttttccccccccctataaacgtacaaattttctctgccagctttgagaattgtctaaacacatctttcctagcgaaagacaactcctctttaagaagtcatacccgactttcacatacgcatatctccataaagctttatgcttccgaggctgtcaatccggacgtgtggagccacccacaacggaaacacccttaaccttcgaaagggaggattcccctctgataaggaaacccgagacgcaccaaatccgggttgccacaagtttaccttgaaccctgtaggccgtaatacacgcacagaggataaaagcgcgtgtatacttgacactttgcggatgcaaacaatggcagttaccccctcttttttataccgggcaagcacatggcgaccgtgtgaattgaaacacatccccgttaaagaggggcccaatggtgtcggacaaggcgcccccacg

SEQ ID NO: 516412 - DNA, 1209 bp, Homo sapiens
  misc_feature (182)..(182): n is a, c, g, or t
  misc_feature (195)..(195): n is a, c, g, or t
  misc_feature (265)..(265): n is a, c, g, or t
  misc_feature (274)..(274): n is a, c, g, or t
ggtagatacgaggctctgaagaaatctctttccaagcaaaagggagatgaatcttacctctcgaagttcccaaacacccgaaagacactgaaccagaatggatgcccatacatccgcctaaatatgtacgagagatcgaagagtggagtacgctctaacgttattctcggactagcctgtgnattgagcatactngagcatataaatggccatactttaggcgacgtccgatcggtgtggacatagcaacataccgagtctcgtnttctactcnatttcaagtctcaagcttgttcctccatacggtggcaaccatagaggatctggaggagaccgacgacattagcgatgctacgctcgttggtagacacctcacctaaaatttacataggcgtgtcaacgcgttctcataaattagcacgcttaactgcttagtcattttctacgcgtggcttgcaaaggtttgttgcttcttcgaatcctctatttggcaccaatatacaacctagtttcaccaacaataaggcaatgtctgtgccattgtaccttatttaattgggtatacagatgtgtttggcattacgcgcgctctatttccacctctacaagtttactacgggtgcattcgaagagggcgtagacctggaaatactcgctttcaaactttgtgaagcaatgggttccccttttgcatgataatcctcatgttattagtcgttacatactataaggattgatcaaaattggactgtcttgaggaacaatgggagagctttgtgggtacaaatgcatcaagtacgacctccatccctgcgcaaattgcttgcacaacacctgttcacgagggcactttggaattcaagtacacccacatagttggatcttgaaagctgggttaaaatctgggtcagtcccccaaagagtcctgtggccccaccaagacggggaacacggttgggttttgtctaaaacatcttctgaagtacaaacaccccaacttttattaagaggttatcaattcaacgtaattacactgggtgtctacatactacataggggggcaggacggcacgctaagacacacttaaccaggaaaagcccacgagccaagcacgatcagtacgaatcacacataaaggacatgggcaagttaccaaaaagcaacgcatctcaagggtgggttggatgtagaacaaccaaaagaaacta

SEQ ID NO: 516413 - DNA, 152 bp, Homo sapiens
gaaagaggggccttggggcccccccttcccccttttttttcccccaactttaaaggtataaagggttttggtttccctgggggggggggggggcacccaggggtttcctgtacctttattttggccccgttgaataaaaggggcccccttta

SEQ ID NO: 516414 - DNA, 214 bp, Homo sapiens
cactactgccaccatctctaccgctgccagtggaggtgttccactgctcctgtttattcctgagctccaaatgcctatgcaatgtgaatacctccttataaaatgacacatgaattatcataaaaccactgaattcatttacaaggtggagtgggcaagttcacattttttacaagcatattttgggggcctaaatgaggcaaatacaataccg

SEQ ID NO: 516415 - DNA, 180 bp, Homo sapiens
  misc_feature (148)..(148): n is a, c, g, or t
gtccgtgtttgcgtggcttctgcggaaaatagtttgaaagttcctcaaaagttaacacagattatcataagactcaacaattctactcataggttatcctagagatttgaaaacatagactcaagattgggcactggtgactcacgcnctatatcccagcacttttgaaggctgaggtgg

SEQ ID NO: 516416 - DNA, 990 bp, Homo sapiens
aagggtcggaggcatacgagaatggtggtgtaccattgatatggagtgaggtgttccaaattttatggttgatgtgggaggtgttaccgctgactgacgtaatgtccgagagtggaggtgccgagaatatgacggtttagtagcaggacgacgagcgaatgtttgaactatctccccttgctcagtactttatgtgggctggggatcaaagagtaatagcatgaggaatgtcgctatgctcatagtgagagggacctagattggattacgatgaccagatggtagtatggaagtgaacatttatcctaaatcgggtgcactgatacttgaggctagaagaatgctatgtgttgataatatgagtgacttttattgtgccactgtagaacgaacgtgtggagtgaaggtctatactattggacgtgcggaaatatcattgctagggcaggagaatactctaagcgggtggagcaccagtggaatttgacaactgttgttcacttttcaattagattcgtggcttggggaatgaatattgtaggttatgcgtaggcaaggaaaccaagttaaattgtttttgactgcgaaatatagggtagttgaaaatatctataccatgaaaagcattttcttttgggggcggtttatgaacgcccatagaaagatttacttgacataaataggaagggaggtggggtgaaccgtaaccgtgttataactggcgccaaaggagttttcacctggagctactggctgccatacattttgtccgttgtttttcacacactttccacactccctcggggttggacctgccacttcctggaaaattggtcctgagagcacaaggtgaggtggcactggactttgaacagaggcacaaggagcagaaaataattacgggggagaagaaccgggataaacttcaaagtccatcgacagcacagggggtcctccacatgtgggagcaaatgctccttcgacaagcac

SEQ ID NO: 516417 - DNA, 708 bp, Homo sapiens
  misc_feature (675)..(675): n is a, c, g, or t
  misc_feature (689)..(689): n is a, c, g, or t
  misc_feature (707)..(707): n is a, c, g, or t
cgctaacggttaaaggatgagcctccattcactaacaatttcgattaaggaaataaccattggggatgggcgcggtggctcatgcctgtaattgcagcaccctgggagggtgaggtgggcagactgcctgagcccatcagttcatgaccagcctgggcaacaagagcaaaactccatctcaaaataaagtgaggggtgtttatccttacggtaaccatgaaaagaaacttcctgacagacagaaaggcaaacagaacgggcagatgtgagactgcaagtatgactgtccatggtggtcagtttgcaaagcactgcttctcgtattttctctgaaagccacagtgcctcttagtgttctctagacaccaaatttcaggtaggccggatgcagtgattcctgcctgtgctcccagcactttgggaggcagaggcgggcaaatcgcctgagctcaggagttcaagaccaactggggcaacgtggtgagaccctgtctctacaaaaaatacaaaaattagccgggtgtggtggtgcacgcctgtactcctggctactcaagaggctgaggtgggaggatcacttgaccccaagagtttgaagctgcagtgaggcaagattgtgccactgcactccagcctcagtgacaaatgagattctgtcgacaaaaaaaaagaaanaggcggccgctcgnattgtcggacgcggccgng

SEQ ID NO: 516418 - DNA, 253 bp, Homo sapiens
tgatagcgttagggctgcattcctagaccccttcacaggcagatagggcccaacagagagaacattctgacatatctatgaagtacctctcccacaccaggcatactcttactttaaaaaaaacaaaaatggccggagggaactctgaagcctcttaataatattcaaagagaagagagacctgtttgccaatttaaagaatgtgtcacttagataatcctccgtgtaaggatatttacatggcaaatcatca

SEQ ID NO: 516419 - DNA, 234 bp, Homo sapiens
accgcatactcgggtacaaaaaaagaaaagaggggctaagagttcccactgtggctcagtggtaacgagcccaactagtatccatgaggacacaggtttgatccctggcctcactcaatgggttaaggatccgggattgctgtgagctgtggtgtaggttgcagacgtggctcagatcctgagttgctgtggctgtggtgcaggcctgtagctgaggctctgattcaacccctg

SEQ ID NO: 516420 - DNA, 781 bp, Homo sapiens
  misc_feature (610)..(610): n is a, c, g, or t
gtatcgtctttgacacgcgggaccagaccccttgctacaacaggaatccggacggaacataaccagggactcttttctagccttcgaccgccctccgatgtactctcagctagcaacctacgtgaccatcttataggacatgtcctgcttatgggaacagtcaacaccgcttatgttgttagattgttcttgacaaccaaccatgagctcgcacattcgtcagaatcattccaccgtcgttgaggcagcacgtaacagcctcgccaatctggacctgcaagactcctacaacaacctttctctgggcttatatttggacaaaaatgatgtggctctcgaaggcgcaagccacttattccggaaattggcgaggagaaacaggaggcctatgagcggttaatagagacgcaaaccagggttgggggggagactctttgcatgtactcaaaaagcccactttagacgagtgggggaaaaccccagacgccatgaaaggtggcatgggacggggagaaaaagcaaaccctggcacttgggaatacttatacccggggatactgccaaacgggacccccatctctgggaatttcatggagacctacttcctggntgaggaaggagaagttaaaaaaaaaatgggggaaaccttaccaaacctcaacaggttggttgtccctagagaggggttggggaaatttttttataaagggccaatttttaatctcattaaagtctctttgccaaattattttaaagggccgttgaaaaaaaaaggcttttg

SEQ ID NO: 516421 - DNA, 1399 bp, Homo sapiens
  misc_feature (132)..(132): n is a, c, g, or t
  misc_feature (621)..(621): n is a, c, g, or t
  misc_feature (629)..(629): n is a, c, g, or t
aacctgtgacgaaaatgaatgcttcttggggcagaaagatgacaatcgcaaacctcgcccgatcgggtgagtagccagtaggatggccctgttgaatgttgcactcgtctttatcatcgacgactgaatagnagaagactcttttgaatagaagaacatcatatactagtgacaacttgccagtaaggagcatgccgttgaacttttatggccccgggaactcacttccagcttcgctgtaaatgcgtactacaagctgcatatgacaatgacactgtggcagtaagcttgcactgcatgaaccgctgtgcacttgtgctctgcttgcacaacacaagcatcggagtgagaacatatcggagggaaatcgcattaggaggagaaggcttatcagatgctgcccaaaatactaggagaacctcgaaagctgtgcaccaatggtccctctcatgcaggtatattgtggaagcacatgcagacttatcgaatagctcataggggcatcagttcagcatcggcacatggagcacaaaggaggtatatttccctgaaaagcatgataggttccgcataccagagttctccgaaaggatatcagctgaaaagagaagcgtgtaaccncaaggagnggtaccctaatctacctggggaacattggcatcgtcccaattatgggagggaactttcttttgctttgtgggtaaaagtcggtgagccatgggaattgcgtaaccatggcgcgcgcctggggatcacccttttggcgtccaatatcggttacattgaattaccgtagttttgaacacccacaagttgcgagaaaggatatttttcgggagtgcctttccccacatgtttgaaataaccggtaggatcacgcggggaccacttggccttagggtagaaaataatataccaccgttatcctttggtttccgggggaacgagacaaattttccggacaaggttgtggggctcaattttgtggggcctagaaataggctggtgaaatataatccttggagggtagaactgaaattaggccggtggcgtaggaatacggtatttgcacatttctcctagtataaatgggctgttggccttagggaattgaaacattggcttatcggcggaggaacggtgcaaaacaggggacatttgctgtgtctgtgggcccaaagagggattcaacttttaattggcgtcttggccagggtctaggacaggaggcactgggttaccttgttccctcggtgggagtacacattgggaaattatacggttagattaggcagactaattgggcatatatgtagatgtggggctattgcgccatgggtactttgaacctaccctatgggttcctctgttggccctggagtgagacattgggagagaa

SEQ ID NO: 516422 - DNA, 529 bp, Homo sapiens
  misc_feature (47)..(47): n is a, c, g, or t
  misc_feature (60)..(60): n is a, c, g, or t
  misc_feature (68)..(68): n is a, c, g, or t
  misc_feature (73)..(73): n is a, c, g, or t
aagtttcctgggcctcccacattatccagaacttgtaagtcaattanccctcttttcggnataaaganctacntaagctgggtaattcataaagaaaataggcttaattggctgatggatcttcaggtcatataggaagcatggttgcagaggcctcaggaaacttacaatcatggcagaaggtgaatgggaagcagacacagcctgcatggctgaagcaggaggaagagagagaagggggaggtgctacacacttttaaacaaccagatctcatgagaactcaccatcacaagaacagcaagggggaagtttgcccccacgatccaatcacttcccaccaggcctgtcctccaacattgggggttataattcaacatgagattggggcaagaacacaaatccaaaccatatcaggctgggcacagggactcatgcctgtaatcctggcactttgggaggccaaagcggaggattgtttgagtccaggagtttgagaccagcttggtcaacatagcgagaacgactcag

SEQ ID NO: 516423 - DNA, 167 bp, Homo sapiens
cgcgcccggatccctcagggttagcaggacatgagggagtgtagactctgatgcggtgagctgggccggagccctcggagctagcctcagcttagtgtggcagcacgccctgccttgtggagccacgggctcccgggacggactccccggctctcccccaggacgcc

SEQ ID NO: 516424 - DNA, 556 bp, Homo sapiens
aggtgactctacaggatcccagaagatcacctatcgtgcacagaagatcacctctacacaaataaactagaaaatccagaagaaatggataaattcctggatacatacaccctcccaagactaaaccaggaagaagtcgaatccctgaatagaccaataacaagttctgaaattgaggcggtaattaatagcctaccaaccaaaaaaagtccaggaccagacagattcacagccgaattctaccagaggtacaaagaggagctggtaccattccttctgaaactattccaaacagaaaaagagggaatcctccctaattcattttaatgaggccagcatcatcctgataccaaaacctggcagacacacaacaaaaaaagaaaatttcaggccaatatccctcatgaacatctatgcgaaggatatgaacagacacttctcaaaagaagacatttatgtggccaagaaacatatgaaaaaaaagctcatcatcactggtcattagagaaacacaaatcaaaaccacaatgagaaagcatctcatgccagttagaat

SEQ ID NO: 516425 - DNA, 741 bp, Homo sapiens
ggctgcgctctccctccacaccgccttgaaagctgagggagccggctcggctctgccagcccaggaaggggctcccacagtgcagcggggctgaaggactcctcaagtgccaccaaagtggagcccaggcagaggaggcgccgagagcgagcgagggctgcctgccaagccacgctgttcacgtctcagcaatagactgtctgtgagaaagacttcaccttcatctctgatctcaaaatggagaaggcccgtggatgagatccaagcaaagctaagcagactcaaccacaggtggaaggagcacagtgccgctgcaagaggggggcattaagaagcaaattcttttggaagaggtacctgagatggagaatttgtgtaatcgcagcaaaccttgataaggcacagggaaatattacaaaaagacccaggaagaaaattggttacaactttcaagagtgattccttaaagttatgggaacacggttccagggactaaccgtggtgcaggattgttgcaggttgggcctaccatgtgggtacacttattgtggccatggcaaggtttgcgtgcatctattaaccccaattacctaggttattaaggcccggttttctggtcattctggatggatagatctttcggtgaaacagcacctgtgtctctaacttcaaaatctggctgtcagtgccctaactttttgccgtggttctcaatttttcacaaattctgggattgctgac

SEQ ID NO: 516426 - DNA, 192 bp, Homo sapiens
gggccctgcggtcatcttcgatgcaagtgcatcatctcaactgaagcttcagcgcacctggtattcatctcgttctcagcgatccttctgtcctgcatcgactggctgatcaaaataaacagcgacaaaaagatcgcctcgcacgacgtccagaaacacaggaacggaaaccggaaacggtccggtgccccg

SEQ ID NO: 516427 - DNA, 190 bp, Homo sapiens
  misc_feature (1)..(1): n is a, c, g, or t
naaatttattttcctccaaaggagtttcactggagaagcaaactatttcttaaggggaggttgaccagcaatagatggccaacagaaaataaaactcaatggtacctttggggctctcttacctcataatgccctgtctgggttttgaattttaaaaaatattgaaggtagagtcgggtgtggtcgacgc

SEQ ID NO: 516428 - DNA, 1699 bp, Homo sapiens
  misc_feature (850)..(850): n is a, c, g, or t
gatggcccaggtgatacaactggccgcatggttccatggtgtgatggtttctttccaggcccttcatgctcaccagacgacttcccatgggggccccacggtccaaggccttgacgcgatatgcctgacgttcacgaccatcctgcggatgcgtcgctaccctgggacatttgcagccgcactaccctttccatggtggccgcaatggacgcgccttgccgcacagactccatggttgctactgcgacgacttggtgcggacgagattgcatgaggcgtgagcgtcacttcactcgaatggttattggcacagtgcgtggcgtctgcctaggaagatcataggggccgtggttgatgacaaacccccgttattccctaagttcccctactgcaccgagtgcctaaggcgctagattgtgggtcgatgtgagcaccatgtggtccctagtgatttatctgctcgcgacacctctgtttgtggaagccattcccacgcaacgatgcgaacacaacttccgtataacccactttagcatgcgctcactacaatgttcccctgtccatgggttaccttgcgagtactgcgctatgcagagggcagagctgtggccccctccctgggatatatatccgcatgtacatttgctggtaagtttcccctgtgttgtgagttgtccctaggaaccaaactaatgtcatgtctgttaacacatttatttgcctagcaacccataatttaacatgaataaacgccccaacttctgtgcagcgcagagggaccgaccacagggaccgagaggtgacattaaaaattttattcccccagacatccagggccccacatttgggnccccctgtggatggcgtggcccccccaaatggtctctggcaccaattggaagtgctggccgaatttgtggatgcccatacaaagcaactgttagacaaccggaggaatacccctttgtgtggctttcgtgtggccgaaacgattggtgaacagtggctgtttgccccggagacgaacgttataccacacccgggagaccgccccgtaagtggccccggttgcccttagaagagacaagacgggccgcgcgctgtaggagccacgccccactgatcgatgtaccgcgaacgcgtgggcaccgaacacgacatttggcgtcgtgtgcccggcccggagggaaccacattatcccgttggcaaccgcaggatatacctccggcaagccgcgaacaaagcgcgtggtttacagaccgaaccattggagtgtctgaaaactcccccacccaccccgagggtgactggcgcagattcagtgcgaccacggcaaatgtggtgcctgtggcgcgcagtacacatggcaccaccgtagcagtgtggtggtcgggcgccagtgtggtgaggcccaatggaagccaaatacacccgtttggaccccgtcgttggtgggagaccaaaggtactctgcgccaggggtagttgaccctattaccgcgttgttacattgtgtgtcgtgcacaacaccacggggccttcttatctgacgggactataggatatcttgcccagcgagaccccctgtcactacagggcaaagtggcaatgaggtcacaacccctcggggacactgtgacactcttgtgcaaataaggcattgccacttgtgtaggcccacagagaaagactctagca

SEQ ID NO: 516429 - DNA, 362 bp, Homo sapiens
gggaaaccctgcccgggttcccgggggttttttggtaaaaaaaaagaagcccccccctttaaggggtttttacgcccccaccaatgggggtggttgcccccccgagcttttccccttttttgccgggggggggaaaaaaacgggccctttttgcttggggggttggcccttttgcccccatttggttttcccccccccggttggccaaaggggggaaaattttttaaccccccttgggtttttttttccccttttttttttccgcttaacccccggggggaaccccccctttttttttctcccccggggggttttttttaatgttcccctttttttcttataaacctgtgggggacctctta

SEQ ID NO: 516430 - DNA, 154 bp, Homo sapiens
acccgcagcatttatcggtaaggatgataaggtcttgggcggaagactcagctatctcaatttaatggtaagagccgctcctgcgtgagcgtcgtgaatggatgctagtggcattatgtaaggcactggtagggggggtacgagctcgaatcgt

SEQ ID NO: 516431 - DNA, 227 bp, Homo sapiens
tgaaaaacaaaaaaaacttttttttttgtaaacgggcggggggcacaaaatttttttttacaactctccccacttaccgtacaaattttttctccccacaaacagaatagtgaccacaggaaaacacaaaaaaaaagcttttttcaaatgtgtgtcgcctctcttataaaacaccacagccaattctctcaccttttcttttataaaaaaaaacaaaagagaggggg

SEQ ID NO: 516432 - DNA, 210 bp, Homo sapiens
  misc_feature (28)..(28): n is a, c, g, or t
  misc_feature (30)..(30): n is a, c, g, or t
  misc_feature (33)..(33): n is a, c, g, or t
  misc_feature (52)..(52): n is a, c, g, or t
  misc_feature (58)..(58): n is a, c, g, or t
  misc_feature (67)..(67): n is a, c, g, or t
  misc_feature (69)..(69): n is a, c, g, or t
  misc_feature (71)..(73): n is a, c, g, or t
  misc_feature (80)..(80): n is a, c, g, or t
  misc_feature (82)..(82): n is a, c, g, or t
  misc_feature (86)..(87): n is a, c, g, or t
  misc_feature (99)..(99): n is a, c, g, or t
  misc_feature (101)..(101): n is a, c, g, or t
  misc_feature (103)..(103): n is a, c, g, or t
  misc_feature (110)..(110): n is a, c, g, or t
  misc_feature (114)..(114): n is a, c, g, or t
  misc_feature (118)..(118): n is a, c, g, or t
  misc_feature (127)..(127): n is a, c, g, or t
  misc_feature (136)..(136): n is a, c, g, or t
  misc_feature (162)..(162): n is a, c, g, or t
  misc_feature (173)..(173): n is a, c, g, or t
  misc_feature (190)..(190): n is a, c, g, or t
  misc_feature (202)..(202): n is a, c, g, or t
atagaaacaagccactatgttgcttttntnaantatgggaaggacgattctncctggntcttctttnanannntggccgntntgtnntggtggttatantngnttcaacnttcntcangttaccccntgttccagnttttggtgtttactttatgatttttntgtgtatgacnttctttttttgttttcnagttatttttcnttttgttt

SEQ ID NO: 516433 - DNA, 375 bp, Homo sapiens
gtgaggagacccctattctatatccaacagcatatttctgatttttcggtctaccctggaagtttcactattcttatcctaccatgcttcggtaataactctcccatattgtaacttactactccgtaaaaaaaagaaccatttggatacctaggtcttgtctgagctattatatctattggcttcctagggtttatcgtgttagcacgccatttatttcccgtacgaataaacgtaaactcactacgcatatttcacctccgctaccataatcattcgctttccccacccggcgtcaaattatttatctagactcgccacactccacggaagcgatttgaaatgatcttgtgcagtgctctgagccctaggatt

SEQ ID NO: 516434 - DNA, 218 bp, Homo sapiens
  misc_feature (58)..(58): n is a, c, g, or t
tcgatctagaggcccccctggtaagggcagtgcataccgacggagcagctaaaacttnaaaaccgacagtaccaacgcttccaggaactctcacccattgctggtgggaatacaaaaggctaaagccgctttagaagacagtttcacagactctcacagaactaaatataaatatattcttgggctggacgtggtggttcacgcctgtcatcccagca

SEQ ID NO: 516435 - DNA, 493 bp, Homo sapiens
  misc_feature (39)..(39): n is a, c, g, or t
  misc_feature (53)..(53): n is a, c, g, or t
  misc_feature (66)..(66): n is a, c, g, or t
  misc_feature (79)..(79): n is a, c, g, or t
  misc_feature (224)..(224): n is a, c, g, or t
  misc_feature (361)..(361): n is a, c, g, or t
  misc_feature (430)..(430): n is a, c, g, or t
  misc_feature (444)..(444): n is a, c, g, or t
tgaggtcaggagatcaagaccatcctggctaacacgttnaaaccctgtctctnctaaaaataaatnggctgggcgtggnggtgggcgcctgtggtcccagctgctccagaggctgaggcgggagaatggtgtaacccaggaggcagaggttgcagtgagccgagatcgtgccgctgcactccagcctgggcaacagagcaagactccgtcacaaaaaaaaaaanaaaaaatacggccatgtgcagtgcctcatgcctattatcccagcaatttcggaggctgaggcaggtgtgttgcttgagctcaggagttcaagaccagcctcgccaatgtggtgaaaccctgtctctactaaaaatanattagccagtcatggtggcgcacacctggaggctgaggtaggagaatcacttgaacttgggaggtgganattgcagtgagccnattgtgctgctgcactccagcctgggtgacagagtgatgagctccttgg

SEQ ID NO: 516436 - DNA, 272 bp, Homo sapiens
aatgacggcgtctcaggagcgaccctacttcatgtcgcccgagctgagagacatcctgttgaaggggagtgcggaaggatttggagtttctagctatggaaatgtatcgatgaatcatacaaacatgaacacgaggatgattgaattcttgaagaagaatcgtagtcccaaaaatggacaagtgaacatagaaaaagagaaagttcataaacatatgattaaagagaggattagaacagaaaaacaaaagcaaagttatttgaactcgtaca

SEQ ID NO: 516437 - DNA, 331 bp, Homo sapiens
caggaataggtcagtgtacaaagaatacagtacgtcattatgactgaattattaatttgacagccacaaaacaaattcatgtgacacatttacttatttgactgcttctgtggtatgtctgaggtgagtataggtgcgacattccagagaaggagagctggcgcaaggacagtgctccagaaaaaacagtaatagtttcaactgaccacaggctcaatatggaacaacactgggatgacattgttaatgtaatttaaggccacattaattgagtgtccaaaataaaggaggaaatggccccattgggagctacccaccccttaaaaaaaaa

SEQ ID NO: 516438 - DNA, 90 bp, Homo sapiens
cacgcgtcgcttgctgggagagtgtccgttgcttcccgtccgtgtcgcggccctgcggttggcggcctcctcgtggagcggagcaaggcc

SEQ ID NO: 516439 - DNA, 330 bp, Homo sapiens
ctgagtgtacaagccgcagagagagtccggaccaggtaaccgcgaggtccatgtagcttcatatcacaccttatccccccgaatggaggagaagggagcatggtcaaatcccaggaatcggctacccactgcaaaatacaaatctatacaacctagctactaaagttacacatacttcacctaacctcataaccttgggtacgaaatccctacatctacagccatgcaaattcccacaaaaaccataaaatgagtcctaactatgctccacaaaagactggtagctccaagggtcctcagggactaagtccctagtctaggcaaaccaca

SEQ ID NO: 516440 - DNA, 276 bp, Homo sapiens
  misc_feature (213)..(213): n is a, c, g, or t
  misc_feature (269)..(270): n is a, c, g, or t
ggcagcatcctccaacttcagctacaagggacaaagtaccctgctgcccgcctcattgttttaaatgagggaggaatgtcccgaagggagccaaatgtctgcgctctgcagccaatgtacttacccatgggtgggaccagaggatggtccattccaacgctaggcaacagcgtgaacattcctgacaatcttacgggataggcgagtgctaantgactgtagcagtccagaaagccatgagcgcagcaagttgtagtagaacggaacanntggggt

SEQ ID NO: 516441 - DNA, 265 bp, Homo sapiens
caagctatgagtgtgacatggatcaaagtacaacatagcatatacttttcaggtggcctgggcttatggggctacttttctattctcggtcggaacatagtgggatgaggaattaattagatggaagggagattttgacagctggaatttcatcttagcttgagtttaacatctatcatgggtagtgctcagggaggcagcatgtgcagggtgcagcatactaaaaaatatctcatatgtcatatgtgtgtgtgtatcatgggtc

SEQ ID NO: 516442 - DNA, 650 bp, Homo sapiens
cgggaggcccatcccgccaggtttctttcagccttttatgtcaccgcgatacgcaggcggcccaggcccccgatcagaatgggaaaccagcctccgggaggagttccgtgggacacgagccattgcttgcccaattcatatggatcccaacacgaacaactaaggccaccctcaaactatgggaggcatcagatgcagtagatatgaaacccgtcccgcgaaggctatgtggtgcccaattggtgtccccgggccccaacatgaatttacgggcaaggcggcaattgaggaccaaaccaatgcacaaaattccctatcgggcccccggcccaatgcccgggggtattaactatgggccctgggagctgggctagaccctggcccaatccttaacagtgctaacttcaattccatactcctcctcattcaccgtggtacctatgtgggaccccctggtgtggcggtcctccaggaacacccattatgcccagtcccgcagattcaacaaattccagtgacaacatctacacaatgattaatccagtgccgcctgaggcagcggtccaacttcccgaatgggtcccggctcggacggtccgatggcggcatgggtggcatggagcacaccacatgaatggatcattagggtc

SEQ ID NO: 516443 - DNA, 302 bp, Homo sapiens
  misc_feature (11)..(11): n is a, c, g, or t
  misc_feature (50)..(50): n is a, c, g, or t
  misc_feature (63)..(63): n is a, c, g, or t
  misc_feature (282)..(282): n is a, c, g, or t
cctcccctggncctgcccccactgagagctggaaagaaccccctctctgnactttggggaagnccaaggctggagggatcacttgagcccccaggagttcgagaccagcctaggcaagatagtgagactcccatctctactaaaaataaataaaataaaatagcccaggtatggtggtgcacgcctgcagtcccagctgtttcagaggctggggtgggaagatcgcttgagccctgaagcttgagactgcagtgacctaggatcacggtcactgtgctccancctgggcaacagagcaaaac

SEQ ID NO: 516444 - DNA, 390 bp, Homo sapiens
tctttagagaaggggtctcactctgtcacccaggctagagcacagtggcacaatcatagctcactgcagccttgaactcctgggctcaagtgatcctcccgcctcagcctctggggtagctgggactacaggcatgcaccaccatgcccagctaattttaaaacattttaaaagagatggagtcttgctatgttacccaggttggtcttgacttcctggcctccagggatcctcctgcctccgcccgccaagttgctgggattacaggcatgaaccactgtgtctggctggccttacccttttaagagacccactctggtatcttctggccatgctctttcacactgggtaagaagtctgtggtgctgagagggtggccctccttcgaga

SEQ ID NO: 516445 - DNA, 1222 bp, Homo sapiens
  misc_feature (72)..(72): n is a, c, g, or t
  misc_feature (124)..(124): n is a, c, g, or t
  misc_feature (131)..(131): n is a, c, g, or t
  misc_feature (138)..(138): n is a, c, g, or t
  misc_feature (140)..(140): n is a, c, g, or t
  misc_feature (1222)..(1222): n is a, c, g, or t
agaggatcccccgcaaaaaaaaaaaatgaagaaagaaaacaaaataatagtggaagctaaattaagagctanacaggagcaagaagcaaaacaaaagttagaagaagatgctgaaatgaaattntagaagnaaagatngnatgcttgctggcaaattttcggggtgcatttagcatgatcgagacctgtagagaagatttacaccatacttttctcgaaatcatggtggacaataaaatggatagacttcggtcagaggagccaaaagcaggggatcaattctcatttcaacagcaaacaagccaaggaagccattgggtaaagccaaagcatgcaacataatggtaaccctacaattaaggaacaaagcaagtgacttgggaagtcactagcacaggagcaggtggcaacaaagcaagccactgcaagcacaacatcaatcagcaagcaccaacaagcaatccctcaaacacaatggcacagtccacaaaggtcgatcagcatttcaacaggcacacacaggcacaagggtcaatgaaagctgccgcagcctgggtcatggtcaacaggcaacaagttacagtttgcagggcgaagaacaacgaaattgtgctcagtgcatgcatgaacatgaatgaaccatgatgcaaacatggtgcaactgagacctgtgaaacagcagcaagcagaagaaacagacacacagaagaacctgcatcctaaacaacaggaagaaacagaaaatggtgctggagaccagtagtttagtaaaacaatttttaattcattttaaataggtttttaaacgactttgtgttgagggggcttataaagggaaacgaaattaggtcacttcaatgtacaactgtgagaagggaaaattttgggagttaacttgtgatgaaagtaatgcaatgagaatcacgggactggtatggccaggacaggggtaatcagaagaatcaacaatcacaaggacgatctaccagcaaatggcgtggaaacttcgggacgggttaaagacaaaaaaaaaagaaacgcatccaattggaacaggccacaaaagataaagaagggcggggacaaaataacaaaggcacaaaagaccacaaacgcaagagcacagagaaacacaaagacagagagaaacgatacaaacaagagcaaagcaccaacggacagaacaacacacaaaaagcaacgacgagaagacacaaacgan

SEQ ID NO: 516446 - DNA, 444 bp, Homo sapiens
cgtgattattccctcggtttttttctccccccgggggggtgggtgggggagaaaaaaataccccccccccccccgtgggagattttttcccccccccctcccccccccctagggggggggggggggggtttaaccccccccaataattcccccccccttttttttttttttccccccaaaaaagggcccccccggtggtttttttttttaattaccccccccccccccccccccccccccccgttttgccccccccggttcccccccgggggggtgggggggggggaaaaaaattttttttttaaatttttttggaaacccccccgggggggtttttttttaaaattgggcccccccccccccccccccccccccccgaaaaaaaaccccccacccccttttttttttcccccccccaaaaaaatttttcggggggggccccca

SEQ ID NO: 516447 - DNA, 432 bp, Homo sapiens
aacgaggctacaactcgattttagacagccagagtgaagcgacggcgcagttggacagcattgacttcagcataatcaggaactgcatccatgctgaggaaaccagagaactgttcagatgctgactttggcaagagaaagaaaagcttcttttgccgctgatgactgaactaacatgagggctgaagcgggcagcacatccgcgaaatcctagacagctgtgccaaatcccactcgttagctaagagctgagctgagtgacagaggactttaattagagcagtttttaggaggactgccggacgttttatctgcgacagaacctgaacctctcaccgtttcttctttcagtcccgcacagactttggctcttcttagctaccataccacttctcagcacctgtttgcgtccttctctcccctctcttcttc

SEQ ID NO: 516448 - DNA, 275 bp, Homo sapiens
taatcctaaaatacaccaaattaaaaccattttaaagtggttaaatggtaaattttgggctgggctgtgtggcgcatgcctgtaaacccagcactttgggcggcgggaggacagcagcagagggattggggacagcagaggccagagaaaggaggtgggagagcaaagggacaggaaagtgaggggaacaacagacgaccaacccccgccccaagagaaactcgcatctaggtgatcccactcgcccctcactagtgccccacgtaggagaaact

SEQ ID NO: 516449 - DNA, 447 bp, Homo sapiens
aaacattaataagagatcaaagatttttgtttaccttttaagtaaactacaggaaaaaaaaaggagagagacagacatttagttggtttcctgctgtcttcattggatcttacagttggggaaactgagtctccttcatatcaatgagtaaaggtctttggtgttttggttttttgtttttttggaaatctttgaattatcgttttggctaaatgaataactattttataatgaaccgtgatcctattttgtggcatcaaatgttttaaacttttgatattcgactgatgaacttcccaacatcaagatttcaacttctggccggctacagtggctcatgtctataatcccagcactttgggaggctgagaccaggcaggcagatcatttgagttcaggaatttgagattagtctggacaacatagtgagacctcgtctctacaaaa

SEQ ID NO: 516450 - DNA, 296 bp, Homo sapiens
ctcacagttgcacagtagaaagcagataacatgggcatccaccaaggtggaaatgtccattggcataataagattagggtgggggggtcagcttcttccagcactatgtaaatgtcacagctgatccaaccaatctgtgggccctatggaaatcagataccacctcttcaaacccgtctataaaatccagtgcactcggcggtaggcgggaagtcccattcaggtgctgagagagagagagagagctgttcttctttctctctctttggcctattacagcccgtgttcctaaaccc

SEQ ID NO: 516451 - DNA, 300 bp, Homo sapiens
cataaggaataggagtagagaatatcatacggatgctgtcccatccacaaccaggtcttcagagaaaagcaaccgtgacccacaggcctctgaattgacgctcagatgctatcaggataaggaatgccactgtcagatgctcggctgcctgcaaaccttagccaggacatcactgacaacatcaagatcgtgctgcagctcgttcatggcactggttatgctcctggtgtctttcaagatctgaatcctccgtgtatatagattatacttcactccaaatggacgcctgattgtttaggt

SEQ ID NO: 516452 - DNA, 228 bp, Homo sapiens
gcgatttcactgggccaccctacagccagaagatatataggaaattgttaaggaagtcagcacttacattaagaaatattggctactacccccacacagtatcatttgtgccaatttctggtttgaatggtgacaacatgctgtagccttgtgctcacatgccttggttcaagggatggaaagtcacccgtatggatcgcattgccatgtaaatcccagcggtttgcg

SEQ ID NO: 516453 - DNA, 138 bp, Homo sapiens
ggctatcacattatctcccagagtacttcaactctgggttggcccaaatacaactaatggcaccacaaggcggtggtggtgccctgcagtcaacagccagtctcttcgtgggctcactctctcttctgcatctctact

SEQ ID NO: 516454 - DNA, 298 bp, Homo sapiens
  misc_feature (47)..(47): n is a, c, g, or t
acccgcatcggcgtaacatcaacacgattaggtgccgcccgcacatngcaacgcgccagcatcaagagcccgcaatgcgcggctgcacacacgtgcgatcaaggagatttcaatgaacgattcatccgcatcccccgctaaggtcctggtgtgggacatgcccgtgcggctgttccactggctgatggtgctgtgctttgccggcgcctacctcaccgccgagaccgaacgctttcgcctggtccacgtgaccctgggctacaccatggctggcctggtggccttacgccgatgcggg

SEQ ID NO: 516455 - DNA, 162 bp, Homo sapiens
cgtctcttacgaggttcccctgctagcgctcgggtgcaggccagagtcctggggctgttctctttggctgttacacatgcccagagaggactgagactggcacttagcccaagaggtctgagcccttggtgtgtttccagattcgatcctgtgcattcactc

SEQ ID NO: 516456 - DNA, 110 bp, Homo sapiens
  misc_feature (48)..(48): n is a, c, g, or t
tgtctcgctccgtggccttagctgtgctcgcgctactctctctttctnggcctggaggctactccacgcgtacctaccaaaggtttcacggtttacctcaccgtcactcc

SEQ ID NO: 516457 - DNA, 976 bp, Homo sapiens
gcatttccagctgcgcggtcccaggcccccctctttttagtgtggtgtcttctctttcctctccctatttttgtgtccctctgtggacccggctgctaactttgccaggggcccccaattatcccgccgagatctgagggtccctccctctcttaccccctcggtttcttccctgggggttgtttagccctctcctcagtggtgactcggtcccgatgttgttgagactactgtttgcccccgcatgtaattggcctcttttggagagacacttgtggcccgcagaacgttttcttctccgcccatctctcttctatgagggacgagaggacaccactcttgatgacaacgctgttgggtgagcttaccacggaaacacccaccgagtggggccccgaaattttcctttttcccggagtattcctacatacacccccgcgctggtgatggtatctgtggggagcaccggcgctatgtagaacgcccaatgaggggtgccgccactacaccacattgtggaaagaaaatgtatggaccaccacagctcacttcactttgtggacgattccacaccaacatgtgcgcccgttcgccgcaaaggtgacacccccacttgggggcactcttctgagacgacacaatatctgggatgggaccagggtggtgagcaccatcccaagagatatggggggacacacagaggcacccaattgcgcgccagaattgggggcggccccggatatggcgttggcgcggaattattttcgtttgacgacaaagaccacccgggggcacccatggataatgaaagatcagcctccgggcggtaatttccccaaaccctcgggggggatttcccgggtcccccaagccagcaagacattgggggttccctaccctttttaaaaagggcccccaaaaacccccaaattttttgagttggcccttccttccaaaaaaggaaatgggaccccga

SEQ ID NO: 516458 - DNA, 104 bp, Homo sapiens
atgctgagactttctgaaatgtggggcctgagtgactatcccggttactcaagctggcctgccagagctgttaactggtatgttctacaggggtggtatcagga

SEQ ID NO: 516459 - DNA, 1209 bp, Homo sapiens
gtcgtcctccccgacgcgtctgcagcagctgccagtggagccgcctgacaaggactgccatccaccatggtgaagctgggctgcagctatcttctagtggaagccaggtagaatgatccctggggaccaggatggtggcatcccaagtatgaaaatgagcctctagttatgaacccgctgtggacaacagccatggcgatcaaccagcatgacccagaccattatatggacaactaatgatcactaacacaatatataccattctgaaacctgctccaggaccatacatagatagccctagagcgcatgaaattggcgagatgcgaagctagcgactgaccctgaactgataaactgctaggggagctctcgacgcatcacaagagagatgcatgcgaacggcataaactgcgaacatgaacgatgcgaatgaaatgcaggagactgatacgcgagcaagattcgaccatgaaacatcgaggcccagacatctgggccaaggtaatattcgcaaaaactaacgcaccgcgaacccagagagaagggcgaatacagagaaagagggcgccaaagcacgaccagacatacctaagaatgctacagaacctgacccatgataaccatggagcgggaacatatggaagcggcaacatccaagggaaggggcagccttcacaaccaacttaaatgacatcaagggtatcccacccagatattagcaatgaagggggagtcgatgctaaccccttcaagaagcccaacgggccatatggtaataaaaatcaagcacgtggtgacattccggggaccccggatcccccggttctgtacttttagagtggggatccattccccgcataattcctaccttggatttgccaccacgagaacttataaaacaactctcggtcgcccggtgggcacaccattcgtggagcaagtactcgagattcatcttcaccggaggattccccttctgccaggagagcaacaaaactacaattcggtggatcttctattgttataagaggttgcctagacggtctttagtggattttttagtgctgttgggtcaatttttggggtttgaattaggggttggggggcatattagttttatgcgtgtgtaaaatcttgggaggctaatatggagtggataattcgatttggggggaatttatcatatgtgtgagtaggtgatatatgggg

SEQ ID NO: 516460 - DNA, 127 bp, Homo sapiens
ttggcctatctgttcaaagcagcctcttaactcctgggctcaatgtgatcttccctcgtcatctctcaagtagctgagactatacgtgtgcaccaccacgagtcacttttttttttttttttttttt

SEQ ID NO: 516461 - DNA, 345 bp, Homo sapiens
cttccttggtgagcagagatccagaatataagaagttgggtagaaatcctaggtgtgtggaggaagagaagaccagtgccaaccctgagactctgctgggggaggatggaggcgaaagtacaagagagctcatagctagaagcaaccgaacacctcttttggaatatattaggaatagatgaattagaaaagcagagaattaccgagaagagaagcgagaagaacggaggcaggagaggagtctaggacaaagacaccacggtggtgccggggaaagtaggcaaaacacatggaaagtaagaagagaacgaaggaaaagagcgcaccatacagagaagcaaaaag

SEQ ID NO: 516462 - DNA, 291 bp, Homo sapiens
ggagattgcgagtgagattattgtgcagttgcttgtctacgatcgatctatctttgattaggctataaaatgacccatctcactctgagtcgcttgacaatgcatattcccaggatacagtgggaattggagacatttagatgtatactccattgccatctgcctgaagagttcaataatggggtggcctatcaatgcctattctgtctccattcaataccaaggctcaatgttcgggcttggaatgtgagccccagcacaatttatacccccagctttatctccctgttg

SEQ ID NO: 516463 - DNA, 936 bp, Homo sapiens
  misc_feature (47)..(47): n is a, c, g, or t
  misc_feature (80)..(80): n is a, c, g, or t
  misc_feature (125)..(125): n is a, c, g, or t
  misc_feature (128)..(128): n is a, c, g, or t
  misc_feature (133)..(133): n is a, c, g, or t
  misc_feature (209)..(209): n is a, c, g, or t
  misc_feature (271)..(271): n is a, c, g, or t
  misc_feature (297)..(298): n is a, c, g, or t
  misc_feature (315)..(315): n is a, c, g, or t
  misc_feature (318)..(318): n is a, c, g, or t
  misc_feature (410)..(410): n is a, c, g, or t
  misc_feature (412)..(412): n is a, c, g, or t
  misc_feature (424)..(424): n is a, c, g, or t
  misc_feature (435)..(435): n is a, c, g, or t
  misc_feature (444)..(445): n is a, c, g, or t
  misc_feature (520)..(520): n is a, c, g, or t
  misc_feature (584)..(585): n is a, c, g, or t
  misc_feature (611)..(612): n is a, c, g, or t
  misc_feature (639)..(640): n is a, c, g, or t
  misc_feature (646)..(646): n is a, c, g, or t
  misc_feature (701)..(701): n is a, c, g, or t
  misc_feature (703)..(703): n is a, c, g, or t
  misc_feature (714)..(714): n is a, c, g, or t
  misc_feature (820)..(820): n is a, c, g, or t
  misc_feature (881)..(881): n is a, c, g, or t
  misc_feature (883)..(883): n is a, c, g, or t
  misc_feature (887)..(887): n is a, c, g, or t
  misc_feature (891)..(891): n is a, c, g, or t
ggccacatagctgtgagtgcagccgttttcccgactggaaccaaagntcaccttcttgactcctttgcccgttcagcttnatgggattcaggcctagatacttgcacgggactggacatggtgtnggntcttntttgaatgtccatgagggtccttgcggcatcagttacaaaacattctctgatgagcccttggaggcaggcatgatngtcactgatgagcccgggtactatgaagatggggcttttggaattcgcattgagaatgttgnccttgtggttcctgtgaagaccaagnnataattttaataaccgnggnaagcctgacctttgaacctctaacattggttccaattcagaccaaaatgatagatgtggattctcttacagacaaagagtgcgactggctcnancaattaccaccntgacctgcagngaatgtganntgggaaggaattgcagaaacagggccgccaggaagctctcgagtggctcatcagagagacgcaacccatctccanacagcattaataaatacctccccggttttgtttttgtaaaatgctctggaggaaggaagaaacnnggcagatccctgacatctttcccctnncctttccgtcttccctacctccccttnnatactntaagactttaagaagaacagaaaatcttcttatcctctttgatattttagtgcanancactcagtgtnttatgattttttaattgttgagaacaagccaagaataaaattgctgcaccagaaggagggtccctccaaagttgaacacttggtgaaaggaagatgccccgacttntttggccagtgatggggaatcagtgagtgctccatgatggtcatgttccaggtgctagtanancatncagntcaccttaatgctcatgagactatatttataatcgagtgaataaa

SEQ ID NO: 516464 - DNA, 249 bp, Homo sapiens
ctctccaaccacatgcacttacaggcgcccagcacatcctctgcctcttccttcataacacaccatgccctccacagacactctttcagccctgtacttgtctaactcgtacttgtgtatgctatagcaagctactcccttgctagtaggagctactgctggcaaaatatcagctatgcccaaactgtcctccatagccaaccacatttccagagactactgcatgtgctccatcctttagcccacttt

SEQ ID NO: 516465 - DNA, 214 bp, Homo sapiens
actcattccgctattctcaaacacaagctacgatacaggtcctggtagagaaccattcacgactcctccgggacctgtaccaccctccccgtcatgcaccgatgatcttagtaaccagagtaagattctgcctaagacacgagtcttttttcctggctccgagggctagtgccaaagtacctccctccaccgggtagggaggcgagacttgagt

SEQ ID NO: 516466 - DNA, 117 bp, Homo sapiens
agaattactatgaagacatgctcaggcagaagtcattagcggagaggcgggaaaagtagattatgatcatcacgtccagcatgagcaggatacccagcagcaatctgcccatgtgag

SEQ ID NO: 516467 - DNA, 200 bp, Homo sapiens
tcccaaaacgggttttttttttattgggggtgatgaaaacatttccctaagaaacccattttgttttacttaagaggggaagggcagtttttttttggcagttcagaatccaagcccttgatttgtggggtttggaaaactccttttttggccttttatgggtttacccataccaattcctttaagcaaaaaggtaagca

SEQ ID NO: 516468 - DNA, 792 bp, Homo sapiens
  misc_feature (496)..(496): n is a, c, g, or t
  misc_feature (519)..(519): n is a, c, g, or t
  misc_feature (523)..(523): n is a, c, g, or t
  misc_feature (552)..(553): n is a, c, g, or t
agcgggcggccgggaggctccgggaccgtggcggcgggcggcggcggcgcagccctccgcgggccatgtcctctccggcggtggcgaggacctccccaggagggagtcgggagatggccccagcgccgcagggccgaggccggttctgggaagtgggcggcggcagcggccatcggctggagcgcgcggcgcggagtcggagcgctgggagctgctgctccgccgcggggagctgctggcgctgggcggccacctgaagggcgcgctggaggcgttcgcggcggcgctgcgccgcggggcccccggccaggcccgagtgcctgggcgccctggtggactgcctggtgttcaactaccggctccgccacgggctgggctggagcgcggccccggttgcaggcgctgacggcggcgccgcgggctcctcagatgcctgggctgccggggcttcctgagcgagccggtgaccgtgccctgtggccacagctactgccgncgtgcctgcggagggaactccgngccngtgccgctctgccgggaccgctgccgccnncaccgccagtgccactgatgctgaagggaccgcccgcggccgccgctctggcgccgccatcgccgcttcagacttcagaaccagcgtcgtcctcaaccacctggccgagaagtggtttccgggccagcgcgagcgggcccgggcggccggcagctcggagagctaatggaccagggcgctaccgggaggccctggcgcgcttggagggttggagcagaacccagggacttgattgcaca

SEQ ID NO: 516469 - DNA, 636 bp, Homo sapiens
tgttacctttgtctttcattatcaagcttaattattcatctgtgggtgactgaaaaatgaaaaccacaccttcgagagatatcttttaaaaaatagaaatccctttacctacaacaacgacaacaaagggacaagtacacatgaactcaggcagcttactgggaaactggtcttctcatccctttgccctcccttcctccccctttagtaaagctggtggggcacatttgctaggatctgtgggtttcatcacttcaagccttactgcttaaaaaaatgaggtaagaaattctttatcggaaaagtgaaactgacacataaaccaaaccaggggtctcccctggctgctgcggcagccgtaatggctctaagtgggagtgtcctgtatggctttaatcatgtatacggagtccttatggccattcgggctggcctcgtcgttggccaatggagaacttgactggggaaggagctcggtcgcctgcttcccagcttgctcagtcccaactttctgcccgcatgcggccctgtcctacccttgctgggagccagctctggttctggggcccccagggcggctctaactgctgggagaaggtgttgatggggcttgtccggtaggcaggctgctggggc

SEQ ID NO: 516470 - DNA, 2476 bp, Homo sapiens
  misc_feature (2215)..(2215): n is a, c, g, or t
  misc_feature (2224)..(2224): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516471 - DNA, 409 bp, Homo sapiens
gcgtcgacataaatatctaaaccatcacaatttagctaatggaataaaatactgggtctatatggaataaattttacacatgagtgtttattcatttaaacaatgaacgttttgatagaaatatttttacaaatgtataggcagatttgtcactttcctgcctttttagacagagactacaaaaatagcattttaaagtggcatgatgacccacacagctgtaatatgctcaactaaagagcctaaaaaacctatacaattatcactttatactcaacttatgttgtatatataagttgatgcccttagagtctgatgaagcaaatatatatcaccctacattagtatcccattgatgtgtgttttgactagcagtgcctccattttaagctttttttttctttttttg

SEQ ID NO: 516472 - DNA, 3020 bp, Homo sapiens
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattaacaagagagaagaacaagaagacacaaaaacagagaaaagaaaaagaaacacataagacaaagaacaagagagaacaaagaaacaataataacaagacagaaaaagagacaacaagagacgaaagagaaacgaaaaacgtgcgcgggggcgccgtgcagagtcatggacggccccgtgaggggactccgaagccgtcagcatcccgggaccaccgcaagacactgcatgtgtgcaacaccaacagtgggggggccctccaacgtgccagagagagacgagtgacccaatagggaacgagtaggaggacgagcggagtcccgtagcagtccgcggtcatacataggccagagcaaggggaggaatgcatagagaagcggaacaaacaacggacccggtaagggaccgaacgcgaagagaacgagcgggaacaggaacgggcacaatcgctaagatagctcacttaacgaggtgaggaggagagagagtaatacaaatcgagggagcggagacaccaaacagagccacgcaatcaccatagaggtaaacctaaggcacacgcggtctccgacagccgacacctgagagaggagagaagccaaattgacaaggtcaccaagagccggagaccgactctcgtgggggagcagttcgatcgaccgaacccaaattgcaccgaggggctagactcgataatgggcaaaccgaaggggacgtcgcaagaaaaagcgcagatagcgataggcacagcgaaacaggatgcaaaaaacccacaatagagcaaagagggacgacacacaagaagatttaaccccgaaggag

SEQ ID NO: 516473 - DNA, 2611 bp, Homo sapiens
  misc_feature (2350)..(2350): n is a, c, g, or t
  misc_feature (2359)..(2359): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtgactcactgcagtacccagggacggggtatccaacgtgtgtcactcccttgatgcctagccctgcccctccttgaacctctctggctgagctgggctgggggctggggtctggggtctggctgtcactcacaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516474 - DNA, 233 bp, Homo sapiens
tatactacgggtctcagtctccaacccactaacaacctcccctggctccccacgcacggcgcggtcccgccggcttataacacaactacagcaaaagaaagccaagtggcctaatggttaccagtgtgctaggccatcttagcatggtatactagtccagatgtcgctcataagttttattctacaactacacggttggtggataagccaccaccaaaccctgctctccctca

SEQ ID NO: 516475 - DNA, 1140 bp, Homo sapiens
ggagaggccgtgtagcgtcgccgtgactccgaggagataccagtgccggtagaggggtgcaaaaatgcagagtaataaaacttttaacttgtgagaagcaaaagcatactccaagaaagcatcatcaacatcagcaccatgcagcgagcaccaccagcagcaacacgcatgcagccgtcaccaccgccaagtacctgcaagatgggcaacaggacagcagccaaaatgaacggcttgacgtattgacctgaaagaatttgacgaaaaccagtgagagaagaccttcacccaacggaagcctgtcattttctgtgggaaatcttcactcccgacatgcactgtaggaagaaatgaggcaccactatattgacgcaaatatggcaaaggcaggcgaagtcttcattcatagcggactaacaggactttaggcttcaatcctgctgtggaaaaccccgaaccctgatgccgggagattgccacatgtggacgcttggacaaaatatgccacatcctgtggaatatgcagagtgcgatggtagcgcttaagcctgaccaatagatgcatcacctatacagtgtcgaaagccttccatcaagtatgctgttccaacggaaactagactgggcaagtaacgccttaatcatgtggttagggagcaaggctaagaagagaggcatggacgtcaattggttggaattgactcgagcgaagggccccttcacggggaaccaatagggaacatcaggttggccagctgtctacaagtggcaagaggccacaggcatggccatcgtgaaaacgggcatcatgggaacaggaattgacatgctgaacatgtacatcactatcactgactaaaaaccagacaattgtcccgtacgttccatggttgaaactaggtgaaaaggcccaaaaggggaacccggggatgacgagtgacaggcacagacggagaactgaccacagaagaagagccaggcctaacaaaagaacaaaccacaggcaagatacacacaacagcgacacaggagcaaacaagcacaagcgacagagaatggcgcgacaaggactggggggccaacaggaccggacatgaacagaagatgaccaccagcgagcacggaacagaaacatacaag

SEQ ID NO: 516476 - DNA, 2289 bp, Homo sapiens
  misc_feature (2028)..(2028): n is a, c, g, or t
  misc_feature (2037)..(2037): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516477 - DNA, 321 bp, Homo sapiens
cgactcttgggatccccctgtatcccgggagagagaaaaaaggttttagatgttgggggctgttttagtctgttttcatgccactgacaaagacataaccgagattgggaaaacaaagaggtttaattggacttacagttccacatggctggggaggcctcagaatcacggagggaggcagaaggcacttcttacatggcagcggcaagagaaaaatgaggaagaagcaaaagtggaaacgctgataaacccatcaggtcttgtgagacacaatcactatcataagaatagcacaggaaagactggccccccgggatacag

SEQ ID NO: 516478 - DNA, 416 bp, Homo sapiens
gatcgcttgaggtcaggctcgtcttgaactcccgacttcaagtgaccactccatctcagcctcccaaagtgctgggattagaggcgtgagccaccgtccctggccttgagctacacttgtatcaagcactccgacacctactatcttattgataagtccccgagggggctgtcaagcagggacctagcggactgttcacactcaaattcctcccttttactgttttttgtttgtttattgtcttcttctacagcccctggcgatataatctgtcacgggagcaccagcttctttttcttcttcctgttcagtatccactatctggaaggcccctttcttgcggtctttcctttttaaaggctgtagtaaaatgaggtacttaccctaaaagtttctctgactctaaggaaaaaaaa

SEQ ID NO: 516479 - DNA, 2253 bp, Homo sapiens
  misc_feature (1992)..(1992): n is a, c, g, or t
  misc_feature (2001)..(2001): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagcaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516480 - DNA, 2711 bp, Homo sapiens
  misc_feature (2450)..(2450): n is a, c, g, or t
  misc_feature (2459)..(2459): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtgactcactgcagtacccagggacggggtatccaacgtgtgtcactcccttgatgcctagccctgcccctccttgaacctctctggctgagctgggctgggggctggggtctggggtctggctgtcactcacaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagcctggagtacagtggtgacaagatctcagctcactgcaacctctgctcccaggttcaagtgattctcctgctgacctctttgaatagctaggattaccggagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516481 - DNA, 2289 bp, Homo sapiens
  misc_feature (2028)..(2028): n is a, c, g, or t
  misc_feature (2037)..(2037): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactcggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516482 - DNA, 478 bp, Homo sapiens
  misc_feature (171)..(171): n is a, c, g, or t
  misc_feature (223)..(223): n is a, c, g, or t
ctgctcgaactggtcaccgcgcagcgggtccagcaggtagtagctgaagtccgaatacaggtccagcttgtagcgcagcgcataggccgagccggccagctcgccgccgccgatcatccgcttgaagccgccggacaggctgtagcgatgcgtcttgccgccgtcggcgcngccgccgtcgaagcagcccaggcgatcgaccaggccctcgtccaccgcgcgntgcggaatctggtcggtggagtcgaagcgggcgttgtaacccatcgcggtgagatgaaagccgcccgacccgtcctgccgcgaatagcgcaacaccacgctgccgttgaagaagttgtcgttcttccgataggcgccgtcgtagtgctcgccttcaacgccgtagagcaggctaccgccggacaagggcgcggaacccgcggcgaggccgcgcgcgtagccgtactcgcacgccgctgagctgcagcagctgctg

SEQ ID NO: 516483 - DNA, 1921 bp, Homo sapiens
  misc_feature (1660)..(1660): n is a, c, g, or t
  misc_feature (1669)..(1669): n is a, c, g, or t
gtacgggagtgggactggtttaaaggctggagtccatggagtagaacctataatgtcctggaacagtgggtttggcaatggcaaaagagggatcaagtcaggagcaggttgggaagccttggaggaggaggaggagttctctgggtgtccttgatggaggccccccagccacatcctgctgtccacagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516484 - DNA, 1298 bp, Homo sapiens
  misc_feature (1037)..(1037): n is a, c, g, or t
  misc_feature (1046)..(1046): n is a, c, g, or t
ggtagggagggttaggggatcttcccagcaagttctctaggtatgtttgagtgggaatgggtaagatcctcattactctctcccctatctccctgtccagaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516485 - DNA, 1305 bp, Homo sapiens
  misc_feature (1044)..(1044): n is a, c, g, or t
  misc_feature (1053)..(1053): n is a, c, g, or t
tataaaaatagctctgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccagggtcacggggcccagaaggcagccttggttctgctgagtgcctgcctggtgaccctttgggggctaggagagccaccagagcacactctccggtacctggtcctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcccccccaccccactagagtactccctctcacttgcggtttccttatactccacccctttctcaacggtccttttttaaagcacatctcagatacccaaaaaactaacanaaaaacaanaaacacaataccacaaggggggggcgcgccataaaagttcccccccaggggggccacaataatttagcctgcaaccacaggttgtctgggacacaagggggggcccacatcaagagggacggagagattatcaagacatggcacgtgcgccgtcggttgaacaacatgcgaagcgtgagaacaaggtgctacgagggggaacacagagaagggcaccaaacatatggtggggagacgcaggggcaccatcac

SEQ ID NO: 516486 - DNA, 391 bp, Homo sapiens
  misc_feature (78)..(78): n is a, c, g, or t
  misc_feature (391)..(391): n is a, c, g, or t
gatcttagctcatacgcagatgacgggctctgcgtcaggtctccaggagcagctccgcctccttcacagacaacggtnataacctcctccccgcaaaggctttctgtccgatttccgtttcaggacagatgaagtggaaggcccaggactgtcttcctcctggggcttctttgcatttcctttgtaactttttccttcttgcatgctgtcccacatttcaatcttctgtctccttttttcttcttcaagttgtttcagtttttccttatgcttttcaacttgcgcatttagttcttcttgcattttcagtcgagcagctgctaaggcttcttgtcgtttaacaacaacatcaggttccacagcagccgcagctcggtccagctgcctctgn

SEQ ID NO: 516487 - DNA, 296 bp, Homo sapiens
gggtgatctagaggatcccggacaagtggcagtcagggctgaatataagaaagtcacctaatagcggaagcaagcagtcactgaatgtaagaaatacatagataagttacaaaaaaaaagtgaaaggaaagtatagctcctgaaaaatgcataggctttaaatactaaagtaatatacagagaactacacaataaggatactagctacaaaaccactgggaatattaaggattccctgatactatatacaagaaaaataagatttcatagaaaaacggtgcactagacaacggcct

SEQ ID NO: 516488 - DNA, 506 bp, Homo sapiens
  misc_feature (290)..(290): n is a, c, g, or t
  misc_feature (459)..(459): n is a, c, g, or t
  misc_feature (464)..(464): n is a, c, g, or t
  misc_feature (469)..(469): n is a, c, g, or t
  misc_feature (474)..(474): n is a, c, g, or t
  misc_feature (500)..(500): n is a, c, g, or t
atgttgtctgctgtctgagaaaccacctgtccctgtcaagggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagggcaacggctgcagagggagcactgtggctgccatcccagttcctcttcaaagccaaacagacacgcgtgacttcaaaccctacagtatgggagggtnggcgttgcatttgaaattccaggggcttgagttttgatagtgggatttttaatgtagttgtttaaagggtattgaatttcatgtttttattaactgttaggagggcaaggcaagtttttttattttttttaaaaaagttttttgaggaggttaattttttaagttttcngttgncagcnaagtnggctaatttaccccctttaaattacnggggga

SEQ ID NO: 516489 - DNA, 474 bp, Homo sapiens
cgcgatgcacgatgcaggtatttgtgtgggatagtgagtagagacggggtttggcgatgtggccaggatggtctccatcttctgacctcatgatccaccggccttggcctcccaaagcgctgcgattataggcgtgagccaccgcgcctggctgaaaatcccctctacctcatctcctccacgcactgtccagcacagctctggacgctatataccacgtgcccaccaggcttcactgagagaaaaacctttcttctcaggattccagccacaacccacaactgtatgacaaagtgcagcaaggtgctccccaaatctgcaaacaaaatagtctctctattggggatctacagtcccttctagagcagttagactagatttctacaaaaatcacttcaggacagcaatcagttatttcacctccttcagtgctcctgtcatcttcagatctgacacggataacacgttcgcgag

SEQ ID NO: 516490 - DNA, 722 bp, Homo sapiens
aaggcacgatgcatcgtggtagtccatgcctttcttggacatccagaaaaggttcggcctataacatagatcgagtggttgacaatccagagtggtgaacagccctcacaagatggctggtcgatgccatgcttttgaaaacagaatggatagacatgtgcacatggaatcggcttactagctcgggccagagaacagagtgcaagatagaactagtgatgatttcgttagagtgtttgcttcggctggaaaacgatgagacgtgcagtgataccatcaggaagcagcgggaataagcgtgataaacggaacggcaaagtacaccccgtccacctcaccacattggacaagggggagacctcgtgtccctgcaacagagtcagctgctgatgtctggtaggctgattttcctgttctctgttctccactggaaaggttgtttacgacaaacctcctatgtcaaagtgtgtaaaacttcaggattgctccatcctagatgaaagatgacaaggggcctagaggacaccccgacacacaacacatcaaaacataaagaaggtccaaggaaagccaaggtggcacgatgggggtggcagcagcatgcatgtgtaggcaccattcgtggcctttggacccattctggagtgaacgtggccaccaaagtcttctcccaaaaacagggggcagcaaaagtacggggcgcgcaccctgtctattggcct

SEQ ID NO: 516491 - DNA, 441 bp, Homo sapiens
cgtggattacaattccgaacatgaagatttgggtgtggaccagagagcccaaacccatataacccaagatacctatactaagaaacaatgcccagttcccctaaagacaagagatgtgaaggagcccagagaagtaggtggaatgacaagaggaaggggcatgaaggacaagaggaaaagcatgaagaccaaatgtacttcccaagtttttgcatgtaacaagaagaaaaaagaaataaagggttaagtcagttccaatggtggcagatagatcagatttttgtttaagtgtttagatgtcttttggcagagacaactggttatgccacacttcagcatacctattgcctacaaccttgttctgcatttcccatgagaccatgaggctttttattcaagatcattttgctctgaaatttacctttctctgaaaaaaaaaaa

SEQ ID NO: 516492 - DNA, 277 bp, Homo sapiens
tggagcgtaccgggttttctccaggcgggtttcttatactctccttcttgtggcaccccttcccattttccctgcgggtttttcttggaaaattttcttccccccctccagtttcgcgtggtcgggccctcagcatgtggtggtgaagaggggcaggggtgccggttaaagtgggcgcggggcgcggggcaaccggggccggcgcctgggtaagtggcgggggcactatggtgagaagtctggcgtgggggggcgggcggggtatccgggcaacctc

SEQ ID NO: 516493 - DNA, 243 bp, Homo sapiens
tcgcgaaggaggtaggacacagaactaaaactattatttacatctaacagacacactacaagtagaatcaattggaaaatcatgtatttatgcttccatagggaacatttgggttatttaaatggtccataaggtcccatatttcaccggttcagtgtatacggtacttggcaatcatctttccttttttcacatagggtaaaaataagtgggcatccgataggatcatggattttataattg

SEQ ID NO: 516494 - DNA, 151 bp, Homo sapiens
cgactcgtagcagtgatccccggcatatatgaggactaagcggcaaagtgaaaccagaccagaggactggatgagtgagattgagctgagatggagtcctggatatgaaaaagactagaggtgaacttaatgcttgtcatatggtggccag

SEQ ID NO: 516495 - DNA, 274 bp, Homo sapiens
  misc_feature (15)..(15): n is a, c, g, or t
ggcacctgacagtantgggtgaaggcgagcatagcacttgcgacagatcatcttgacgcagtgtatatcttgggcaagctggctggagagaaggctcaataatgccacctcgcaggccgcaacaccaggtgccagggtggactctatatctaggatgtagtagtactagagagagtgcggccatcctccagctgtttgccggcaaatatcagacgctgctggtcaggtgggataccctccttgtctttgaatatatggcttttgacatatctca

SEQ ID NO: 516496 - DNA, 215 bp, Homo sapiens
accaggccacgaggaaccgcagagagaaagggcagtaagtttcaggaccctggagttgctaggcagtgttaattctcttccccttccttgagatagctctttttttgttctgtagcaaaaacttagcagtccttacacagtgggaatgaggattagaacttccagatgtgggccattctctcctgagtctgtatttcctctcccacagagctaaa

SEQ ID NO: 516497 - DNA, 1169 bp, Homo sapiens
gcaggaggcccctcaggcccgtgcgggccattgtctgctgtccgcctgccggggtggcagagtgagttgtctcaggaccgccgtctactgcgacgttgacacgtcctctcccttcccttcctcctcacaattgccccaaacactgtggaaggggatgaaggaagtgatccacagcattcaggccacttggggtctagaccatggtggtgccgagcctggggggggcagtggtcctcagctctgcccgctggatgcggttgatgtgcatgacagggtgcgcctcttccctctagccccgcatcacctgctgtgtgccatgcctgagacggttcctgcctgtcttgcggggtcggtgggagcgtggcggcacgttctgccagccgttggcagggctggctatggggcatccaggactgtgggggtctggaggaggggacatgaggtgagaggtatcctggaccgagggcgtgaggcagacgggaggtctccctaccgtgactacctcagggatgctgagcggtgcagggcatccagggcgaggccctgggcacagagtcaaggctcagaggacttcacggttagctagtctcatcataacacttgccattacgaatggtgctcgcttgctcgcaactaaccacgttgtgacctctcaacgacgcccgccacccacgacccccccacggccaacatattacccgagatcgctccaccacacgtgactaccagagcggtacctcgtggcaccagcgtgcagcctcgacccaacgttcctggtcccaacgggaaaaaccggcgggaccaccaaaaagtacgatccatataactctggaaaacccgtgtaaccggcatagtactcccaagaacccaccccccaccgcgccctgacctggtgcgtcaaccgctatcccacacccaacgcgacgagcatcgtaccacccagcgccgcacatccaccacaccctctgaccccagcgtgccccgcacctcaaacaccaacacacattcgcccgctggacctgttccccatcacagaggagctaaccacgcacacctccagcgctcgacccgaacctgacccaccgagcgattcacgtacccaacacacgcgcgcagcgagacaccccaccataccccaccacaccggctccctacgagtacccacaccg

SEQ ID NO: 516498 - DNA, 196 bp, Homo sapiens
  misc_feature (76)..(76): n is a, c, g, or t
gcctgagtcacatttttacatggttctggtgctcttcctgcaggtcaagaaggagccagtatcttcagggggagtnagagagttctctgccaagtgtgaagtgtgaattcttgagaggctgttgcaagggtaccatggcttaatgtgtagagacaagagacaacttgagagcttttgctttctctcagggagagag

SEQ ID NO: 516499 - DNA, 194 bp, Homo sapiens
aaatccccgtgcggctccagccccgggtctcgctcaggagcgatgagaggggcgccctggccacacaggctttcctgaagcgtgcacagtgggtgaggggctccacgacaaaaggacaagatttgacttaaattaagtttttcccttgaggatattttcattttctttaaaagaatataattttcttttaagga

SEQ ID NO: 516500 - DNA, 399 bp, Homo sapiens
cagttatttctctcttctaatgatcattcaatcaggaggtcagcatgcagagattgggtaacagcaaaagcccatctccagagataaaattcaaaatggtacagctcgtcgtgctgactcacaccaggcaagctgaggccctgaactgtgtcactgacttaactgatcataatttgtgcttttcagatgaatgaagttacttattctaccctgaactttgaagcccagcaacccacacaaccaacttcagcctccccatccctaacagccacagaaataatttatacagaagtaaaaatgcagtaatgaaacctgtcctgctcactgcagtgctgatgtatttcaagtctctcaccctcatcactaggagattcctttcccctgtaggggtagaggggt

SEQ ID NO: 516501 - DNA, 598 bp, Homo sapiens
taataaagtcaccacccttctgtcaacaacctccaccaaaatttcgtgcagaaacacttaattctcgccacctgtcgctccactcttcaataccacaaatgttgcccacacaaaatgtttttttcactctcttttcgaccaaaattttggttcgaacatccgctgttgaccaatgaccctctgtttataatcgttgaacaactgctcgtacatctagcaccaagaagttcgttcgacacttctctaatcaatcacattggggaaaacatcttctctttcctcttatttactcataatcacctcattttccacacaattatctaactgaggtggctccacatgtttcactgcactggagcataatattcttttttagtacacacatatgataatgtgcccccaccgcgtgtatctttctcttattaaacaatttttaacggcgaaagtgtcccccaaatgaaagatgttgcccttgttacacccaactacaattatccccgatttttaataaacttgctgactaataccacctaagaaaacatttgggtaatcttggctttgttttccaatataaaaattgaaccccaaaataaaaaaa

SEQ ID NO: 516502 - DNA, 188 bp, Homo sapiens
attcgcggccgcgtcgacgaggaaaacagaggggttttttttttccccaaaatggggcctgtggcacctgctctgttttcccaatgagttctaggttaccggaagttattttagggtctttcctgtgtgcattatgtgtggctagactaacacaagatgaactggatgttttaggaaatggttccctc

SEQ ID NO: 516503 - DNA, 528 bp, Homo sapiens
ggtatgggaagaacccagcaccactaataaagctgctgctggctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagcggaggtgcgcggcgcgggcggcgccgcccgaaatactacaaacgcaatacaagtagggggagcgcggccgcagcgaccgcagcgagcaggagtgaaatgcgaaggcggcgcgagtgttatacaatgcatagataggcgctagcagaagtcgaagagatgtgagggagcttggaggtagaaacaacacaccagtcgaggagcgctggggggtagcggggagtcatacgaactaacgataaaagggtgtggagggtggaagagtaagggaaaatacaagagtgacacatgggtcgcggcgccgacgcgtatgatcaactagccccccgggggggttta

SEQ ID NO: 516504 - DNA, 215 bp, Homo sapiens
actgtgtattattcatctccttcataaatttaatgtagcatacgaataggagtccctaaagacccattgttccattaggcttgatgtccaagggcagttattcagcaaactcaaccaaaccctttttaaaagtatttcgaagtgaaagtggacatagtattcatacgagggaaaaagctcctttagaaacggagaacacagtcatattgagacgt

SEQ ID NO: 516505 - DNA, 609 bp, Homo sapiens
  misc_feature (29)..(29): n is a, c, g, or t
  misc_feature (73)..(73): n is a, c, g, or t
  misc_feature (134)..(134): n is a, c, g, or t
  misc_feature (152)..(152): n is a, c, g, or t
  misc_feature (164)..(164): n is a, c, g, or t
  misc_feature (191)..(191): n is a, c, g, or t
  misc_feature (202)..(202): n is a, c, g, or t
  misc_feature (226)..(226): n is a, c, g, or t
  misc_feature (242)..(243): n is a, c, g, or t
  misc_feature (339)..(339): n is a, c, g, or t
  misc_feature (343)..(343): n is a, c, g, or t
  misc_feature (398)..(398): n is a, c, g, or t
  misc_feature (412)..(412): n is a, c, g, or t
  misc_feature (421)..(421): n is a, c, g, or t
  misc_feature (436)..(436): n is a, c, g, or t
  misc_feature (558)..(558): n is a, c, g, or t
ctcacaccctggaggcagcagcataagcnccagtttccactatggtgtctcctcaatgacaagaatacccgcnagttccaggggtcagcaattccattctctctctccggctcagttcagaagctgtgatggtnctgttagagagcactgcntgcaggtcaaangctggaagaggctctcccaggccaggngacaacccttnaggtgcagagggggaacaaaaggnttaagctgtgataatnncaacaccttctgaaaaaagagtaaaagttatccagcaacgggccatgggtaggggcgggcggtagcaggggaactgtcccctgcctcagcatgttntgtncagagggtgggcacagatataggctcgctttttaaggatttgctgggacactttnttaatttgctgatntaggttttntggagcatacttgtncagctgagagaggctgaagagattttgcaagtaagcttccacgcagaaggtgttggccaagagaacctcgtggtcgtggttgctgagcccaatggggatggagcggctggaccgcgaaaganggccgttatgccataaaggttgatgaggatgttggccacccgctttagtac

SEQ ID NO: 516506 - DNA, 225 bp, Homo sapiens
  misc_feature (208)..(208): n is a, c, g, or t
tgctgaggtcgactctacgacggactcccctctaccctgcgcgggtgcattctaccctcgcgggtgccttctaccctcgcggggtgcctctaccctacgcgggtgcctgcctacgtgctggacgtacggggaccacactgggacactcctacgacggggactggacagaccgctggggacgtgacgcgtgggtgcactttttacactncttacgacgcgggtacc

SEQ ID NO: 516507 - DNA, 308 bp, Homo sapiens
tagctgagttggtgagaggcctggaatgctgctgatggtctacccgtgtacccagagagtcgatgagtcctttggggatctgaccactcctgatgctgtaatgggcaaccctaaggtgaaggctcatggcatgaaagtgctcggtgcctttagttgatgggctggatcaactggagcaacctcaagggcacctttgccacactgaagatgagctgcactgtgaacatgctgcacgtggaatcctgagaacttcaggctcctgggcaattgtgctggtctgtgtactggcccctcacttttggcaaaag

SEQ ID NO: 516508 - DNA, 119 bp, Homo sapiens
tttcggctccattataaaagacataacagtattagatcccacagctaccttggaaaaaagtccttctccagcacgggaaataagagattcagcaacataaaccctttctgattcatagg

SEQ ID NO: 516509 - DNA, 100 bp, Homo sapiens
acggccgtgtattactgtgcgagaggggacattgacttgtattacgatattttgactggttatacaaagtggggccagggaaccctggtcaccgtctcct

SEQ ID NO: 516510 - DNA, 135 bp, Homo sapiens
ttgggctgtcgtgccggagcaaggccaggaggctgaaggagtcatgcgcatgatggggctcagcagtgtggctgcactggagtgcctgtttcctctttttcttcctcttcctcctcatcgccgcctccttcatga

SEQ ID NO: 516511 - DNA, 967 bp, Homo sapiens
  misc_feature (78)..(78): n is a, c, g, or t
  misc_feature (126)..(126): n is a, c, g, or t
gctgagctatgattaggtagagacacatcagggtggctggcatagtcggcgcgactgaggcgcccagcgctgctaganggaatggtcaaggcgctcggtatgtgtcagtgccatcctgacaagccntctctggtgcttgtcgtgaacttgcgtgcctcagagctcgagcagattgcttccagcgtctgcattgctcggacaagctggggtatagagatgatccccgttcaggcaaagtccgaggcatgaagtgcagtcgcacttcaaggtcgcgagtcacgtggagggacctcgggactgctctctggttgggcccacggggctctacaggtactgtgtggcactggtgggatagaagactaggcctaggtgggtaattaggtcctctggcgacccaagcgatcgtagactagaagcaatggcgtagaggaggaccgcgaagcttgaccttgcgggaccgatgtcgctttggattcgtcgctccggcgtacgaaggtcggacttagtttggttaacgaaccacccttaaccggacgtgggaggatctattggggcgttggaacacgaaagacattgcacatgtccctaagggggggacaactcaattggaagaacgggctcactcataccttaaaaaactttaaccgcagtttgccaccgccataacttggttcaccagatggggctaattgggcattggcctccatttggagacgccatagggagatagcgggtgccatgcgtccttttaggtccaaacatgacaaccggcggccctttgcggagcgaatggggtttgcccctagaaagcgacaacggacaccccttgtgcgcccagggcaaggtaaatcacgctcccgggtcgacagcgacagcacatcacaaaacgcgccacagagtgaagctccgcagtaaatggaaccccaattggggcagaaccaccacacacattatacagaaaagacac

SEQ ID NO: 516512 - DNA, 405 bp, Homo sapiens
gatcggtaccagttacaagtcaggagttggaaaccagcctgacggcatggtgaaaccccgtctctactaaaaatataaaaaattacccgggcgtggtggcgggcgcctgtagtcccagctactcaggaggctgaggcaggagaatggcatggacccgggaggtggagcttgcagtgggccaagatcacgccactgcactccagcctgggagacagagcgagactccatctcaaaaaaaaaaaaagaaagaaagaaagaaaaagaaaaaaaaagaatttctgggcttggaacccaggcactggaactgtgaaaactttctcaggtaatcccagtgggaagtaactttgagaagcaatgatttcttgaccttaggagttctgcaaagggagggaagctggactctgg

SEQ ID NO: 516513 - DNA, 641 bp, Homo sapiens
tggcccttagtctcttccacatattataataaatgggggttagatactctacaaacaagactattatataagatttattatatgactcatcctaatggtttaaatctggaaaatttaaaattagactatttacacattttatctaaaggctttcccttcatttcaaaatatgttcaacatttctagcactatttaaaattgaattgggtttacttcttctctcctgggatttaaaagagaaactatttgctatgtatcaagataaaggtttccatgtaaatcactcttatatttctcaagcctacaaataccttaaccaatgagattgaaatgtgagctactttttatactagtggggcttcggattgtgcattcagcattaaaaaacaaagcgattatgccaaattatagcaagaccctcaattaacaagtaaccattaaccatgtgagcggagacaactaagacgcaatagcacagaccaattcagtgtgccagtctttttaacacagtgagcaccatgggctgtgaatgggactctcatataaggccacttatttccccttaagaaccgtgcgtgtttgtgctttacggctgctccatagaggcctgaacctttcctacccgtgtaagcctattgccc

SEQ ID NO: 516514 - DNA, 97 bp, Homo sapiens
  misc_feature (58)..(58): n is a, c, g, or t
gagggagacatggcacaagtcagagcacagcaggagccaacctaattgtgggaagaangttagaattacgccgatgaatttgataggggaaatggat

SEQ ID NO: 516515 - DNA, 963 bp, Homo sapiens
  misc_feature (86)..(86): n is a, c, g, or t
  misc_feature (312)..(313): n is a, c, g, or t
  misc_feature (315)..(315): n is a, c, g, or t
  misc_feature (323)..(324): n is a, c, g, or t
  misc_feature (409)..(409): n is a, c, g, or t
  misc_feature (412)..(412): n is a, c, g, or t
  misc_feature (421)..(421): n is a, c, g, or t
  misc_feature (428)..(428): n is a, c, g, or t
  misc_feature (442)..(442): n is a, c, g, or t
  misc_feature (444)..(444): n is a, c, g, or t
  misc_feature (446)..(447): n is a, c, g, or t
  misc_feature (453)..(453): n is a, c, g, or t
  misc_feature (463)..(463): n is a, c, g, or t
  misc_feature (466)..(466): n is a, c, g, or t
  misc_feature (478)..(478): n is a, c, g, or t
  misc_feature (480)..(480): n is a, c, g, or t
  misc_feature (482)..(482): n is a, c, g, or t
  misc_feature (498)..(498): n is a, c, g, or t
  misc_feature (504)..(505): n is a, c, g, or t
  misc_feature (512)..(512): n is a, c, g, or t
  misc_feature (523)..(523): n is a, c, g, or t
  misc_feature (548)..(548): n is a, c, g, or t
  misc_feature (553)..(554): n is a, c, g, or t
  misc_feature (562)..(563): n is a, c, g, or t
  misc_feature (567)..(567): n is a, c, g, or t
  misc_feature (575)..(575): n is a, c, g, or t
  misc_feature (585)..(585): n is a, c, g, or t
  misc_feature (590)..(591): n is a, c, g, or t
  misc_feature (932)..(932): n is a, c, g, or t
agcgggaccgcgagcgagagcgcccccgagcagcgcccgcgccctccgcgccttctccgccgggacctcgagcgaaagacgcccgnccgccgcccagccctcgcctccctgcccaccgggcccaccgcgccgccaccccgaccccgctgcgcacggcctgtccgctgcgacaccagctggttggcgtcttcgtcgccgcgctcgccccgggctactcctgcgcgccacaatgagctcccgcatcgccagggcgctcgcctttagtcgtcacccttctccacttgaccaggctggcgctctccacctgccccnntngctgccanngccccctggaggcgcccaagtgcgcgccgggagtcgggctggtccgggagggctgcggtgctgtaaggtgtgcgccaagcagccnaangaggactgnagaaaanggcagccctggaananannaagggngctggaatgnaanttcggcgccagncnancgctctaaaggggatntgaaannatcagtnagagggcagancctgtgaatataatccagaatctancaaannggggaaannttcnagcccaantgtaaacatnagtgnncatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggagctcgcatcctatacaacctttacaaggcagaaatgtattgttcaacaacttcatggnccagtgctcaagactgtggactggtatctca

SEQ ID NO: 516516 - DNA, 376 bp, Homo sapiens
cgtcggactacatatgtgtagtttttgttaccaagcatccatagcacacccgaggatgacaggcctccaagtgggatctggaccgagtcaacttcttgctcggatgattatggtggggcctcaactttcactaaagcaatgctgttgttacagaattggacctgactttgaagaacaaaacacaacagacatacacgagtataaaattttatgctaaaaaatgactcgcaatgaatcaatcagtagcacattgcatctgttaagtgtcccaggtccctgtaatggttatgtttccaacggttgcttcgtttccaagataatggtgtaggtgttacaccccaatcttcatgtccacattctgcaggttccttgtctc

SEQ ID NO: 516517 - DNA, 391 bp, Homo sapiens
gaggggtaggaaagaggactagcatctattcttatatttgtggcgacacatgatgacgcttcatgtaaaacagaacatacagtgaaccccaaaatcataaatgccaagtactccatgtacatatggactcatcactatgagttactagtagctggatgccatttctcctcatcaacccaaatcccgcatcccagatggaccttgacattgtctaggatatacttgatccatgaccggcgcaggagcgggataataggacgacgtattagctacctcactgaaaagtgctccgtacctccggctcgggctcgagacattctgactttactttatccagatcaatggcgggaccgctgccaagcttcaggagcagcacgtcctggagcctccg

SEQ ID NO: 516518 - DNA, 275 bp, Homo sapiens
ctgcagagctccaagctgctaactatagcatttggagccatcatgtccagctacctcggcccagagcccagggaaggctggcaggcgtctcatctcccatgtggagctgacaccagcggctgagtcggaaaggagggagccttaccaagactcctgcaaaacccttgacctctccacgtggtgccgctctgcccctctcaggctgtgttacctgtgacagcagctctgccccaccccatgggcctcatgaataaatggcttcttgccggcttcct

SEQ ID NO: 516519 - DNA, 109 bp, Homo sapiens
gtcaaattatttttttcaccatccacatccaacagcatcattcccatcacaaccattccactgttcatcaccatgttccaacattctccacaccatcgccacagatgcc

SEQ ID NO: 516520 - DNA, 253 bp, Homo sapiens
  misc_feature (34)..(34): n is a, c, g, or t
  misc_feature (42)..(43): n is a, c, g, or t
  misc_feature (147)..(147): n is a, c, g, or t
  misc_feature (197)..(197): n is a, c, g, or t
  misc_feature (206)..(206): n is a, c, g, or t
atacttgctggtctgatccatgcacaaggcgggnctgctagnntcttgtgccggggcttggaattcggtgcggatggcagctccgggatgacccgccggacccgctcgcaaataaggtggcctggtaacggcttcaccgacgggatnggctttcgcatcgcccggcgtttggccaggacgggcccatgtggtcgtancagccgaanagcagaattttgacaagccgtgcacgctcaggggaagggcttaacgt

SEQ ID NO: 516521 - DNA, 303 bp, Homo sapiens
tggtcgactctacgacggactccccctactgttctcgactcgttactgacgacgaactacggtccggaccaacgtctgactggtacgtggtcatacctcccacagtctgacggacggggaggactcaccattagcctcgggtgcctggaaacgacgaaccactatcccgaggcagaccgtttacagaatgagctgtaggaaactggcgcagctgtacaatggctagttccaaaacttttccccaaggtatggactgtgtgcatacccgtaaacaccggtccggcacacctacctctccctctt

SEQ ID NO: 516522 - DNA, 1335 bp, Homo sapiens
gcgcgtgggtgagggatgggtcaggtctagaatatgccttccgtatgtctcgtctcagtgcccggctactttggtctgaaggtcgaccagggcctacgtaagttccaagatctatgagaagtggtgaaactgtattagatgaacgtgcccgtaggccgagaggaagaaggagacttatgatgggctatccgaaatcaccacagcttacgcatggagctcattgcacgtagcagctccgactttcgttgagacctctaccatgacgatgatgcatcacggattttagtggattgagcatcaaaggactaatatgaagcttcgtcggaaacggagaaatgcaaagaaagtgatgagagggaagaagagcgaggctgaagaggacattagtggtcggtcctctcactcagggagacctttcattccctcagatgcgcgcgagagacagaaagtagcatcttagtatggtcttatccgaacatacttggacggacatggtcaatctttccttgaacatgaatgctgtatctcggagggaaacatgagtccattctcctttggtgtgaagaatcgtaatcgcggatcacacttgtagggctgggtatcgtgggaaacaagcagtgctagactcgtggcacaagttatcttggccatagagccgcggtgaagtcgtcgaagggttaaccctgaattccttcctaattgacaactaaaagtaaccctaaaaaaaagaaaaaaggaaaaacacacaacacaaaggccacacacgacacacaaaacaagagacaacaaacagcgcggagaggaatacatatcacagggggccggaggaaaaaaagagagagagaaaaacaaagaacggcaagaacggtgagcgcaaacatacaaggatgtcgagtagcccgccgcaacttctgctgatcacacaagaggagggagaacgagacacgggagcccacacacaataggaaggggggcgacgatcaatatcccaaaccaagccgggggttccctgtattatatcaatagacgcgaaagacagaaggaagggcagcgaggaaagggacggaacgcagagcacacgcgaagagagaggcgacacaaacgagccggaagaagggaacgcgggcgaaccgcgcggaagggaacacacggagaggaagcggaagagaagagcggagcagacgacaaaccaacgccaaggcaaaagagagaacaaagaccagggacgcgagagagaaggaagaatagaaagacagactgaagagaagaagagagcgggcgacgcaagagagaagcaagggaaccaagaagaaccggagccgcagcagaaggcag

SEQ ID NO: 516523 - DNA, 147 bp, Homo sapiens
ttaaggtcgggcgcggacgtcttgcatgtgtgactgcgtcgagtcgtactctctcggaggagctgagcgcgtgctctcttgctcgagtcaggcgagtagccagctctcttatgcacgctattccgctcgcgtgtgtgagtgagccgg

SEQ ID NO: 516524 - DNA, 242 bp, Homo sapiens
aagagacatatacaactcatctcggtacctggttacgggagtggctggaccagcgcgatggtgccttcctccagaaaggtgaggggattctggggttccaacgccccctgaggccacttcttggctgtgtggcttgggcgagttacttaacctctctgggcctgtttcgccagctgttacatgggagtgctccgaacagaactgccttcgtggtgtcactgtggaccccactcccgtaccag

SEQ ID NO: 516525 - DNA, 168 bp, Homo sapiens
actataagaatgaattttgcaaaaatttgtaagtaagctattttggggccggggaaaaattttctgttgggaactgttttttgttccccaaaccagataaaaaccgcatataactttgtgacattttttttgttttgaaacatcattaaaagaaagacagtccattga

SEQ ID NO: 516526 - DNA, 819 bp, Homo sapiens
tggaaacagattctcgctctgtcatccagaacgggagtgccggggtgtgatctgggtataggaacctctgcctccggggttcaaggtggattctcctggcctcagcctcccaagtagctggggacttgctgggcacttgccaccatgcccagttaattttggtattttaagtagagatgggggttccactggtgtgggccaggctgggtctcaaactcctgacctcgtgatccgcccgcctgggcctcccagagtggctggggattacaggctgtgagccaaccacgcttgggcctgggtttggtattcttaccagtagtcggggtcataaatataagaggaacaaggatcaaatacgtggctaaatggccggtagcactcagtaacaatttcttcctaagggtagtccagtcgtgtcctggacctggctctgtgaggttccagttgttttcagcacaggaaaatctggcttaagcatggagacccgccggaaatgaggtgaataactcctctaatttcctgctattcttagtgtcatgtcactcatgacttagactggccccttagacctggtgtgaataatctccatagtttcccagaaattaagactccaccatcttggccccacgcgggaggtggtggcttcacaccctgtggtataccccataatcgtgctgcttgtggtggccgcctgtgagaacgggataaaaggaggccgggggatactggacaaaaggggacattgcctttggtcgtgccccaggcctggccaaaaacccgcggcgagcggcgccaacggggggcgcgcgattacaagag

SEQ ID NO: 516527 - DNA, 1812 bp, Homo sapiens
gggatttcccagctgcacagcggaactccgacggccacccctcttgcgtctcaggggttttgggcgtcaggaccagccaggctgtgttgaacgaggaggccagaaggctagtccagtgaataggggtactctatgtatcagcaattccgcgtgaccggatgctactcgagaattagctagaaggctaggcccatgatccatgaagttgcttcatcgtgacagcggcgggagactcgtaacgaataactcgaaaggcgaaacagacctgcttgctacagtggaggcatactactagatgaaccgtgcacgtgataagctgcacggaaacccgaagcctttgagtacttgcttatccattggggggactggagtgagagcccttgaaggaaccgcccgctaacgtgggtaaaacattcgttccgcgatcgtgtttctcggagaacaaaccgtgcgcaaaggtggagaggcaggtgatcgcagcggagaatggcctgaaagttaggtcgtcgggagtaagttgaaggcaggcgcattggatgcttgactggtggacgcggccgtagtgtgagcaatagcgtacaacccggaacaatttgtggagagaatagttccccctggtcgcgagccagtgcctgggcgaggcgccgcgtaggccacgggtccaaacccagggccatgggaggcactggccaaagagtgggaagcctgaagggtaagagacgaacgtgggatctttcccaggtgagatgaaaaatcgcatttgaaggcactacggaggcccatttcgctttgtgggtctgcttgggcacgaagagaccaagcaaaattggaggaagttctcaccgtttggactgtttacaacacaagacataagatggacccaggcaaaacatcggttctgaattcttggccttgttccccccaaaggggagagaaagtggcattcacgcaaacagtttaatgcgccgtttgtctccactccggtcccattttgcagtggtggactctctaaggtgggtagcccgcaggcatttgtgcagcacagtgggccccaatggcgatttcattgggcgatgtcgcaaatggggcacgtcgcatggggggaacacatgttgagcgttccaaagctttgtggaatgcgcaacgtgacatggtcttggtcatcaggaataaaaaccaggggtgggagaccaaatgtgggtcccctttttcgtgcccatgtcaatgtgaaactggtgaaggacaaagccaaattgtggtatagcgccgcgtagcgagtggttcacatagggcacacaaacctccatttaggcgtagtgatcacccgttttaggtcgcaaccattgtgtagacacggataattgtcaactgggcacggagctattaaaaacgggcagcggataccaaggcgagagtctattaggagcagcgaccatgagccaaccaggcagtgtgtctctaagaagagatgataggacggaaccctcacacaatcttcatactcactttgcaagagtagctgcacaaaactcttggattgatcacaccaacacaacaaacaccgcaatgcactcacgtgacgatacctacaacaacacacgaaacactactacatcattatactctatcacaccaactatgatacacaactaaaacaacaagaccaacttatctagcacgacaacatagtaagaccatcaatataacactatacatcactaaacacaagtgacaccatcccatcaactaaatcatagctactgttacttatctatcattgactctctttatacttaacattagggcacccac

SEQ ID NO: 516528 - DNA, 152 bp, Homo sapiens
  misc_feature (16)..(16): n is a, c, g, or t
  misc_feature (82)..(82): n is a, c, g, or t
  misc_feature (110)..(110): n is a, c, g, or t
attatttttacttatntggaatttacagagcacacctaagcaattaggatataaccaaaactaaccatttttgcaaccattntgttttttaagcctttttatttctaaanagatgaaaacttataaataaattcttaatttgtaattacttt

SEQ ID NO: 516529 - DNA, 343 bp, Homo sapiens
gagctctggctaattcttgtatttatagtagagacggggtttcacccatgtcggccagtgctggtctcacactccacttgccatggtgcccatcctcaacggcaatgtgagcgcagcgaatgcgaagatcatcttgcagtgctgcacctcttgctatgagactcttacctgaggttagcgacactgtctgagattgctgggccctgcaggggctggatcttatcagacgctaagatacagcccctgcaggaacacggtcctgcgggtgggctatgggcgcagcccagggctggcatgtgctacgagcagtgtaccaccagcgggaacagatgtcattaagaac

SEQ ID NO: 516530 - DNA, 201 bp, Homo sapiens
ggactttcgctgtgtctcgtgctcagagatgctgcactcccattgtgtcacagcgggcactcctgaagttacatttgaaggaagtatttctaagcgtgattaatgcagtcaatgtttctgatgcacactgagaaactgctttagcatgagtattcctggagaaattcagtgtgtgttttttaagtcgcgaaagtcaaggat

SEQ ID NO: 516531 - DNA, 204 bp, Homo sapiens
  misc_feature (50)..(50): n is a, c, g, or t
  misc_feature (61)..(61): n is a, c, g, or t
  misc_feature (64)..(64): n is a, c, g, or t
  misc_feature (69)..(69): n is a, c, g, or t
  misc_feature (86)..(86): n is a, c, g, or t
  misc_feature (93)..(93): n is a, c, g, or t
  misc_feature (107)..(107): n is a, c, g, or t
  misc_feature (109)..(109): n is a, c, g, or t
  misc_feature (156)..(156): n is a, c, g, or t
  misc_feature (164)..(164): n is a, c, g, or t
  misc_feature (180)..(180): n is a, c, g, or t
  misc_feature (184)..(184): n is a, c, g, or t
  misc_feature (190)..(190): n is a, c, g, or t
  misc_feature (199)..(199): n is a, c, g, or t
cccccccagccccccggcttcatctgcctggacatcagtgaaagacatcnccgtgttaacnggntagangtcaacacactgaaganaaatgtngggattcgcctggngngggaggaatgaaagtagggtaattaatgaaagcagcttacatatttnccattgcnctcttagcaatatgcncccntccccnttctgcctnttctc

SEQ ID NO: 516532 - DNA, 379 bp, Homo sapiens
  misc_feature (18)..(18): n is a, c, g, or t
  misc_feature (366)..(367): n is a, c, g, or t
  misc_feature (369)..(369): n is a, c, g, or t
  misc_feature (372)..(372): n is a, c, g, or t
gcggtaattttggtaccngttaaattaacctctcccctagcctcccctccccctacccttccccaatctctcataacccacaattcctactctcctagatcctatgagcctcattttttaagtccctgcatttgagtgagaagatgaagtatttatctttctgcgcatgacttgctttgcttaacataatatcctccagattcatccacgttggtgcaaatggaaggattccatactttattttatggctgattattgttccattgtgtgtataccatattttctttattcacctgtttatggatatttatgttgattccatacgtttgctattgtgaatagtgatgcaataaacataggggcatnnanatnacctttg

SEQ ID NO: 516533 - DNA, 249 bp, Homo sapiens
ctggagtgcagtggcgtgatcttggctcactgcaacctccacctcctgatcttcctgcctaggcctcccgagtggctgggactacaggcacataccacgcccacctaatttttttttttttttttttttttggaattttaagaaaagagggggtttaaccttgtgggccaggagggtttggattttttgactttgggatcttccaactttggcttccaaaagggttgggaggggtcccgagctcaaatt

SEQ ID NO: 516534 - DNA, 124 bp, Homo sapiens
ggctggcttcagagagactatagtcattttgtccaatattggaagtaacaagctgtttaatattggacaaaactggctggcttcaaaactatagtcattaataaactaagcttgtatgtgcaag

SEQ ID NO: 516535 - DNA, 386 bp, Homo sapiens
ggaccaaaggtgggcgcatcatgccaggacgaggtggaggaatacctggaggtgcagtgggaggtagccttggtgggggtcacgaggagtggggaccaggaggcagacctggatggtggacctggtgggagtggccagtgggtcggcctggatggtggtcctgtgaggtaaacagtcggggataagggccctctggagtccatggcattccagagtggtctcagtgaatggaaggagctccgtggagagtggaccaaggagagaaggcctgataggatggcccagtgaggcctgtaatggtcggagccaggtgagtggtccaagcaggtaggtggtcctggcattgggaggtgcttgtatctagagaaggaggaacagactgcggc

SEQ ID NO: 516536 - DNA, 286 bp, Homo sapiens
  misc_feature (127)..(127): n is a, c, g, or t
cccgaaaaaaaaaaaaggggggggcccctttggggccccccccccccccctttttttaagttttttccttttggcgggggggggaaaaaaaattaaggcgggggttttttttcccctccccaatttnaaaccggtttcccctaaaaagggtttaaggggggcccggggctttcccccccccttttttttttgggggttttttttttttgggaaaaaacccccccaaatttttaatttttttttttccccccctttttttaaaaaaaaagggggggggcccccccca

SEQ ID NO: 516537 - DNA, 1108 bp, Homo sapiens
  misc_feature (251)..(251): n is a, c, g, or t
ggagagagagagagaactagtctcgaggtttttatttttttattttttccagggtagtaaaccatttaatgggaaacgggttaaaaattagggcaccccaagcctttatggttcccttgaaggtaacaggtttgggtggggtggctcttaaggtggttatttcaagaaaaaacgcatgttgggactagaaaaccggaccttacaggactgtgggtgtttctacaactggagccgcaagggcgctgactacngctggtattctcaaaaccagacgccctagccgccagttcagacaccctacgctcaggaagcggtattttggcaaccgccaccactaactggctatcctatacagatgtccactggaatgtcttattacaccaagtggtctttaatggatataaacatatacaaagtccaatttggatgggctggctataaatatcacttagagaactcttttgccaaaatcctttatacatacaaattcacaaattcgcccaaaaggctcaggggaaaactcacgccttgaaaacacggcggctacagggttcatatctctttggggagaaaattctcaggcccatagagaattgtatccccgcgtcaacagaatttctaccaccgagctccaaaaagggggctatatcagagcgtgtttgagaacgaagttctctgttgaaaggtgtctccggggaactcaggtgaactcgtgcgcgtggtaacacctcttagttcccacccgttgaaaaaacaggtcctctcaccaagatatttctccaacttgaaacgttggggaaaacgtgtgtctgcaaaaatgtgtgaaaacgcgcatcttcctggaactccttgaaagggtggcgtggtcgtgaaaccataattttttcccccccagagaggccaaaaagtgttgttttaaaaaactgccgagaggccacatctcgtggaaaagcggggcacctaaattttcccaaaagctttcctcttgagggccagccaccttctacgaggggaaactttcccccgacaaggccttgcttttccccgttaccgacaaaagcggcgcgtgtgaccgtgatcacctaagagggcccaggttaatccggga

SEQ ID NO: 516538 - DNA, 131 bp, Homo sapiens
  misc_feature (50)..(50): n is a, c, g, or t
aacactgtggaatattagattcacagtattcagttactttaattgtcagncaatattaaattttatagaacttggggaaatttgacttgcgggttgatggatttccatgagtcttcttcttcctgaacgtc

SEQ ID NO: 516539 - DNA, 311 bp, Homo sapiens
  misc_feature (35)..(36): n is a, c, g, or t
gggccccccccttttttttttggtaagggcccctnnagggggggccctttttttttgcccctggggtccttccctttttggccggggttccctttttgttccaagaggattggggctttaaccccctgggggaacccggcttttgtttccccccgccccggttttttcccgggttttttttgggggcgggggggaccctttggggggaaaaaaaaatgggggggccgggggggttcgggttttttggggagggggggccctttggccttttggggttggttgggccctttaacccatttttgggcccttta

SEQ ID NO: 516540 - DNA, 1583 bp, Homo sapiens
acggagccgcagcggctgaccgcggcccagaggctgcccagtggtgttgcagctgcatgcctggccgtgcgcttcctgctactcaccgggtatcggtgcgatcgccgtctcggcggtagcgccctctgctttccttccgagactggtaattccacactccctgcaagcgcatggggcgtggtgcgaatcggttctgagcggcagtggcgaacgtgcaattcacgatttgaggcaacggccgggcgagaaccacgtgaaaatttggtgacactgttggcacgcaaatttatgctccttgcttggcaagaaaacgcggcatgggggtgccaagaaacttcaaataccacatggggtaatccccgaagctgcccgagaagcctggaagggccaattcagccttttcggcccaagcctttccaagccctttcagaagattgcggcgagccttggcccatctgtaattattaccaacgacgggggccaacaacccgccgtatttatccaatataaaccccacaagtcaccgcgatttcacccgactgaaaaacgcacgtgggcgctcacatggcagcaaccgcctaagttggttagccgcgcttgggcatacggccatctctttggtaaatcgcccccctttttggccgcctggtcgaaccaagcaaagagcccacattaaggggcttggcgagcactttggggagctttgggcccccagggtatttggcacgtactacagccctttccaaagtatggcacggccgtctgtgagtgagtaaattttcccccccgtttgggggcacactatgtgcacggaagaacgtataactaaggcgggcctatctatccttacatatttttaccccaccgttaagcggcaaacggcggatccgcgtgtgtgtccgctcaccagaagaatgctatttgggacgagaatccccctctcaaataaacaagtgtttcacacgttggcgtcgctcacacagacaatatctgcacaaaaagcacgcaaaaaacgagccgtcaccccaagctaccattccgattaggactagaatccccattttgtgggggcggcacaagcacattcccttatattccgttttgtgagccataacaggaggcgcccatttacagtttgttcacttaaaacacgcctttgggcttgggtgatgaccccttttgtggccgcccccacccaaagtctttgcgaaattgaagggaccaatctaaacagcacagagagctcgagggactcagtggccgagccatacgtttttaacaagtacagagccaggcacattcatcccggtatataaaaggtatatacattgtgtggcgttacaccacaccacaaagaagagagggccccagatattactccttcaacaagagggaggaggcgcctaacagtattagtaagatagtaagacacgccacatagagcacactaccttgtacgtagagcgcacgcccaatataattataacacagactcatcatatcgtcgtcgagtagtaagcagtcagtatagacgtaggcaactcaaacagtcatatcgccacaaggagcagcagcatctctca

SEQ ID NO: 516541 - DNA, 386 bp, Homo sapiens
agcatacaaactaatgacttttagtgttactgcagatgcaacgcatgttcactgtagaccaatttaaaactatagatcaaccaaatcaacaaactttttcttttttttaaggagacggagtctcgctctagttgcccaggctgtgagtgcagttggtgcaatctcgcgctcgctgcacacctcagcctcccaggttctagcaactcctgcctcagcctcttgaagtagctgggactacaggcgcacaccaccacacccatctaatttatggtatataaatagagacggggtttcaccttgtaatccactgtggtctcaaactcctgagctcagacaatccgcccgcctcgcctcccaaagcgctaggattacaggtgtgagccacc

SEQ ID NO: 516542 - DNA, 354 bp, Homo sapiens
gagagaactagtctcgagtgcttccggtctgtttttcaatattaggccacatgatttattcagtcgttcttatggtcccaaattacaatttatgtgtattcataggactacaaaagttcccattcgaattgtctgagcttataaaataccaactttttttttaaactggtacatatactcattaacaccagtctgcaacaggttacatagaatcagaggcacttgaaaggcttcgacgtttacaccttaaatgcatttttaagaacacaaactgatttttctttaaacctctactcgtactcttgaattgctagatgcttacagatacagtggccggaatctgcagccttgttg

SEQ ID NO: 516543 - DNA, 239 bp, Homo sapiens
  misc_feature (104)..(104): n is a, c, g, or t
  misc_feature (110)..(110): n is a, c, g, or t
tcggccgccggattccttcggccgccgggattccttcggccgccgggattccttcggccgccgggattccttcggccgccgggattccttcggccgccgggatnccttcngccgccgggattcctcggccgccgggattccttcggccgccgggattcctaccgacagcttagtcaaagaaggcattgcggcctcatttgctgtcaagcttttcaaagcatggatggcagaaaaagatg

SEQ ID NO: 516544 - DNA, 607 bp, Homo sapiens
ctctagaatgcactagatatattgctcttggagtcataatcatgatgcataccaacacaagactagtcaaattatatttcatggagatgcatgtgcatggaggagtcgactgacatagagtggagacttttccaaaatggcttttacatcctacatgaaagtttgggacagtagtatcctcatctgcgcgtttatcactcaagtgctttgtgggtccagcgtggcagcgctttctgaaggtttgtggtttctgctgcctaacatggtctttgtaccctctatagatacggaggaggactcatagaaacagtcaatgattgtcgaggacacaatggcagacgagcatgccatacatggaagcaccgccctggctgtcttattcttcggttcctatttgagattgactatgtgtataggcgcgccgtagtgtactcttgctgaaattactgaagtagtatcatgacctaccatgttccttgagaaagcgaagaagaagcgtcttaggcttcctggatgattcgcatagtactggcgcgtatccgcgatggtgattcgacgatacattaggagcaagtagtgtacgacgacttgtattcttgtaactcct

SEQ ID NO: 516545 - DNA, 132 bp, Homo sapiens
aagggatttattccccccctgcaagggtaaagtcaggtgagagtcccttggtgagtcatttgtacatcagggtcatttttttttaacctttgaaaaagatgggcatcagaaataaagacaaagccctttcca

SEQ ID NO: 516546 - DNA, 200 bp, Homo sapiens
  misc_feature (54)..(54): n is a, c, g, or t
  misc_feature (95)..(95): n is a, c, g, or t
acgatggcgcgtcctgggtttatggggggaagaggaagactgacggtcctgccnacaggtggtgctggcgcacggtgggcactcgacacaacatnttgcgctcaacgtgtcttgtcccacctatggtgtttgcttggcgcttgtgatctaactgttgcagtgtgtacggtcttgggtagccgaaggttgctgtgagggca

SEQ ID NO: 516547 - DNA, 206 bp, Homo sapiens
  misc_feature (124)..(124): n is a, c, g, or t
ggtgtttcctttgtctcaaacaaaaaaaaaaaaccatgaaagaatgccaacatcactaatcatcagagatgcaaattaaaaccagcagtgagataccagtcagaacttagaccagtcagaactngctattattaagagagttggctggacatggttgtgcttaccacggcaaatctacagcactgagggcgggacggatctgctgt

SEQ ID NO: 516548 - DNA, 210 bp, Homo sapiens
  misc_feature (53)..(53): n is a, c, g, or t
cgcctgacataacctaggaagcattgctatcatagctcagaccatacctatgntcccaatggtcttttattccgggtagtaagttacaatatgggagattattccgaagacctggtaggataagaatataaacttcagcgtgcccgaaaaatcagaataggtgtgcgtatagaatggcgtctcctcctcaggcggggtcgaagaaggtgg

SEQ ID NO: 516549 - DNA, 248 bp, Homo sapiens
  misc_feature (109)..(109): n is a, c, g, or t
gcgggagtagttggaaagttggaaccgtgtccagcacagaagggattctgtgcagatgagcagtcacactgttactccacagcgggggagaccagttcaaaggccaggnttcggagcgaagaagagaggttggggactggggttttaacccccggccttccttaaccaagaccctttttcaaccattggggctttttgttgccctgcgatgggcagaagggttttttttcccctttccttgggggccc

SEQ ID NO: 516550 - DNA, 211 bp, Homo sapiens
ctcccgcacagctctaaaaaaaacataaataggccgggtgccgtggctcacgcctatattttcaacactttgggaagctgaccttgaggtgggcaggatcgcatgaggtcaggagtttgagaccagcctagccaaaatggcaaaaccccatctctactaaaaatacaaaaaattaattgggcatgggggcacacacctataatcccaacta

SEQ ID NO: 516551 - DNA, 842 bp, Homo sapiens
aatttctaacacaaattgaaagatttccataaaaggaatcaaacaaccttccaagctcactcatttttgcatttcacgtttcttatgagaagtcccccttttactgctttgtccacagtggaatttaagagtagattatctaagcttttttttttttttttttcccgtgaatcttcactcaatccaacttggagaattattccaaactcttggatgtggatccctcaagttgcctccttttcaaaagaaagcatacaagtgggggggggtgggttatttctctttacacctttagcaagccagtttattcccttagtggaagcagaacgggaaacagcagatgtccaccatgcttatacgggacactacacctctgtctcgacaagccaggtgctttcctccctcttggggagcacttcctcgggggatgagtagtagggactattggaccctcaaaatggggcctctcaccaaaagccaaatgaagtagcgtatgccaggatgatgtccttgggagccgtggccagtcgaaacggctaagacaggcgcctaaggttgggtggtggcaatgtctagcaaaatggttccctcttttcaaggggcaccactaccattctggggttgacacactggactttctattaaacagtctgtggccccccaaaaaaaccaatcttgcacacacgcgttggttttgcagaagccgggtcttgcgccagcctaacaagaccttcaatatcaccggggtctcggatgaagctccctgggcgtaataagcacaggcgggttccttcctcgtcgtctttggtttatctccacaccaaagtcaccatattggctaa

SEQ ID NO: 516552 - DNA, 444 bp, Homo sapiens
  misc_feature (15)..(15): n is a, c, g, or t
  misc_feature (41)..(41): n is a, c, g, or t
  misc_feature (97)..(97): n is a, c, g, or t
  misc_feature (107)..(107): n is a, c, g, or t
  misc_feature (406)..(406): n is a, c, g, or t
aaaaacaacctcatncataaaggatggtttattttacctancccatataagggatggcaaaatgggtatcccctaacaggccaatacacagaatcanccctaagtgnccatcaacagatgaatggataaagtcacatacatatgtatacacacacacacacatacatacacacacacacacacacacatacacacacacatatatatgcaataggatactatgtgttctaagaaaattctgttacttgcaacaatatggatgaacctggaggatactatgttaagtgaaataagtcagacatagaaagacagatactgtatgatcccacggtatatgcagaatcctaaaacgtcaagttcaatttttttttttttagaaagaatctcgctctgtcacccaggctgnagtgagtggcatgatcccagctcactgaacctccacct

SEQ ID NO: 516553 - DNA, 1490 bp, Homo sapiens
ggggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccacaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgctcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcatctggctgtcgaattcttgtgaccctgttacacacactggagagaatgggcagaagtcgtggtgttgcagccctgtgcattgggggtgggatgggaatagcaatgtgtgttcagagagaatgacaatgtgtgttcagagagaatgaattgcttaaactttgaacaacctcaatttctttttaaactaataaagtactaggttgcaatatgtgaaatcagaggaccaaagtacagatggaaaccatttcctacatcacaaaaacccaagtttacagcttgtactttactttaatgtgtaatactcaactcacggtacaagacaattgcatttaacattgttataaataaaaggaacatcagatcaatcattaaaaaaaaaaaa

SEQ ID NO: 516554 - DNA, 451 bp, Homo sapiens
gtcgcgtgacccaagaggaggagaaggagcggcgccgccaggagaaaaaacagcgcggggctgagaacctgaaacgccgcttggagaatgagcggaaggcagaggtcgtccaagtgatccgaaaccccgccaagctcaggcgggcaaaaaagaagcagctgcgctccattgagaagcgggacaccctggccttgttgcaaaagcagcctgccaagtagccggcagccaagatctgagctcaggagggcccgaggccttccatggccaacaattatgtcagacacagcacctcagggcgatgctcagatgcctctggtggagttggcactccaaaaccatggttccagagcagggacccacccgagcgggctctcagcttgaaggctcaggcttgttgttgacaaagccagagggctggactggaaatgggcgaaagttagtccatctcttc

SEQ ID NO: 516555 - DNA, 1292 bp, Homo sapiens
ggggcagcgcagggcagacggcggcaggagaagcaagatgaatgcaggctcagatcctgtggtcatcgtctcggcggcgcggaccatcataggttccttcaatggtgccttagctgctgttcctgtccaggacctgggctccactgtcatcaaagaagtcttgaagagggccactgtggctccggaagatgtgtctgaggtcatctttggacatgtcttggcagcaggctgtgggcagaatcctgttagacaagccagtgtgggtgcaggaattccctactctgttccagcatggagctgccagatgatctgtgggtcaggcctaaaagctgtgtgccttgcagtccagtcaatagggataggagactccagcattgtggttgcaggaggcatggaaaatatgagcaaggctcctcacttggcttacttgagaacaggagtaaagataggtgagatgccactgactgacagtatactctgtgatggtcttacagatgcatttcacaactgtcatatgggtattacagctgaaaatgtagccacaaaatggcaagtgagtagagaagatcaggacaaggttgcagttctgtcccagaacaggacagagaatgcacagaaagctggccattttgacaaagagattgtaccagttttggtgtcaactagaaaaggtcttattgaagttaaaacagatgagtttcctcgccatgggagcaacatagaagccatgtccaagctaaagccttactttcttactgatggaacgggaacagtcaccccagccaatgcttcaggaataaatgatggtgctgcagctgttgctcttatgaagaagtcagaagctgataaacgtgggcttacacctttagcacggatagtttcctggtcccaagtgggtgtggagccttccattatgggaataggaccaattccagccataaagcaagctgttacaaaagcaggttggtcactggaagatgttgacatatttgaaatcaatgaagcctttgcagctgtctctgctgcaatagttaaagaacttggattaaacccagagaaggtcaatattgaaggaggggctatagccttgggccaccctcttggagcattgggggggcccatttttgggccccggtccccccccctgaagagaatgggcaggaattgagtttttccagccctgagctttgggggggggatggggaggtcaacgtgggttcataaagcatgacaggagcattttttgtacaacgtctatttatttttgcactaaaaaagccgtgggtttctaa

SEQ ID NO: 516556 - DNA, 690 bp, Homo sapiens
  misc_feature (320)..(320): n is a, c, g, or t
  misc_feature (485)..(485): n is a, c, g, or t
  misc_feature (491)..(491): n is a, c, g, or t
  misc_feature (531)..(531): n is a, c, g, or t
  misc_feature (539)..(539): n is a, c, g, or t
  misc_feature (570)..(572): n is a, c, g, or t
  misc_feature (574)..(574): n is a, c, g, or t
  misc_feature (576)..(576): n is a, c, g, or t
  misc_feature (578)..(586): n is a, c, g, or t
  misc_feature (597)..(597): n is a, c, g, or t
  misc_feature (652)..(652): n is a, c, g, or t
ggagtctctctaaagaattcggtcaaaacatagatcactcacgttcacccctagttagtgttttgcctcacttaataggttgggagacgaaagactcagcccgggtggggctgcagaaaaatgattggccccagtcccccttgtttgtcccttctacaggcatgaggaatctggaaggccctgaaacagggaatttgcttcattccaatctattgcttccccatggccttataaggcaggtgagagatgtttgaatttttctcttccttttagtatttttagttgttcagttgccaaggatccctgatcccattttcctntgacgtccccctcctaccccataggagttagaagttagggtttaggcatcatttgagaatgctgacacttttcagggctgtgattgaagtgagggcatgggtaaaaatatttcttaaaagagggatgcccattttttttaattattccggttaatacccaatagnagagtnggctttttttttttttttggtcatagtgggtggattgttnccatggcnccttggggttttgtaatgacagtgaaaaaannnangnannnnnnnnntatgatttgtntctgtcacccttgtccttgagtgctcttgctattaacgttatttgtaatttagtntgtagctcattaaaaaaatgtgcctagttttatagtta

SEQ ID NO: 516557 - DNA, 611 bp, Homo sapiens
agcggggtggggaacggcggggtgacggcggggaacagcgggggacggcggggaacagcgggggatggcggggaacagcaggggactgcgtggtcgcgtccatggccgccggggagctccttcccttcacagagctgagagaggcatctggcgctgcacgcatggaccagcgatgagcccctgcctcccgctcctgcagaaacatgaacactgacatatgataccacactcatactgacgaggcagagggagaacagttcgatttcggcagtggcgctgcagtcaccagaagcggacacgcacaggcccccatccgccccatgcagcacaggagcgtgctggagccagatgcaagcccctgcacccacccggacggtgcaggcactggagcctggacgcacgagaacacagcaccagctgggcacggagcactatcctaaaggccctggctgacttcgctcgcaatgtaagcagtcacatccccaactacttcttgtcgctcatagaactgagtcaccgccccgattcccaggcagggaacctcggcatgcgcctaactcagcgtttgcccccagcggctgcggcaggcagaatgttggctctcgcacggg

SEQ ID NO: 516558 - DNA, 425 bp, Homo sapiens
ttggaaagccaacgttatcctagaaaagctttttaaatgacccagcaggacaagtctccggatggccttggccaacccggtgcttccctctttttttggttgtagttctcagaataactaaagaatgtactgggagtgttgtcctgagataaggaggaactgtcctaaacctggactctgttcccatcacccctagaacaggatgtcctgcaacgctttagcccaatgatccaagttgcccttggggtataaaacttgacaccagagggcgttcagggtccctcagctgcagtgtgaagtgggacacacaggtgagactccatttgccctgggcaggttcctgagccttgggggaccagttccccctacatcccaggcttttgttgtcccttgcctgcctgtaaggaataaagttgctttgctta

SEQ ID NO: 516559 - DNA, 1378 bp, Homo sapiens
gggccgctcttgtcggcccgtcggtcgcctctgttgggggcacggctcgcttttcgatacccgacagggggcccctattgcgcgtacgcgtctcggtcgtctgtggccgtggctcccagggcgtggagactcccccgcagggcggcgcgccttctgagggctctgtctcctgctcatctctggcctttgtactggcggcgccgggatcctggtggttggccggcgtctcgtccggcgcgtctggtgcggtcctgtcttcttcgcagggagtttgctgagctcgcccggcgggagttttgcctggccctccctaatgcgccctgcgtcgttgcgggtccacatccgacgggcggtcgcctgagctgtgcgggtgtaagccgaagccgctgtcctccgtgtgtgtccgtctccctccgtgtgagcgtgccttgtgtctcctgccttgttgtcccccggcccgttaccggccggcttaggccgccgcgtgtccgcccccctttgggtcgcgccgcaggcgggttgcacgctagtgcgcggcctgctgcaggcctgcaagggaagtctcctcggtgctttacggtgcgtctcggtcttctcgtgggcgatccgcatctgtcgactcgtaggggtttcgtgcccgcgggtcccccgtggggcttgtgcaattgagcatctggcgaaaaagcacgggcgcgtggcgccgtttggcaccgtctggcgatagtggtctaccacgggcgccgacggtgcactgcgtgcctttccccctgggtgagccactaacttgggcctgggcgacgctgtgctccccttgtctcggttcactgggtcgctcaccttggctgttcccatcggcgtcccctttgggccggcgtgtgtcatctccgagaatccgcttgccccgacccaatttcctattgacaggtcggtctccccatgggcgacgacgccctcatgccttctcgtacatgttgcgcatgccaactatggaaacgcagatgccttcagttcttacctgtctcttcgcttgatggttacgcgaaataaaccagcctgttgttccaacgggcgtagaggagcaggtagacctcgacgggtgcccgcggacggggacctcgttcattggcccacgcttggcgaaacgcgacgcgcaacacgtgcattacatgaccttggaggttgtggaagatggacaccgtgacctcgtggaggccgtgtgggggcagcagcctggccgtgtgccatggtgggtgctcctaggggccatgtgcggaagggacgccacctcatccttagcagcccaggttgcaaggtgtggcattgtttctccttgcccagcagtgctgccattaacgcccgggacggggccaggcccttt

SEQ ID NO: 516560 - DNA, 615 bp, Homo sapiens
agcggagaggaagctgcggacaggggctgtgaggtggcagcggctgcagcggcggagaccggtcgcctcagcggtgcactggggtctgttcccccgttcccagctcaccatgactcccatgctcaggcagacgtgcgggacggaccgcttcttgagtcacccgacgccatcacgaacagagtgaaggagtctggaccgtgtgacaaaggctgtcagtgcaattgagtgtgatgctcggacgtcaatgcggactctgatactcctgggcttcaattcctactacgtgcctgctctcgagctcgtcactccgagcgctgcatggcgcttacaggggctgttccaggagtagtctacgttggttgccgcgaacttgaaggcatggacgaggaaatgagcccatggaataaggaagcgatctagttgggccgttgtgtttacacgcgacgtggggaaaaccgagaggagcgacatggatcaagcccagctgaagatgtaacacttagcaggagagacgactgaacagacagattaaggtgttgctaagaacccgtctgagcaaaagtgtcttcgagtaatgaaggaaggtttcgtttgcatacaagggaacggaatcaa

SEQ ID NO: 516561 - DNA, 246 bp, Homo sapiens
  misc_feature (144)..(144): n is a, c, g, or t
cccattgtcgagagaaataggctacccgccgcagtactgatattctatttccccctctattgatccccacctccaaatatctcatcaatcatccgactaatcagccagctccaatcaagtgactaacttaaactatcctctagntacaaatgataaccatacacaacactaaaggacgaacttgatctcttatactagtatccttaatcatttttattgccacaactaatttctctcggaccaatg

SEQ ID NO: 516562 - DNA, 226 bp, Homo sapiens
tctagagtggccgcctactactactaaattcgtggtcgagtcgaccccaaatgttgacataaatgagttagtcccactacttacgaatatttagggacaaaacccataaagcttcttggactgagtctatgagccccactcttcagtgttcagataggagaagggagactccctcaccttcttgatgaggacaaattcgttctccgatgaaccgtccgcttaactt

SEQ ID NO: 516563 - DNA, 245 bp, Homo sapiens
  misc_feature (10)..(10): n is a, c, g, or t
  misc_feature (80)..(81): n is a, c, g, or t
  misc_feature (107)..(107): n is a, c, g, or t
  misc_feature (138)..(138): n is a, c, g, or t
  misc_feature (153)..(153): n is a, c, g, or t
  misc_feature (200)..(200): n is a, c, g, or t
  misc_feature (212)..(212): n is a, c, g, or t
  misc_feature (215)..(215): n is a, c, g, or t
  misc_feature (234)..(234): n is a, c, g, or t
agcacgttcnctgccccgggtgggctctgcggcctgctcaagtgcacgtgtccattacacgattcaaagcccccggtggnntgtgggtgacttcactttgggtcggnggtcctttctcatagctgtgaagtgcttggntcggctattcgtgtntccctcctgtgggcagagctgatctcacccccattccccatgggcancctgtgtgcaantangctacttgggtcccggcanattgtgagaaa

SEQ ID NO: 516564 - DNA, 164 bp, Homo sapiens
tccagtttttatatgtgctactgcgggggtgctggtacaagtcgtgggactgcatgctactgtctagagcttgtctcaatggattctagaactttattgtcctctgattgccgatcacctctgagacccgcagtcaatctcaataccatatctaacacgtcctg

SEQ ID NO: 516565 - DNA, 223 bp, Homo sapiens
  misc_feature (139)..(139): n is a, c, g, or t
tcactgccggctcgcctctactagcttcaagtattcttctaaattggttctggtctacgattaacaccctcatcttctcaagctttacctgtctaagcttctgcaccaccatgaaatttaattagcttggcttgtaaanatatagttggttaccagctcatttcctctattgtttcatgtgctgattttatcctagtttttcggcttccatattttgtctatc

SEQ ID NO: 516566 - DNA, 343 bp, Homo sapiens
  misc_feature (33)..(33): n is a, c, g, or t
  misc_feature (66)..(66): n is a, c, g, or t
  misc_feature (72)..(73): n is a, c, g, or t
  misc_feature (91)..(91): n is a, c, g, or t
  misc_feature (100)..(100): n is a, c, g, or t
  misc_feature (102)..(102): n is a, c, g, or t
  misc_feature (108)..(108): n is a, c, g, or t
  misc_feature (122)..(122): n is a, c, g, or t
  misc_feature (129)..(129): n is a, c, g, or t
  misc_feature (157)..(157): n is a, c, g, or t
  misc_feature (163)..(163): n is a, c, g, or t
  misc_feature (165)..(167): n is a, c, g, or t
  misc_feature (196)..(196): n is a, c, g, or t
  misc_feature (198)..(198): n is a, c, g, or t
  misc_feature (201)..(201): n is a, c, g, or t
  misc_feature (214)..(214): n is a, c, g, or t
  misc_feature (218)..(218): n is a, c, g, or t
  misc_feature (220)..(220): n is a, c, g, or t
  misc_feature (224)..(224): n is a, c, g, or t
  misc_feature (227)..(227): n is a, c, g, or t
  misc_feature (261)..(261): n is a, c, g, or t
  misc_feature (274)..(274): n is a, c, g, or t
  misc_feature (323)..(323): n is a, c, g, or t
attattattttaataacaacctgaatcccagancttccagatactgtccacactccctcccctggncagccnncaggaggcacctcaaggnaacaaaacncnggtggngtgtctcccgggcngcctccnactcccccaagccgtctactgccccccnctcccncnnngcagggtgggggttggttccctcccaaananggntccctctgaaganccgncntgangcnctccctcctccatcaaggttggggatgatgaggngatggggcagggnctgggggaccaggccattactgagccttgaactcccaccccggggacanggggacattaaagctgcata

SEQ ID NO: 516567 - DNA, 117 bp, Homo sapiens
tgcattccgactgcacgacactgtccttcactgacgacggcgaccttttcacggacctttacctctgcgttcaaactcaattaactacgtttgtacggttactccacctacttacgc

SEQ ID NO: 516568 - DNA, 1131 bp, Homo sapiens
cgttcccagccacatgctccctgtgcctctgtttcaaggttcccaaacattggcaaaaaattctccatgcccctacatgagactgagctggttgcatcgagtccccgattggcttgtcttaccagaagtatgctggacaaggattggttataaactaacatctctactccaagaccagagttacctaaagcttccatggaatacaggacactagcttgcctttcacaagatgaacccagaagggacccttgtgtggtccttttgacccggcattgcatgaaggaacactgggaccaccaaaccatgtgcactggggtccacgctagaatttcctcagcacattatctataactctcgcattgggtatggccatagcttattgggctttggccaagtgacatccactataccgtcaagggctttggtcccctttccccaagaaaggccggaacactttgaggagaacccccatattgggacccttggtgcccttcttcagagagcgcaaagacaccctttttccctttcccatggcattttaactgggtccaatacattactaccaaacaagctcacagccaattacccacattgacggcccaaacaacagtaaacgccccatcccttacaaatgtggcattggggccccccccaaatctccttgttggccccaaatttaacgggtacatctcaaacgcgcgacaacagttggctccaccgtttacttgtataacacacaacacccatttggaacgcacacgatagtccaaaaacaagtcccaacagctcgatcagagagcagcaaagcaagaaatacaagaacgacccaagctaatgtctgctactcgagcccgccccatacagggcaaccaacggtaccaggagagaaaaggcacctagtcacgaggaaaaacaaccaaaacaaaagcacgaaaataaaagcaagacccgaccggatgaaaggaacaccaacaacaatgcagaagcgacaaaagcggcgaaacaaacagaaggttgaaacaaaagagacggtgaaccacaacaacaggggaagaagaaacccccggtgcgggggaaccacaaaaaaaacaagaaggaagggagaagagggagaccacaccacaaccaaac

SEQ ID NO: 516569 - DNA, 657 bp, Homo sapiens
  misc_feature (8)..(8): n is a, c, g, or t
  misc_feature (72)..(72): n is a, c, g, or t
  misc_feature (192)..(192): n is a, c, g, or t
  misc_feature (217)..(217): n is a, c, g, or t
  misc_feature (222)..(223): n is a, c, g, or t
  misc_feature (226)..(226): n is a, c, g, or t
  misc_feature (242)..(242): n is a, c, g, or t
  misc_feature (244)..(244): n is a, c, g, or t
  misc_feature (246)..(247): n is a, c, g, or t
  misc_feature (263)..(263): n is a, c, g, or t
  misc_feature (267)..(267): n is a, c, g, or t
  misc_feature (272)..(272): n is a, c, g, or t
  misc_feature (297)..(297): n is a, c, g, or t
  misc_feature (358)..(358): n is a, c, g, or t
  misc_feature (375)..(375): n is a, c, g, or t
  misc_feature (393)..(393): n is a, c, g, or t
  misc_feature (399)..(399): n is a, c, g, or t
  misc_feature (416)..(416): n is a, c, g, or t
  misc_feature (440)..(440): n is a, c, g, or t
  misc_feature (456)..(456): n is a, c, g, or t
  misc_feature (461)..(462): n is a, c, g, or t
  misc_feature (466)..(466): n is a, c, g, or t
  misc_feature (474)..(474): n is a, c, g, or t
  misc_feature (481)..(482): n is a, c, g, or t
  misc_feature (490)..(490): n is a, c, g, or t
  misc_feature (508)..(509): n is a, c, g, or t
  misc_feature (512)..(512): n is a, c, g, or t
  misc_feature (515)..(515): n is a, c, g, or t
  misc_feature (536)..(536): n is a, c, g, or t
  misc_feature (575)..(575): n is a, c, g, or t
  misc_feature (581)..(581): n is a, c, g, or t
  misc_feature (594)..(594): n is a, c, g, or t
  misc_feature (609)..(609): n is a, c, g, or t
aaacaaanagaaaaaagaaggaaaaaaagaaaaaaaaattattggaaacttcatggttcaagtcggcgaganaggaggaggaacatggagctaggtctccaggcctctccagagaagtcctcaccctcgaagcaccctcttgggggacagcagagccaggacagccccccccacgcccagcctccgtctgangaagatggcagaatcacagtggtgngaggnncanaagggttggagggggnangnnccgggcggggtcacangaantagtnggccaagggctttttggaggggatnccccgtgtctcttgggggagcagcctccaaagatgatgaaatcttttctgggagatgctcntccagctccaagatggntgccacattcccacagcnggtagnggtagttggggtgccgnccacacagtgagcacccgtctcantgaaagtgccacgggnaaccnnccancaccaggnggggggnncggcagancatgtcaatgtcattggnngcnttnaactgggccaccacgtcactnccaaataggtagcccgctcctcgggggctcacgccccancctgtngtgtcttctgggncagaccagaggaggncacacatgggcccatcatgaggcacctcttgctttcggtcgattgtcc

SEQ ID NO: 516570 - DNA, 268 bp, Homo sapiens
  misc_feature (26)..(26): n is a, c, g, or t
ccccgggttttttatttggccccccngaaaattttttccccggaaagggccccgggggggaaagcccccgtttccccttttttcccccttttttaaaaagccccttttttaaatggggcgcccaaaaggaaccggggggggggaggggggcccccttttttttttttttttccccccaaggggggaaaatttttttttgccggggaaccccccccgttcccccccccccaaaacccgggggtttttttttttttttaaaaccccccca

SEQ ID NO: 516571 - DNA, 939 bp, Homo sapiens
ggagacgggggtcgagtgtgagactgggacttcttttggttctgcttcacttctgaggggcacctctggcatctcacgtccccatccatgatagggtcgctcgaggcacgcggatgcggacgtgctgcatattgatggcggttgatgcatgccatgatcgtgaactgctaggtctggacgatcggcgccggacgggtccagcaggtgaatggcgcaccggcaagcctgaaggagcctgcgtgagtcttgcatgagacgagaatgaagcactgctactcgcggctgcgggaactggtacccggagtcccgagaaggcactcatgcttatgctcaggtggaaatcctgacatggtgtgtcatcagactatcaattctctgatcttgacaaggtatgtcctgtgcctgggccatgtccctggaccccctggatgtgtcccgaacttcccgatccagggtatgcctcgaagtcgggacagggctgaacagccatggctaaggatgctgctgggaccctcggagctcccgattgcctcgcgtaactcttcgcctcttttgcgctctaatcagacagcgggagctcgctccggaacttgtcgatctccaacgacaaaaggagcttttgccactgactcggccgtgtcctgacaccgtccaggtgagtatctcctctcttggagagggaggtttaaacggcaaggtcctggagttggcagacgttttgaaaaattgcactcactcggtttagggaaactgaggccagagagggacaagtgacttgcccatggttgcatcaaatgaatggcagagtcagtttccatgtgatgtgcattttaaggccttaaatgcgcctgggggcctgccctccgcaggtggcgaggtcttggcaaagtagacatgggtccgactaaatacaagtctttctgtccatgttgtataggg

SEQ ID NO: 516572 - DNA, 339 bp, Homo sapiens
cccagaactcctgggctcaagcgatcctcccacctcagcctcccgagtagctgggactacaggcacgcgccaccgcgctcggctaagtgtgtataaatcttgattgttaacagttgaccacttgataaaaaataggtttaagatagtttacttcgttgttttgagacagggtcttgctccatcgtgcaggttggagtgcagtggcacaatcagagctcaccgcaggcagcctccccatcttgggctcaagcagtcttcccacctcaggctcccaagtagctgggactacaggtgcatgctgccacactcagctaattattatattttttgtagagacgg

SEQ ID NO: 516573 - DNA, 285 bp, Homo sapiens
cgccaaattaaggggttccgccaggggttttgggaggaacccgcttattccaaccccagcctccttttggggccccctcggtcccatagcaaagcccttgcacagattccagcggggcccacccctggttataaggtgggccaggggaagcgcttcttttcctccgtggaggatttccccgggtttgtgtggggccggggccctccctcctgcattggccttggggggttttgcctgtcagtgaaataaatagtcctgcccccagggcccagacataggggccca

SEQ ID NO: 516574 - DNA, 120 bp, Homo sapiens
agagtatattcacgatactgttaacgatgaatatagatctcaagaacaattacgaaatgctcttgagtctcgtgaaacaacatcaagaaacaattaatacactagcatacgaaatatctg

SEQ ID NO: 516575 - DNA, 443 bp, Homo sapiens
tggtattttaaatagagacagggtttctccatgtgggtcaggtgggtctcgaactcccgacctcaggtgatccacctacctcgacctcccaaatggcggggataacaggcgtgacccaccgcgccgggctggtcctgggcccacttctagctaagtaatatatgctggggtgagtcacgccctcctctgtcagtttccctgaatgaggggatggcctcgttaagcaccttacaggtgttttctcccattgaagagcatgctgggccaatacgttctggcagctaaaatcaaacaggggtctctcccaagacctttgtaaattaacaccggcaataatatttattggtccagaggttccacatggtaggttctccccccataaatatctccaaatcgggggtaccggctacccggtatataagactatattacaatgggtgtct

SEQ ID NO: 516576 - DNA, 198 bp, Homo sapiens
  misc_feature (69)..(69): n is a, c, g, or t
  misc_feature (133)..(133): n is a, c, g, or t
gcttcccttcagtgttttatcagagcccttaataaaatgtaaggctggatttatttgaagttggacagnatgacttaattcacatctgttggaatagaaaatatattttgttgagtatttaaaaggcggacangttttcttttgtgttggattcttggactttttcatgtcaggacatcataaacaaagttgaaggga

SEQ ID NO: 516577 - DNA, 209 bp, Homo sapiens
tttacggctctatcctcaccctttcacttgatgatatcagaatgttacatctgtgtacaggtgcgtacacaaacccagaaattatgtagaaaacaaaatgtggagttgcaatccaaagttacaataatactgatttttaaataatgacttttcaaatgtacgagtttcttaaatcatacagaaagcaaaaaatggagttacaaaccttt

SEQ ID NO: 516578 - DNA, 114 bp, Homo sapiens
gcagcagcggaggcgaggacaatctcaggacactgagctggtggagacagaccagcaggagatagaacttccagaagtgggcagctgtggtggtgccttctggagaagagcaga

SEQ ID NO: 516579 - DNA, 169 bp, Homo sapiens
acgcgtgtacttcaaatgctattttatctcagcggaactgtactatgccctgtatttcctcgccacgctactgatgatcacgtataaaagtaagtcagtgacgggcacagtggctcactgcctgtcatcccaacatcttgggaggccgatgtgggcggatcacttgagt

SEQ ID NO: 516580 - DNA, 258 bp, Homo sapiens
cgtggatgaagagagatggagaagaccaggcatgagactgtggagaagccacaccaccagaaacccctgccccatgcgccgtccagcccacacctgtggatgcacgggggattgcaggcagggctcccaccgtggactcaggaacaggcagggaagctgctgcctcaccaggcgaagggctcaggagggggaggcggagaggcccgtctagcccctgcggctgtcaccgtggtgcctcctcactggccagtgcggccg

SEQ ID NO: 516581 - DNA, 222 bp, Homo sapiens
  misc_feature (15)..(15): n is a, c, g, or t
  misc_feature (25)..(25): n is a, c, g, or t
  misc_feature (39)..(39): n is a, c, g, or t
  misc_feature (47)..(47): n is a, c, g, or t
  misc_feature (54)..(54): n is a, c, g, or t
  misc_feature (69)..(69): n is a, c, g, or t
  misc_feature (72)..(72): n is a, c, g, or t
  misc_feature (75)..(76): n is a, c, g, or t
  misc_feature (120)..(122): n is a, c, g, or t
  misc_feature (133)..(133): n is a, c, g, or t
  misc_feature (139)..(140): n is a, c, g, or t
  misc_feature (173)..(174): n is a, c, g, or t
  misc_feature (176)..(176): n is a, c, g, or t
  misc_feature (180)..(180): n is a, c, g, or t
aactagggagtaggnctggcagggnaaggggcagacagnctcgcctngcacccntcatccctggctgcnggnccnntccgtggagggactaagctgggggtgggggacatgagtcccccnnntgcccctgccncatccnngtgggctctgaccccctgatctcaactcgtggnncnaacntggaaaagggttgatttaaaataaaagggaagactattttgt

SEQ ID NO: 516582 - DNA, 231 bp, Homo sapiens
tacaagactatcattctattactagtccttacgaaacggatctcagggagaagaatgcagtaatagctgtccgtgtctcatcattccagtttctaaaacacagcccagccagcttttttccttattaagattctccagcacaggctgccaggccagcacaccacaaatatcgggtgccttcctttggaaatatttgacctctcttctgtgacaagaatggtacttaacagc

SEQ ID NO: 516583 - DNA, 673 bp, Homo sapiens
  misc_feature (656)..(656): n is a, c, g, or t
tgggtcctgcccgtatagagacggcagtgcgggggcatagccggcaccccaaacgcgcggcgttgcgtaattcgccgagggtcaggttcagcgtaccgcaccgtacattgagcgccatgcttagctcgtcgaatggttcatgcccgaacacatccatcaccgctgtttcatcctcatgctctgagtagggctgtgttgcaaaatcctcatccacaaacatatcctcgatagaagtaagggtcagacgcatcggcccggattcagcgtcgatccagcccaccaggcgctgtttgccaacctgcacgtggccggttcccgacgcactgaaaaaggctcgctcaagcaccagcacgtcaccagcccgcaagccgcgcagctggtgcatggacaaccgcaggtgcccaagcgttacgtcaaccgccagccgaaactgcgccggcatcggctcagccctggatcgccacggccccgccttgcatagcgccagaaagctctcgacagacagccacagatagcccgccacgcgagaggccccaagcgtcacgcagagtcgacaaccaaagttcatggggcgagcgcctggcagcaaacgcaggtacccaaacaacgcctgcacctcaagtctcagatgatgctggaacaactcccagaaccangcgtccggatcatcccg

SEQ ID NO: 516584 - DNA, 134 bp, Homo sapiens
tcggtccctcctgagtagttgggatacagtcatgcacaccatgccagctatttgtatttttagtagagatggggtctcaccatgttggccaggctggtctcaaactcctaacctcgggtgaggtagtctaccca

SEQ ID NO: 516585 - DNA, 363 bp, Homo sapiens
  misc_feature (36)..(36): n is a, c, g, or t
  misc_feature (75)..(75): n is a, c, g, or t
  misc_feature (83)..(83): n is a, c, g, or t
  misc_feature (104)..(104): n is a, c, g, or t
  misc_feature (106)..(106): n is a, c, g, or t
  misc_feature (114)..(114): n is a, c, g, or t
  misc_feature (238)..(238): n is a, c, g, or t
  misc_feature (242)..(242): n is a, c, g, or t
  misc_feature (248)..(248): n is a, c, g, or t
  misc_feature (254)..(254): n is a, c, g, or t
  misc_feature (280)..(280): n is a, c, g, or t
  misc_feature (291)..(291): n is a, c, g, or t
  misc_feature (329)..(329): n is a, c, g, or t
  misc_feature (333)..(333): n is a, c, g, or t
ctgtgaggatatagagttatcatatatgagataganccacatatttgtgtttttaacacacacgagggaatggtnagaatcangagagattactaacctggcanangagctatnacaatcaccaaggtgggtttttcagggcacgggttattcattacacttcagaagtgctgacccctggcattttcccaaatgtgggaaacccaactgtgcaggttgtagtaatgggtgactgtgntcangcgctnccctgngaacaacaaccaccaccaagaatcanaagagatactntgctatctaattcctaaattccctgagatttctaagtnagantatatgtttttttgcgttttctggttggtt

SEQ ID NO: 516586 - DNA, 1354 bp, Homo sapiens
  misc_feature (1316)..(1316): n is a, c, g, or t
gggtgctcggtccttccgaggaaagctaagtgctgcgttgggtgtgaggccctcagttcatccgcgtgagctagcagcccgggtccgcgcagcgcttgctctacgctcgcccgtgccatgcgcctctgtgctccgagctcagccttgcaatctagctcgggcccgtcattctgcaacgatcgaacgagtgtagacatgtcacggagtgataacgctgcaagtgaccgtcacttaaatgcatggcggagtaaggtattgttgaggccgtcttgattggccctcggctttggttcctggcgacactgggcccttgtggccagagtgttcaaacaggtaatggggatggacttcagtactttgggaaacctgtagtgaggcggccctaggcttggacccgatagtctgcccaagacagcgacataagagttagcattggcgagctcagagcgatgtgacggtgtcactaagcctccaccattcgcagtatatggcggtacggcgtttggggtcacccattgtcggttagaatggcgcattggacaccaagacacgagtggctaggggaaagggccacagtgaccgaacagactggacaagggaaaatacctctggaaatgcaggacaggttccataggacttcggacttctgcaacccagttgagggcaggccatttcagggtgctgaccatatacactctgaggacaccgttcaaaacaacgacgtctcgtttgatagtgagtaaacagccacccttggctttgaccaagaggatacaagcaaccaacgggcctttggcaacaccgttagtctagcagagcaacagaacaaagagagaaacgaggcacaaggcaacatcaccacatctcgcacgaacgagggagcaaagagcgacacaaaaaggacggcacccgacgggagtgcgaagccgcgggagagacacacaacgacgcacgacagggtgcgactcgaagcgcgagcacaaaagcaagagagggcgcgcccaaagaaggtaggagggcacaaccgaggaaacgaggacgtgagtcaagaccgcgaagaagacacacacagcgagaagcattaccaaattgtcgaccaacaccaacaagaaggcaggagtggaggacaacgacaatacaggagcagcaccgacgaaaacccgccccccagcaaataacagaggcagaagggaaaaagaagtaagcggacagaaaacataggaaaagaaagagacagcacaaaccgaaactaagtggagaccacccggagaggagtacgaaacagcaaccgagcgcgctggcacgagacgggtagnaccaagagtgacaaacaagcgacgcgcagaaacaaggc

SEQ ID NO: 516587 - DNA, 141 bp, Homo sapiens
ctgagaagacaggacataatcttgtcagcgatcatcagggtatgactggaaagtgagaaacagtagtccgtaaaacatttacctaactaatagctttcccaagacagtacttcccctgcgaattaaaacagagaaatacaa

SEQ ID NO: 516588 - DNA, 389 bp, Homo sapiens
tgagatggagtcccgctctgtcgcccaggctggagtgcagtggtgtgagatggagtcccgctctgtcgcccaggctggagtgcagtggtgtgatctgggctcactgcaagtccgcctcccaggttcacgccattgtcctgcctcagccttcccagcagctgggaccacaggtgcccaccaccacgtccggctaattttttgtatttttaatagagacggggtttcaccgtgttagccaggatggtctcgatctcctgacctcatgatccacccaccttggcctcccaaagtgctgggattacaggcatgagccaccgtgcccggcccacttctgttttcttgtaagagtttgctagttttagctttcatcgttttttttgttttttttg

SEQ ID NO: 516589 - DNA, 378 bp, Homo sapiens
atcgttagtgtctcatactaattttagactcaacatattttctaatgaagcttctggaaatagctggtatcatattacggaaacttattattggcacagtgccttaatgattagttggcttggggggtggggagagaccctagctatcaaggatggacgtaaaaatactttgctaatatgagcactgctgaggtttaagtcattcctgaggtaagctaaaatatgtttaaaggttattaaaaaggcacacagtttctcatttaacattttggtattaactttagaggccaagagtttcaagtagtctctgtaggatagcttgttaccattccattccttcctcccttcccattcactttccttccttccttccctcct

SEQ ID NO: 516590 - DNA, 319 bp, Homo sapiens
tctcagttactttggtactgtcttgctctgcaccgatcggttccacttcggtctgatgggtggctcctaatcggtatttttggtttacatctcaactatcacagcagccgggcgcggtggcttcacagctgtaatcccagcacattgggaggctgaggcaggggtatcacctgaggtctggagttccagaccagcctgaccaacatggagaaaccccccgtctccactaaaaatacaaaattacccgggcgtggtggtacatgcctgtaatcccagctactcgggaggctgaggcaggagaatggtgtgaaccagggag

SEQ ID NO: 516591 - DNA, 456 bp, Homo sapiens
  misc_feature (28)..(28): n is a, c, g, or t
  misc_feature (328)..(328): n is a, c, g, or t
ctcccatgtgcatggtccttcacgttancaaaacgctttccctatgcatgttgccctttgatccctcccagtcagctggatgaagtatccctccttcttctcccagatgaagagactgaggccctggtcattacacacccatgttcagggtcacttgtgaaattggaactccctggctgggcacagtggctcatgtctgtaatcccaaaactttgggagcctgagtggacagatcatctgaggtcaggcattcaagaggagcctggccaacatggcgaaaacccatctctactaaaaatataaaaattagctgggagtggtggcgcanacctgtagtcccagctactcgggaggctgaggcaggagaatcgcttgagcctgtaaggtagaggttgtcgtgagccgagagcacatcactgcactccagccagggtgacagcaagattccatctcaaa

SEQ ID NO: 516592 - DNA, 609 bp, Homo sapiens
  misc_feature (19)..(19): n is a, c, g, or t
  misc_feature (29)..(29): n is a, c, g, or t
  misc_feature (34)..(34): n is a, c, g, or t
  misc_feature (40)..(41): n is a, c, g, or t
  misc_feature (53)..(53): n is a, c, g, or t
  misc_feature (92)..(92): n is a, c, g, or t
cctcgcttgaatggggatnatcgggaagntgtgnagaagnnactcgggtctcngactttgtcctcagaggagctggcctacgggaagacaangatcttcatcagaagccccaaaactcttttctacctggaagaacaaaggcgcctgaggcttcagcagctggccaccctcatacagaaggtctaccgcggtggcgctgtcggacccactaccagcagatgcggaagagccaaatcctcatctcggcttggtttcggggcaacaagcaaaagaagcactatgggaagatacggtcgtcagtgctgctgatccaggctttcgtgaggggctggagggcccgcaagaactatcgaaaatacttccggtcaggtgctgccctcaccttggcaaattttatctaccagagctgtactggttttatagatcacccccaattgtatggcttaaaacaagctacatggtcatggtttgctgtgtgaccgacagataaccacaatgaaactagtctggaaaaaaaaacttgctttttgttgtagttaccacttaaccctgtagtttaacaaggaatgtctgtgccaataaaccaattctccctctgcttgaaaaaaa

SEQ ID NO: 516593 - DNA, 449 bp, Homo sapiens
aggaacgaacacttcacgagaggacaaatgccacctctcagctgcatcttgaagctggtcacttctgggtctgtggcaggcattcgtcaatggcccagtgcagttctctggagaaagctaccttttcccaaggcatctgcatccatcgacattggtaatgtggccagctctccttggtcctgtcctcagccgatgctttttcaataggatttttatgctttgtgtacctcaaccaagtatgaagagctgtactggttttatagatcacccccaattgtatggcttaaaacaagctacatggtcatggtttgctgtgtgaccgacagataaccacaatgaaactagtctggaaaaaaaaacttgctttttgttgtagttaccacttaaccctgtagtttaacaaggaatgtctgtgccaataaaccaattctccctctgcttgaaaaaaa

SEQ ID NO: 516594 - DNA, 346 bp, Homo sapiens
  misc_feature (87)..(87): n is a, c, g, or t
  misc_feature (219)..(219): n is a, c, g, or t
  misc_feature (225)..(225): n is a, c, g, or t
  misc_feature (265)..(265): n is a, c, g, or t
  misc_feature (299)..(299): n is a, c, g, or t
  misc_feature (308)..(308): n is a, c, g, or t
atgggcattccgccaacaggggtcacttccgcataggcggcccgggcaggcccaaggcacccttcctaccctttcctgcctccctgnaaggtccaggcattaatcccctacccgggcgtacacccgggcaggccccttcacccctgtgtacctcgcaggatgcagagattgtgcgggacccgggatcccgaaaaactcgcttcctgtgacatcgtggtngaagtngggggcgagtacgaccctcggagacaccgatatgaccatnaccagagatgtatgagaactttgtggaggaggtngatgctttngacaatgggatcttcccagttgggcagagggggagcct

SEQ ID NO: 516595 - DNA, 143 bp, Homo sapiens
acctgtaagcgtcctttctattctataactgatataatatttctctagagtcctatctctgttcagcaaaagccagagagatatccaaaaatcattctgtcttatttataggtttaaaacaacctccgattagctgtgaaacg

SEQ ID NO: 516596 - DNA, 122 bp, Homo sapiens
ttcaaggccccgtcgtgcactgcatgctcctcccgcgtgcatttgcaatgctggcatgatctttctgagggggccaggatgggggtcaattactaatggagttgcccacctcgaacccctcg

SEQ ID NO: 516597 - DNA, 1274 bp, Homo sapiens
tcaggttttttgtttgtttaaagtgaaacttgatgattttgaaacaagtaattaaaaaaaggtccaaaacaccaggtgggccaaacattggtttgagcctgggggccaccagttcgcgaccactgccttacgtagttaacaccctgagtatgtatacagtcatatttttaggtatatgggatatagatagtgttatatatactatgggggcgtgcatcattggaagtcatctttatctctcagagttaagctttattgtagaagacaaaaaaaaaagttcaacacagccatagataacacttaactcacagttcccaggaggacactggatctcgaagctgctcttttggagtcagatcctacatcaaaccacttagggccagttttgggcatttccttcctgggtgactgggggtaaacttcttggcctcggtcggagttcgcagatgagtaactcagaaggatggcccgaatacctgggtccccttggatataaaattcttacattatcaccttaatctcgggggggataaggggtatccctagctcgggccctttaccggggcatgcactggcggggccaagacaacggggtagcacagactactataggctcataccatttcaaactaccaagaaacacaggcacaggacacggacacggacacagggccacgcgactaggaagacccagcgctcgagctgcacgggggcacagataggccagctcatcggcaggccattgacaccctccctggggctcaagggaaagctccaggactagggaccctccacacaacagtgggaacaccagaacagtggcccagaacacccagggaacttcacacacacctgcggcaacgacgggggacacccaaaagatggccaccgcgaggatacgtacacaacagcggacaacaggcacaactcgcacagctggcccccccaaggtgttgggtgcatcatctgtggctacacgacacacaccttgtcatcacaaaacctggttattcgatgcagctaaaaccagcaagtgtgtcctgacaaactagcagcagatatgctagtagaagaaagaccatactgccgtaataatgcacgactaggcaggagacaatcggacttcagtcgactccctcatctcagccaacgtgacgtctcgcaagtaatagaagacgaacgtcgcgatacctatactttggtccaggacagaagctgccacaatgacgtcagactatgtattatgtaacagttcatacaggctaactaacggc

SEQ ID NO: 516598 - DNA, 605 bp, Homo sapiens
ccgaagaggccatgaaacagatcaacgattacgtggagaagggtactcaagggttgtggatttggtcaaggagcttgacagagacacagtttttgctctggtgaattacatcttatttaaaggcataagggagagaccctttgaagtcaaggacaccgaggaagaggacttacacgtggaccaggtgaccaccgtgaaggtgcctatgatgaaacgtttaggcatgtttaacatacagcactgtacgaagctgtccagctgggtgctgctgatgaaatacctgctcattgtcaccgccatcttcttcctgcctgatgaggtgaaactacatcacctgtcgtctgccagcttacatttaccccgactgtgcattactggaacctatgatctgaagagcgagctgggtcaactgggcatcactaaggtcttcaacaatggggctgacctctccgggtcacaaaggaggaccccttgaggctctcaaaggccggcataaggtgggctgacatcgacagagaaaggactgaagctgttgggccatgtttcaagagggcatgccaatgttattcccccgagggaaagtttaaccactttggcttttggcg

SEQ ID NO: 516599 - DNA, 557 bp, Homo sapiens
  misc_feature (5)..(5): n is a, c, g, or t
  misc_feature (144)..(144): n is a, c, g, or t
  misc_feature (172)..(172): n is a, c, g, or t
  misc_feature (199)..(199): n is a, c, g, or t
  misc_feature (211)..(211): n is a, c, g, or t
  misc_feature (320)..(320): n is a, c, g, or t
  misc_feature (332)..(332): n is a, c, g, or t
  misc_feature (355)..(356): n is a, c, g, or t
  misc_feature (368)..(368): n is a, c, g, or t
  misc_feature (408)..(408): n is a, c, g, or t
  misc_feature (420)..(422): n is a, c, g, or t
  misc_feature (426)..(426): n is a, c, g, or t
  misc_feature (430)..(430): n is a, c, g, or t
  misc_feature (473)..(473): n is a, c, g, or t
  misc_feature (481)..(481): n is a, c, g, or t
  misc_feature (515)..(515): n is a, c, g, or t
acatncagcttaattcagatgtactgcctgaatgacccagacataaaaagaaaccccccactctttcccactggtttttaaaataaaatcttcacttataaaactgaaacactaaagcattaaaatacagaaagctcgtttaantcacttcacaaaagcattaacaaatgangtatcccttctgtaactatttaaaganaaactgagttancactaacacgaaggggaaattatgacagatgggatactgaacttgtcaaaaactcaaaaactctacccagacaaagtggtaatggcaactaacaaaccattgaagaaanggagtttcaaanacggctaaatatgggtgacaggnnggggcacagggngacccgctgtcacctcacgatacagcaacgtggaggggangggggggggggnnngtgngggnagcggacatgttaactgtgatgtataaaattcgatcttctganggggaggnagttcagaagggagaaatctccgccccgcggggnttatctgtactggttgttcatgcggtggtctgcgtttctgtc

SEQ ID NO: 516600 - DNA, 548 bp, Homo sapiens
ggtgcatgcatgtgactaggtgattgtgttctcagccctatctttgtcagcctcatcaggattagtgggatgggctttttgaaaaagaagaaatatccgccagagcactgctggagaagagggcctgcctgtgctgatgctgaggctgcaaaaccaacgcccaaactagagccaaagcaagcactgctgaccctgtcttgggcctctaggccaagcactgggtaaatatgacctcattgatcgatgcatagggtagcccagccacagccttccgcaaaggccaaggtgaaaaagtggagcagtcacttgagctgcattcttttcagggaattgctgagctttcctagaagcaaaccagggaggcttgggatctgagatattggggaagaggtgggggaggtgggtgttcagaatcagagtgaagtaaagtccagatctttgctggccacagacttcagggagagaaggctgagggccattttcacattgtctaaatgtagtgcatctttgttggaactttgaaaaatatggtactccatggcattaaa

SEQ ID NO: 516601 - DNA, 181 bp, Homo sapiens
tacttaaccagggagagagacacacacacacacagcacacacacacacacacacacacagagagagagagagagagagagagagagagagagagagagagagacagtctgtgtatctatctgtgtctgaagcgtgattttgtgtagagttgtctctatatatctctatctttgctatatat

SEQ ID NO: 516602 - DNA, 677 bp, Homo sapiens
tactgttttactgaacttttagggccaggaaatgggtaggctccgagctaacatggcaatctgattgtcctcagaagctactcaatccaaatacatcctacagaattccgctaatacgatgtgcattctataaggtgcctatgtttggaaagagtgcaatagatacacagcccgtccattcttgacctgaggtgaagtaatggattgttgccaaaatttctatctgtggcttcgctagggtctggacttaaagacaggggttgtagacctgaaaagaattcttgctccttttatagaatttcacacacaggaggatttcttgagctggcaggctgtagaaacttcttctctgtggggagggagctgattctagctttcagggccctcactcgagggaagctcgagataacaccgtggctgagctcctttccgttttgataagtgcccccagctgatagggagaccgggtcaacttgtagtcgaccagggaatcctggccatggccctcttagacattttaacaagcccgggagcagcgaaaggttcagttttccctttatgcagggaagcctgggctcttttttcttccgtggacaaaccggccggaggccgatcttttcgcccaaaacggtttacctttttttttcagccaaccagggcgtgttttttttttgttt

SEQ ID NO: 516603 - DNA, 141 bp, Homo sapiens
tcctagtcctatcgccctccatccctacgaatcctttacatacaagacgaggtaaacgaatcctccttaccatcaaatcaaattggccacatggtactgacctacgagtacaaccgactacggcgaattaattctcaactc

SEQ ID NO: 516604 - DNA, 168 bp, Homo sapiens
gctgggcgacaagagggagactgtctcaaaaaaaaaaaaaaaaaaaaaaaaagagagagagagtctgactctgttgcccaggctggagtgcagtggcgcgatcttggcacatcacaatcccttccctgccccctatcttgtcctgaaatatttttggggttggaactc

SEQ ID NO: 516605 - DNA, 457 bp, Homo sapiens
gtggatctggagtctgaaggagaggagtgcgctagagcattctggggtggggcttggaagggcgctgagggcagggttctagaaggggcgaggctttaagcgaggcagaatggtggcgctccagagtaggtggggtctggagtggtaccagagcctatggtaaagggtgtggctgggaacatttgggagacttgagcttgattctaaaggggacagatcgttgagcaaggcaagaagtgggattcaggaatgggccaagtccaggatcgcagacagggtgtgggcttcagagatgtggtgcttccatggtggttgtcagaagagggcagtgcctcctcatggtgcagtgagggagacatgttttgagcaatggctgggttgtggtgcagtggagaggggacgtggataggatgcttccgagatgggatatggtgatagggtgtggtgagagatatga

SEQ ID NO: 516606 - DNA, 440 bp, Homo sapiens
agagttaagttcctatggcatatttctgggcacaaaaacatcaccaaacttctaaataaagacccaagacacttctaatattaaatattgatgtaaacgtgagatatgcaaacatttaagcaagattaatacaaatatgataattattggcttggcacagtggctcactcctgtaatcccagcactttgggaggctgagacagggagatcacctgaggtcaggggttcgagaccagcctggccaatgtggtgaaaccctgtctctactataattacaaaaaaaaattggccaggtgtggttgtgcacacctgtaatcccagctacttggaagagtgaggcaggagaatcgcttgaacccaggagacgaaggttgcagtgagccgagatggtgccactgcactccagcctgggcaacacagtgagactccatcttaaaaaa

SEQ ID NO: 516607 - DNA, 920 bp, Homo sapiens
ttacgaatggcggcgagcagggagccaacgacgaacgtggtggatccattttctaagaaagattggtatgatgtgaaagcgacctgctatgtgcaatataagacatattggaaagacgctcgtgatcaggagccaaggaatcataatggcatctgatggtctcaagggtcgtgtgtaggaagcttgagtcttgctgatttgcataagtgatgaagttgcgatttagaagaacttcaaggctgatgtactgagagaatgttcaggggtaagaaactgcctgactaacattccatggacagtggatcttacccgtgacaaaatgtgttccatggttcaaaagaatggcagacaatgattgttgctcccgtcgatgtcaagactaccgatggttacttgtttcgctctgttctgtgtgtggttgttaactagacaagatgcatacaatcagatacggaaagaccttcttatgctctagctaacattgcaggtctcagccaaatccggaacgaagatgatggggccatcaatgaccgcgagaggtgcagaccccatgcacgtggaacgaaagtggtcggtgatttgattccagacgagtcattggaagacgacctagaaaaaggtttgcatctagttattgttcgtccatgaatgtcttcgttagaaaaacgtgaagattcgtggaattgaaagcccagttttgtattcgggaaaagcctcattggagccgtcatggttgaacaggccgacgctcctgggaaaagcccatggggaccaaaaccggggcccagtgaaaacacctcgttggtttaaccccgtccacaactgtttaagcacaggcccctttgcgcctccacagtgctctgtccccaccacacaaaccgggggggctattccggggcccaaaccccctttaaagccca

SEQ ID NO: 516608 - DNA, 202 bp, Homo sapiens
cctcatgtaatgtgcgtcaggatctctcagcctcgcatgtcgctgcctcttccatgtggatggtggcgtcgggttctctccagcactcgcatgtcacctccctcttccatgtgacatgctggcgtctgcggttcctctccagcactcgcatgtcgcctgccttttcatgtgagatggtggcgtccgagattcatccacaggt

SEQ ID NO: 516609 - DNA, 760 bp, Homo sapiens
gcagacactgaccttcagcgcctcgggtccagcgccatggtgcccttccaggaagctcttcgtgtgggggaaactggaatatgaacgggcggaggcagagtctgggggagctcatcgagcgactcgtgaacgcgggcaaaggtgctcgagacagaatacccgagtgtggtttgtgcctcccactctaacttggcctatatcagacatggcgctccgggagaagctagaatctccaagtattgctgtggctgggcagaactgctacaaagtgactaatggggcttttactggggagatcagccctggcatgatcaaagactgcggagccacgtggtgtggtcctggggcactcagagagaaggcatgtcttggggggagtcagatgagctgatgtgggcagaaagtggcccatgctcttggcagagggactcggagtaatcgcctgcattgggggagaagctagatgaaagggaagctggatcactgagaaggtttgttttcgagcagacaaggtcatcgcagataacgtgaaggaccgggagcaaggtcgtccgtggcctatgagctctgtgtgggccatgtgtactggcaagaatggaaacaccccaaaaggcccagggaagtacacggagaagctccgaggatggctgaagtccaaggtctctgatgcggggttcagagcacccgtatcatttatggagggtctggtgactggggcaacctggaaggaggtggcagcagcttgatgtgattgtcttgg

SEQ ID NO: 516610 - DNA, 231 bp, Homo sapiens
  misc_feature (216)..(216): n is a, c, g, or t
  misc_feature (229)..(229): n is a, c, g, or t
accagtgaataaggggcgcaacgtcatcggcctgggctggatgctcggcgggctgtcgtttgccgggatgctgtttggcccgagcaacatggcgatggtggtcgggctctacagcctgggcctgttcttcctgatcgggccgtactcggcggcactgtttttcatcagcgaaagttttcccaccagcattcgggccaccgcggccttattcactgntaccgcaaccatntg

SEQ ID NO: 516611 - DNA, 875 bp, Homo sapiens
gatgagctggtggaggagatggagcactttggccagtggtctctgtggcaagcaatcaaggacaaccgcatccaggttggctacgagaacgtgccgacatattgacatccacatgaaccagatcggcttcgagcgggagtggtacaaattcctgctggagtacattgcgcccatgacggagaagctctaccccggctactacagccagggcccagtttgacctggtccttggtcgtccgctacaagcctgtatgagcagccctcactgtatgccacaacatgatgcctccaccttcaccatcaacatcgccctgaaccgagtcggggtggattacgagggcgggggctgtcaggttcctgcgctactagactgttccatccgagcccctaaggaaggggcgtgtgacccctcatgcgtcctggtactggactcaccgcattaccatgaggggctccccatcacaggggcacccgatacatcgcagtctccttcgtcgatccctaattggccaggcctgagcctctggacctttcttctttgccgaaaacactgcaagcaggctctgggacctcggtgttccaggaaccagtgcagcctcctggctgttgacttcccggttgctctggagccagccagtcaaagagatgccacgagattcttgcaggcgacggcggaccccaccttatggtggggtccggggtgtttgggcccgccctgggacgcatccctgcctgcttcggatggcccggcctccacctgggtctgaacggggccttcccacttcttcgtggtgggctggcgacacgcgtccatttccagaatgtgtgggaccggcggtccgcggtgcagctgttgggaagccaacacagggcgg

SEQ ID NO: 516612 - DNA, 138 bp, Homo sapiens
  misc_feature (40)..(40): n is a, c, g, or t
gttcgagtccagagtccgctcagagttccatgtcgatcangtgacagtctcgacagacagtttccgtccgtctcatcagccccgtactactacgtactatactatcagtcagtctagggtacgttagacaccgagacc

SEQ ID NO: 516613 - DNA, 219 bp, Homo sapiens
gcggccgcctactactactactgctcgaattcaagcttctaacgatgtacggggacatgaagacagtggctggcaggtgtctggacgtacaatacaacttacgctgtaacggtaaagttcgtataagaagactgaaggagatgaaagaccagtagacgctgctatactctaagagacatgactggagtataataaatgggataatgtatgttacaaaaa

SEQ ID NO: 516614 - DNA, 881 bp, Homo sapiens
ataatttgtactttttttttttcagacagtctggctctggttgcccaggttggagtgtagtggcgtgatctgggctcaaggaacctccacctctcaggtgtaagcagtctcctgtgccttagtcctcccaagtagctggggataataggcgtgtgccaccacgctgttaaagttttggtggttttgacatagagaggggttttcaccaattgttgaccaggctggtttctggaactctggacctctggtgatctggcccacctcgtactctcccaagagggtgctaggatacacgggcgttgaccccatttgccaccgggcatatatttcggacttctggatagaacttcttgcagtgctccaggaccttactcccaatggacatgttgtgtcccaaaaaaaccttttcgcttggcccagtttccaaactcaattgttttgacccataaattgtggctgtgacagggtagtggggcctaattatcactctgggggaagatgagagcttgttgtggtcgcccaagatgggattgcaggggcgcatcgacctgggcctcgttgaaacctttcttgctcccgcgggttcaacagcaatttctccgtggcactaaagactccggaagtagccttggggatacgggtttgccaccaaacaaaccaggataattatcatatctcacgcagagcggtggggttccaaccatcttttgggcatggcttggttttgactctctttgacttgtggtccaaccacattttgggctcccaacagtgggttgggctaacaggcgtgcgccacacagccgggaggtttattgtacacttaggaactcgaaacaagcgtactagaatatactccgtgttggtggttggtggacacc

SEQ ID NO: 516615 - DNA, 293 bp, Homo sapiens
catgcattttttcgctattgcattgtaaggaaaaagatgctaacgtttaaagtggctttaacctccaaagatgttttgaaatgtatgtaattctttgggctaactgtccatcttatgtgaaatatgcttggaaaaaggctttaaaactggtgattatatatccgggtatgcgtacatatccctacacacctctgaaaacccttaaattagttttttaactcctcttgcgtattacaattcctcaagttaatctcggtttaggtccagtttaggtcctaaggtccagggccatt

SEQ ID NO: 516616 - DNA, 202 bp, Homo sapiens
  misc_feature (61)..(61): n is a, c, g, or t
  misc_feature (76)..(76): n is a, c, g, or t
  misc_feature (115)..(115): n is a, c, g, or t
  misc_feature (142)..(142): n is a, c, g, or t
  misc_feature (158)..(158): n is a, c, g, or t
  misc_feature (199)..(199): n is a, c, g, or t
aaagtttagccgcttccctgaagctctgagcattggcattgatgctcaatgacatggagtnggtagaagacatctncacctcctgcaaggatgtggtagtacagaaacagatggnattcatgctaggccggcatggggtgtncctggagctgagtgangatgtcgaggagtatgaggacctgacagagatcatgtccantgt

SEQ ID NO: 516617 - DNA, 830 bp, Homo sapiens
ataggagctgtagaaggccctaatgctcaggccgagcacgctgagaaggagaaggagcggctgctgcaggagcgcatgaggagccgagaggacgaggatgcgctggagcaggcccggcgggcccatgagtgaggcacgtcggcgccaggatcagcagcagcagcatgcgccaggagctacatgcatgcatgcagcaacttgcaacgcagactgcggtgtgctagccagccggacacccctatatggcccaagagctcccaagccccaagtccattgcttgtggaccacgcagatgggagtttggcccgtgaagcgtggtagcaggcagcgaagacgccgggaagccatggcagctaccattgacatgaatttccaggagtgatctattgtcaagtatttgaagaacatcttttctgagcgcacctaggttggcttctgacttttgatttctctggcaaaaccatttgactttccatagtgtcaggggcggtggtggaggtgggcatcagcggccaggcgatgcctcagggccttggccctccttgcatgctatgcccgggggcaggcctgaacgggcagcttgaaggattttgcaggagcctgtcttgccttacgtgccaagtcgggaaagacgtcccgccaaccaccagcccttcacaggacgttcgcttcagaacacgccttgttaccgacgcaagttgccggtgtgtaccccaaagcccttgattccccaaattgcggggccagaggcccctttttttccgacaaatgttctaaaagtattgaccagggacattcgtttgcttgcgccgtactgggtttctgttcca

SEQ ID NO: 516618 - DNA, 546 bp, Homo sapiens
ccgatcccttggagaccagggtgagtctgatgctcaaagtaagtgagctgttgtattagatagtgttgagttcataggcaacgaatcactgaaacacacatctggtcactgcttggacttcgcacagggccctggaatctctgggatacctgaatcctgttgtccctatgcggagtttactaatccctcttaattggagccagttcttcagaacctagtatcaaccagcttgggtatcacgtgaattctgtggtctgccaggccctgtttttgccattcctggaaggggtggccccagctgttatttagacatctactggatgccagctatggattgataacagaaaggaagggagatgctgatgatgcgtgttctgacagggttcccactaaatagagagactgactctctccataagtatttgattttcactttatctcctcgttgacttcacagcgtaagtgcagtatgttctactcactagggtagatgcatgcggatgaatgtttatgtcgaacattagaagtctgcgtgtgtgggtgaac

SEQ ID NO: 516619 - DNA, 152 bp, Homo sapiens
tagggtcgagctgggaccggggcataggtggttactcttgtggtactggatttgatggcggagattcgggatcgcctggggatctcctcagcccattacccgccagtgaccggagtcattgtgactctggaggaagggggaattgatgtggc

SEQ ID NO: 516620 - DNA, 714 bp, Homo sapiens
aaatataaaaaaaaaaaaaaaacttaaaaaaaaaaaaaaaaaaaaaaaaaaaccctttgtgggccccctggcccaaaccattttaaacttgggcaaattttatcctgggggccgaattctaacatacttggccaaataccccttataggggggggattaaaaattaatgggcggcgtttaaaaaaggttgtaatgggaaaaccccggggttaaccaacttaaatgactttgagaaaaacccccttttaaccggttggggaaaaaggaaaaaggcccgaacatagctcctttccaaaaattggcaaaccttaaatggaaatggaaatttctacggataaatttttggaaaaaactggcataaattttgggtaaaaaaatctattttttaaccaaatgggcgaaactggaaaaaaccctttttaaaaaaaaaaaatcccccgaaaaggggtgaagggttttccaatttggaacaaggggcccttttttaaggaccggggccttaaactcaaaggggcaaaaacccgttttccagggggaggcccaattggggagaccatccccttattaaagtttttggagggcaaggggccccaaagcccctaaatcgaaccctaaaagggccccctttttaaagttttgcgggaaaagcggctaccgttgcaaaaaagaagggaccaggggcggccctatggcccttcgtataccgccccctcc

SEQ ID NO: 516621 - DNA, 128 bp, Homo sapiens
ctgtggtgccgtgcaccttatggcactggatggctgcacctagccctttctgcttgcagatatcggaggttagtttccagcggcgcagtgcggggatattgtcaatgccctcatgtcatcgttccaat

SEQ ID NO: 516622 - DNA, 642 bp, Homo sapiens
gaatggcaccggcggcgcagtaggacggaggacgtccgatagggaagcttcgaagccagtgcaatgactgatgccatgtcacatggggccccacaaaggattgctgaccgtgatgaacggtcatcattgaccaactggactttgctgttggcacaaagcccccgttcaagagcacaaggtgcattgtacgacgggttaacaaccacttcatttccacgacaggcaggaggttaaccccgggccaggacggtattgagcattggcacagctgagttggccctcggagacgcaatttgccctgcacatagccgcgagagggaaggtaatattggagaacgtgcccaaaaagggcacacctttggcattaaaaagttacccaaaaattacctccctgacgggggagatacccgtagaggccacagaaggaatcgctaaatgggggcgggcgcaccctgaagcttcacacatcgggcactggacctctggggggcaggaaccccttcgttgctcaccacacagcaaaagaccctggacaagggcaccatacttaacgcccggggaaccccaaacatggtatgccttgggtacgactcacaacggctcccaagaacctcataaccttccaagagactcccccctgtg

SEQ ID NO: 516623 - DNA, 789 bp, Homo sapiens
agcggaagggctgagaggcgcacccgggcggccagctgggctcggagcggaacggggtcaggatggacgaggacgtgctaaccacccatgcaagatcctcatcatcgagcagagagctgcgggtgggcaaggtccagccgtgctcttgaggttcacagagtgatacgtttgatccacgaacttgcagcgaacgaataggtgttgacttataaggtgaaaacaagtttcagtggatggaactaaggctaaccttgcatatatgggatactgctggtcatagagaggtttagaagaattagactcccagttattagtagaggtgctacagaggtgttagtattagtcttagtgatgtcacaagtaggagcatagcatggtgttgaaaactggataattggttgtgatgcaagttcggacacatcatactgctcacaaggagacatgacatagctagacgaatgctacttggagactcaagaatcgatacggaaaatcgggaatgtcgactagtacatgataggccttgtacatttgcacgaaagctattccagtgttatgttatagaggcaacgtgcaaaaacatgtgatggtgtacaatgtgcctttgacgaacttgttgataagatcattcatgacccctggtactgtgggaaagtgagaaccgagaagtaacggagtctaactgtcacacggggaagaaggccaaggaggaggagcctggggtggttattgctctgtgttataaactctgggaaatccatctcttgcatatttgagcagatagtgact

SEQ ID NO: 516624 - DNA, 187 bp, Homo sapiens
cgatctagagtatccccctggagcggttttctcaacagggctgctttgctgcgtgatcgaggacgatgccgatgaggccctggagatctactcaggcccagctgttatttgagaaccggcggtaagggacggcagcagcagcagaagcagcagctgccacagacacccccttcctgtttgaagactt

SEQ ID NO: 516625 - DNA, 196 bp, Homo sapiens
aaggtttggccccggggggggaaaaaaaacccccccccccccttttttttcccggggggggggggggggctttttccccaagacccctttttttggggggggtttccccggggggcctttaaaaaaaccccccgggggggggccttttttccctttttagggtttaaaaaaaatatttttggggggttttttttta

SEQ ID NO: 516626 - DNA, 1306 bp, Homo sapiens
ggaaaagaatccaagatgtgatcctagaagcctgatgatcgtcacagggcttgtctgcgttctcaggattcggaacgctcaatcctgattagtcggaggtatctggaccagctcattacgtgggagcgtatcgctaagcgtatagggatagatacgttggtccataatgagatctcaactattgctaggggcctatgtatatcggctccaccacttgtggcgcatgcaattactgtgtcaatccggaaaactggttactcaggggactggactattagacatggttgcaagaattatgatatggcggcaataacacgtgggtgacagctggactagagcagaattgtagggtcatacaagtaacattgacataggcccctgtgattgtggaccaggtggaacggaggtgaattcaggcattcattattccacgttccctaaaaaatgtgaaccttgttcacacatcgatctgggccaattttgcgcggaaaaggaattccatagttgaaccccaaagtttaatcggcgagcggattcaagccaaggttcccatgccgagaaggaattttgctacctagagggcacaatttgggcctctttccgtaggttctacgcgtaaaacagttagtggatatctggggggttgccattcagcaaattcgcgaacaggggaacttctgttagagagactttctacacaatgggtctttggacagttgcacaacttcgcggcggcaacccgcgaagggaactctactgtgcgcaggcgcggcaaaacgcgcaatcaggcacacactggtatacgcgttgtggaaagttcccaagtgtccctttccctgcaacatcgttggcaaaccgcttttgtgcaacacagcagggcggctttgggaccctagcggaaaatagcccacatttgccccccgtttgagggtccccacggtggaaaaaatagaggcgaggctcaacaacggggccacatgtggccatttcacacacctttgggacaaacgagtctgcctcctaatgttttcaaactctggggttggttgggcccaacgcatttgtatcataagtactcgccaacggggggcggtctttcccaacaaagtttcgttcccgaagagacagcttgtcccttcaacccccacggtgttaaaaaccaatggtgttgggacccgcacctttcacaaaccacaactttttgtgtttcgcaaattccggaaaagacggaaaacagggtacctttaaaggtggaaaccccacattgttgctcggcacaggggggggcccctttgttccacacatg

SEQ ID NO: 516627 - DNA, 110 bp, Homo sapiens
tgctaggtgtcatgcctagctgaagcccagagtctccgaatgaagcggtccccagcgtcgactcttgaagtcacagccatagcatttcgtgccacacatcttctcatagt

SEQ ID NO: 516628 - DNA, 1421 bp, Homo sapiens
  misc_feature (438)..(438): n is a, c, g, or t
  misc_feature (1421)..(1421): n is a, c, g, or t
taacaataatgtcaagttaaatctgccaaattttcaagttgaatttggggagcatgtttggccgtgggtgtgccacacagttaaacagaggtttcttgaaagtgactcaagtgggatagggcttgaaaagtgggcacgtggcccttagccagggtgagttaggaaccgggcagggaagggcaaagaagggtgagcgcccttaagggttcagctcaagacaggagattgacccaggtggaccaacgccatgtagaccctctctgaagggaccccacgggggccaacagggctttcccagatattatatatatggccccttcttctgtgaatgtgaggcaaccccagggacaaacaacaagtctcgcggggggcgtgtgtgtgtgtgtttcgcaaaactctgtgtgtacaggcaaggtgtgtcctctctctggtgggganacacaccacaccccctcttatacatgtgtcatatctctatatctcttatcccagaaacacatattgtgaaagaggctctcttcttcttatatccccacattctctctcgcgaggggaccacccccgcgagaacagaggggcccctcgtgggaattttcctataaaacagcgaagacaaaaaaaacaatttccaagagtggggtctcccattatgtgaaagagtggcgtgtctccgtggaattcttttcagtggtctctcaaagaattatgccaattttttgggacctcgagtttaaaaagttttatatagaaggggcaaaaagaaaacatgttggagggacacacagaatataattcacagaaaatgtgaaggttataaaagaagaggttttcaaaaaggggggcaggcctcctcctgttgaaaaggtcttttctcccccaaaaaaaaaagaccccccgtgggtttacactcaaaagggggatacctggaggtagcctcgacatgactagccattgatcataggactagacatgacttgacatagccatgacagacatgcacatggacatggcctagcattaaaaagtagtatccccagagagcaaaaagaaaaaaggataatccagcgcggccgcagcagaatgatcaaacaaagaagcgagtctcccaagggcccccaaagagaaggtggttcttttcttgtggccccaaaagaaaaatctggcctcacatactgtggcccaaaaaaaaaaagacaaagcagcgcgtgtggttatcccacaaaagactgtcttctatagagagggggggctttaaaaaagagtcactctccactgcccaaataaaaaaagcgacccgcttttgctcccacaaagagggtcgcttttgttggcaacagaaaacggtgctactgagggttgggcaccacctactaataaacgcgaatacaagagaggagctttatcttagagctacttgtgan

SEQ ID NO: 516629 - DNA, 382 bp, Homo sapiens
acttttgcaagagacacaacattcagacaattagaagacactgtcttgccttcaggtagttttcatgttatccaggccatttagaatgagtttattactcgtcagagtacaatattaaatatattgaaagttctgaagttgagatattatacagtgatagcacttgtcttgtatttcatattttagaatagtggttctccatgttactcacatattggaattgcttgggagatgtttgaaatttttgtgccttgtcgtcacccctgatcagttggattctactcttttatggctgatactatcgttctactagtgctggacttctgttgtgatccagttagtatttgagtgatttctttctttatgggcgtctagatgcctt

SEQ ID NO: 516630 - DNA, 419 bp, Homo sapiens
ctctacaggatcccctgcagctagacacagcagcgctgttagtgagcttagttagcactgacttcgtaaaataccatacatcggccagtcttggaaaagagaaaaatcaatggagtttcttcttttaaatacagacacaaacttatctcttccctggagaggctgataaatagcctttctgtcttttggccattgccgagtgtattgcctcgtttgggggaggatgagggactgtgttcagctgtggtgctttgtttgttaaggcagcctggcctttgctactcgaggagaaagatggagcctagggtctcaagcccaccttcgctgtacctttgctacatagtactgtatgcttgccagctagaaggagggtcagggcatttttttaccgtccgtgactaagtgtgtgtgacttacgc

SEQ ID NO: 516631 - DNA, 411 bp, Homo sapiens
ttacacagagacaccgtgtctcatcccgacgagaggatacactcgcggtagactcctcaataacagatgtctgtctgcatattaatgagactagcgcacgaataattggtgagtaaacatatcagtgtcagaatgaacccggaggccttatgttcatgcacacagacacccactcacccctaaactctccccttccacccactaggacaattgaaacagacgcccaagcaggctatgacccaataaagtgggacggggcaagacagggaaaccaccaaggaggacctgtaaggagaggggtgtataacaaggagggaaaaaccccccatgagttggtcctgggtattggcaaggtttcatatactaagatccacttgcctccaccaacctccctagaggggcacaaagcta

SEQ ID NO: 516632 - DNA, 157 bp, Homo sapiens
  misc_feature (85)..(85): n is a, c, g, or t
tcaagcttctaacgatgcacggggacatggtggtacatacctgttagtcttagctactcgggaggctgaggcaggaggactgatntgatcccaggaagttcaaggctgccagtaaagctgtgcctgtggtgacagagcaagaccctgtctctcaaga

SEQ ID NO: 516633 - DNA, 481 bp, Homo sapiens
gacagagtctcgcactctagtcacccaggcggaaatgcaggggcgccatctcagctcacggaaagctccgcccttgggggctcaagcaattctccggcctcagcctcccgagtagctgggttaacaggtgcctgccactgcccccagccaattttggtattttagcagaggtgaggtttcatcatgtgggccaggcgggtctcaaactcctgacctcaagtgatccacccgccttggcctcccaaagtgctggaataataggtatgagacaccaccccagccaatgtttctcaaagtattaaagatacttgtctacttaatgtggcattggctactttttaaaaagaaatattggtgaggtatttggcaagggagtaggaataaggtgaaggaattaccttgggagaaaagacttccacagagctctaatggctttacacttaaaggtgtatctcaatatagactacattttccccctgtg

SEQ ID NO: 516634 - DNA, 100 bp, Homo sapiens
caaagtccaaacagtgcccatagtccaaacagtgccagagtccaaacactgcctgggtggtggttcacaacacttataacttagagagtttgagagccag

SEQ ID NO: 516635 - DNA, 922 bp, Homo sapiens
ggcaggccaagtggaaaatccaagggaaaggcccgaagtaagagcaccaggctccagtacaacatggcctgtccggagaggcaagtcaatttccttataaaatgatgatatctgagtgctcccgactccaaaaggtcctcaacatcctgagcgaacaaatgatccttttattcaacgaagtagcctttggccactctggttaccaaatgcagccatattcatttaaccccagaatgccataccgtgaatgggggtggctgccccaattcatgtgcaacaactgataaaaaaaaaaaagaccccataattagggaacaagactttacaaatgcccttaataacctgtgagttgtgaacaccgcaagcaaaatcagggcaaagattaagagtgtaatccagtcaagtgtgtggtggacaccatggttctgtcgctggaaactcagctgtgcagatgggtgggtcaagaatgttaaaccaaaaatggattgttgatattcattaccaacattttgttttcctatttctttccagaattttggttgagttattcctggaaaatcatttccaccaagatacagattatgaaactacttataaatttactgaaaatcagcatgaaagagagtggtcagttgtaagtacatcagaatcgttccctcttaataagatgcacagcgacgtctctaatatccttacctattggattaacttgccacctacaaattgaggtcgtctcaaaaaacaaaaaaacaaaaaattggggccgcgcaagaattcaaccactctgtgggcggcccacaataaaagcacggccacaacacgacaaagtgtgtcccaaaacacgggcactcgaccaccgctcgtctggcacgcccaccccccccgcgcacgggaagaggcatcaacccacacagcacaacga

SEQ ID NO: 516636 - DNA, 156 bp, Homo sapiens
aaaataaagaattctttacaatatataaccacattatcatgatcacatctaaaaatttaataattgtaaaatatgacctgctatctagtcagtttcagattttctctagtttctcatatattttttgctcttttatgaatcagggtccaaataaag

SEQ ID NO: 516637 - DNA, 974 bp, Homo sapiens
ccggtgctcgcgtgctcgaggctttcgtgatctgtgggagccgggctggcaggtagcaggatggcgtgcggtgtcggctgccagggcgaggcgcgccgtgtgctggtgtactgtgggaagtggtgctctgtgttctcgatgcgtgtcaggctttttgtgtccgcaactggtgggttgccagcgttatgattgttggtatgtagaaatgacagaggccatgccgcataccattatttgtttaaacactgacagactcgtacactgcaagcagcgtatgacccagcgtgactgctgagtgtttggaaagcctcttgggatgaaagagaacggtggtatgtaaaacatctttgccgttgtctgtgcatgcgaactgtggtccgtgggcgtcaactgcctaccatccaaggtctctctttaatgaaacttgctgtaccgtgtttgtgtagagcctgaagcatttttggatcgtcggatccattctcctatgtccatctgtgctacccaagcatctcttagggcaagtgaggcctcctagtccttggcttggcgcatattgctgcccctggatgggatctccctgtgtatgatcgggtacgggcgatggccaagtgggtgctgttctaccagctctgcccagagactggctgtgggaagagatcgcgtgcgtgccgccccgggggcaggcgactatcgctgtgctcccggttaccctggatgaccctgatgaagagaaatccaattgcctgaggttgacttcgactctggacacccttagaaattctagttgaaatttttcatgactggatctccgggaaaaacccgccgactcggaaagctaatccgtgttcccacatgagggggaactaccccactatttaagccctaataacatataagggcgaaaaaaataacagttctgggtatacacgtttttttcccctgggacaagaaattatacaaaaagcttcacagaa

SEQ ID NO: 516638 - DNA, 1151 bp, Homo sapiens
cggacgcgtgggctagggaagcccaggctcgtaccagcagttcttccccacactgggagatgtcctccctacctgggtcccgggagcccctgctccgtgtggctgtgactggaggcacccacgggaatgagatgtgtggtgtctacctggcccggtactggctacagaacccaggggagctgcagagacccagcttctcagccatgccggttctggccaacccagcagccacagctgcctgttgccgttacctggaccgtgatctcaaccgctcctgcaccctcaccttccttggttccaccgctacccctgatgacccctatgaagtgaaaagagcccgagagttgaaccagctgctgggtcccaagggcacaggccaggcttttgactttaccctagacctgcacaacaccacagcaaacactggagtctgcctcatctctgaatccaacatctccttcaacttgcacctgtgccactacctacagcggcagaacccggggatgccctgccgcctctttctgtatgagccagctgggacggagaccttcagcgtggaatctatatccaagaatggaatctgtctggagatgggcccacagcctcagggcgtgctgcgggccgacctgttctcccggatgcgagctctggtggcatccattctggacttcatcgagctcttcaaccaaggcatggacttacccgcctttgagatggatatctacaggaacttgggcagtgtggacttcccacgcactgcggatggtgacctggctggcactgtgcaccctcaactgcaggaccatgactttgagccactgaggcctggtgaacccatcttcaagcttttcagcggagaagacgtactgtatgagggggactccattgtgtaccctgtgttcattaatgaggctgcctattatgagaagcacgtggcattcctgaagtctgagaagatcagggtcacagtgcctgccctgctgaggttgaccccccgctccacccagactccctaacccaaatcatacctggcctgatctcagttttcctatctgaacaatgggtcccaagcccagggtcccctatctcactctggacaccatatccctttccagacaactgatctcattatataaaatagactgtgcccc

SEQ ID NO: 516639 - DNA, 1296 bp, Homo sapiens
cggacgcgtgggctagggaagcccaggctcgtaccagcagttcttccccacactgggagatgtcctccctacctgggtcccgggagcccctgctccgtgtggctgtgactggaggcacccacgggaatgagatgtgtggtgtctacctggcccggtactggctacagaacccaggggagctgcagagacccagcttctcagccatgccggttctggccaacccagcagccacagctgcctgttgccgttacctggaccgtgatctcaaccgctcctgcaccctcaccttccttggttccaccgctacccctgatgacccctatgaagtgaaaagagcccgagagttgaaccagctgctgggtcccaagggcacaggccaggcttttgactttaccctagacctgcacaacaccacagcaaacactggagtctgcctcatctctgaatccaacatctccttcaacttgcacctgtgccactacctacagcggcagaacccggggatgccctgccgcctctttctgtatgagccagctgggacggagaccttcagcgtggaatctatatccaagaatggaatctgtctggagatgggcccacagcctcagggcgtgctgcgggccgacctgttctcccggatgcgagctctggtggcatccattctggacttcatcgagctcttcaaccaaggcatggacttacccgcctttgagatggatatctacaggaacttgggcagtgtggacttcccacgcactgcggatggtgacctggctggcactgtgcaccctcaactgcaggaccatgactttgagccactgaggcctggtgaacccatcttcaagcttttcagcggagaagacgtactgtatgagggggactccattgtgtaccctgtgttcattaatgaggctgcctattatgagaagcacgtggcattcctgaagtctgagaagatcagggtcacagtgcctgccctgctgaggttgaccccccgctccacccagactccctaacccaaatcatacctggcctgatctcagttttcctatctgaacaatgggtcccaagcccagggtcccctatctcactctggacaccatatccctttccagacaactgatctcattatataaaatagactgtgccccaaaaaaaaaaaaaaaaaaaaaatttggcaccaaacacattcgcatttatttttttttttaagcaaatggacaaaaacccaaattaccagcttttttaaacctaagcttaacattacatatttaaacaatagtcaaactggacggg

SEQ ID NO: 516640 - DNA, 1300 bp, Homo sapiens
  misc_feature (358)..(358): n is a, c, g, or t
  misc_feature (412)..(412): n is a, c, g, or t
  misc_feature (704)..(704): n is a, c, g, or t
tttttttttcccaggtttcccaggagaaaaatccatcttttgggtggttaatctggggtcagtctccctttcttaaagggcctggagggtctatctctctttcaactttctccagaacttgggaaagaactcccgcggctgtgttccacttctttagaaatgtgaagcccattttgtgtgccccttttcggtgaagaggtgttcccgtggatcaccacgcgtgacgtttatcggagggcattacgagccgcgagacaatatagggagggagggagggaggtataacagcgtgtgcgcgtgggtataacgcgtggtaacatctccttatctcatataatatagtctcgcgcggtggaanagagtctcatatagtctcacagagtctcaaagagagagggaggcgcgtatacanattctctcgcgcgctgtggacgagaaatctgtgtgttctacaacaaacgctgtgggcttttctcccctgcgaggtctccaacatttgtgtgggactctctgtggagaagccccgaggtgtataatatatctctataaaaaagcctgtgggccgaggacaaaatctatatatctctgtgtccaatctcctctctctcgctgtggcatacacgagaccaccgcccagtgggagacatattcatctctctctacaattataacacatactctgtgtggaacgcaggaagggacanacagccgcccttatatgtagaaaacagagagaggcaggccccacacaacattgtgtggtgcgcatattaccctgtcagaaaacaagagatgtgtggcgctctccacaaaaattgcgaagaccattttctcgtggggaaaccccacacaaagagagtgtgtgttgtgcaagaatatctccccccaatgtgaaaattacacgcgcgggggaggaaggtatcaccagaggggagagcacggagaggggaacctccgttgctccatgagtggtgggggcacaacaccggtcgtggcggtggggccccaacatgcggtgtgcgtatgaggaacgcggacggacaaggcggcgggctgttctctctacacacaaaaaaaggcgcggcggagaaaaaaaagtggattaagcgtcgatgaaacaggaacactacaaccaaacaaacattttccctccaacgaaaggacaagagggggggcgggcggggcgccacgcacaacagcaagagacattctcagaaaaaacgagaggaagggaatcctccccataaaacaacaccgggggagatacccaggcggaaacaaaaaaaaagacccgaaaacg

SEQ ID NO: 516641 - DNA, 145 bp, Homo sapiens
  misc_feature (11)..(12): n is a, c, g, or t
tgtacgagatnnagagagagaagaaagaaagaaagaagaaagaaagaaagaaagaaagaaagaaagaaagaaagaaagaaagaaagaagctacaacaaaaaccccagaaccaccttttttcaaattagtccctgtgcaaaggaaa

SEQ ID NO: 516642 - DNA, 343 bp, Homo sapiens
ctccactttaagttaagcctgggcaacatgttgagatcctgatctggtttggctgtgtccccaaccaaatctcacttgaattgtaattcccacaattcccacgtgtcatgggtggtgactgaattatgggggtgggtctttccggtgctgttcttatgatagtgaatgagtcttacgagatctgatggttttaaaaaccatcagtgcagggagttgccctgcacaagctctctgcctgctgccctccacataagatgtgtcttgctcctcttgccttctgccatgattgtgaggcttcctcagccatgtggaactgtaagtccaattaaacctgtttcttgca

SEQ ID NO: 516643 - DNA, 318 bp, Homo sapiens
atgagatgcctgctgactagcctatattagatgctgactcagttgaaagtaaggatgtttgcactatgctgaggcaaaggatgtcttcctgcgcatgatattgtatgaatatgcaagaaggcatcctgaatactctgacatgctgatgctgagacttgccaagacatatgaaaccactctagagaagtactgtgccgctgaagaacctcatgaatgctatgccaaagcgttcgatgaatttaaacctcttgtggaagagcctaagaatttaatcaaactagttccttacaccaaggtaccccaagtgtcaactcctct

SEQ ID NO: 516644 - DNA, 188 bp, Homo sapiens
gctgactcagcaggatcccgtcacatgacatctgcctaagaagaggtgctactaccttcgacacgtagtgacttccataaatggttatgttgggggcaagttctttaagcggaaatgtaaattcctcctgaactgttttttcatgcagttaccatgaactaatactacaatacaggatggtcttgtgt

SEQ ID NO: 516645 - DNA, 282 bp, Homo sapiens
tgttaatatatgcatggtagacctctatcactggaaactagagttagccgaggagataaaaacatttgctatctttgcttttggactatggtgtttttccttaagagacgaagtcacagaatattatatattatctcacattacctcctcattttacatactgcataatataggctcacgttattttcttgccccatgtttcactggaaatgcaatctattctaagaaacaaatatctaactaggtcggcgtgttggctcacgcctgtaatcccagtactgt

SEQ ID NO: 516646 - DNA, 410 bp, Homo sapiens
  misc_feature (29)..(29): n is a, c, g, or t
taccggttgacgccacgtggggttttgtntgcaagaataatccccttctctgcagctccctggggctctgtcattgcagagggggactgggatgactggggaggcacgcgccctgctgagggcagccacttctccagcccagcaggctgtaatccgacatccacagggattatcctggtaactggtggtgcatggcccctgtgctgagagggctgcagtgtgcacgccccgtttagagcatcgtatgggttcagcatgtgtccgcggatgggtgcttgaggagcacctgtcagacgggtgcctgtcaggccatatttttggcaatggtagcttcccgggaatgagggatttttcctgggataaaggcccccgtggagggtggtcagcagccctgaggacgtggcgtctgt

SEQ ID NO: 516647 - DNA, 223 bp, Homo sapiens
cgtgcaggcaggttcgtccgggcgcacggctaataggcgagttaaaactggtgcaggacctcgcgaagtgcgcagctgtgtaattttgacacaacgtgatgacatgcccgcggcgcttgttgacgcgatgtgatatctgcctcgatgcgtctgatatgtcggtcgtgaataactataatgctctctcgggtaacactggatggctgctttcttattgaatttc

SEQ ID NO: 516648 - DNA, 272 bp, Homo sapiens
atccaaagagttcggcacgaggcaccttactaccagacaaccttagccaaaccatttacccaaatagagtataagcgatagaaattggaaccctgcgcaattggttttgttaccgaagggaaggttgaaaattattaaccaggtttatttggcagggcttaccccttttacctctctgcatatgtgattaaacaagagtatatctttgacaggagagaccccaaatctaagacccccgagacacagagcgagctactttagaggcatcagct

SEQ ID NO: 516649 - DNA, 210 bp, Homo sapiens
ggaaaatatcgaccttttagccgctgacatccagctctgtgtccataggtaacaaagccaagtacacatttctaatgtgtgtgtgcctgtgtgtgtgtgtgtgtgtgattaaatcttgctctggctcccagactggagtgccgaggttcaaacttcacgccactgccgagacattggggacctgctctataattggaactccttgcaatt

SEQ ID NO: 516650 - DNA, 231 bp, Homo sapiens
tcaatgctttatattcctcaacgctttatacttcactaccgggaaatgaaatgagaagcgttgagaaagtataaagcgttgaggaagtgtaaagcgttgaggaagtttaaggcgtggagagagtataaaggcgttgagaggagaataaggagttgaaggggaatcagggtgataggcggtatcctgggtgaaagtgcggtatccgggacggaagtcgttttccgtgacgaa

SEQ ID NO: 516651 - DNA, 1547 bp, Homo sapiens
ttcgctctgtgttcgtccttttgtgtcgtgcgcacggacgtgtcgcacgaagattgttttgctgttgtgtctcgatttttaatcccacctgccatctctactctgagggtgaacgacgtcgctcccccctgcctgagtagagaagcccctgtggtcgtgcgaactgtcttgctgcggatcttgtctgtatccaactcccactctcggtgggggggggcctccaccactcctgaggagggtcgtccgccccccgcgcatcggtctgcgctgtgtgtttgggtcgcctaccgatggccgttttggtgtgttttccaccccagataagatcaaacccaccaatactcccatgccgacatgacgtgttcgttttaagagggtgtcacccctctagaaccctccgcccgttttggtctctccccctcccatcatctcctcttggcgccaaatttgttcgctcaagcgtgggtctgaataaggcgcgcgcatgactcttttgttgtccaagtggggtggtgtaaccacgctccggggggttctccaccgccccgcgaagcgtcctcgcttctgaacacaacccacccggtcctgctctcgggggttttttctccagaggggtgttggtggttgtccccacccaggcgcggtgttcgtgttccctactgtggggggtgcaccagccccgccaacgagaaagatgttgggggagtgtcccccccagtgctcccccccccactgagagccgccacccacgagaattgttttgtatatattttttgtggtgactactcaggagcgtgagatgtgttggctccccccgacacagtgtgatgccgcccccctcgttggtgaccccctggttggtgctcaacagacgcccctcttgtacgatgctcccctctaaatagggtgtcgccctctccggggagaaattgtggggagaccataatattgggcctctgtgggtttaaagcccactttaggaccccccccagtgttagagactcgcgcacaccaccccagagaggtcgtccacgcaccccgaggccccctctggcgcgcacacaccacgccacaccccctgtgtcgccacaccacagactctgtctttgtctaagcccctctctctcttgggttgctacacactctccccacccttggcccccccaccaccgcgagagaactcgagacttctataaaccccctcttcacttccaaattgggttgctataacccccgcgtcttcttcacccttgccccacccttcactcccaccccacgaagagatgcaccacgagaccccgcccacaggggcccgcgggcccacccgcacacacaccctttgttcccgggcctctgttctgggactgtgcctctcccgcgctcacaccacagctgaaggctcacgaaagggaacaccacaaagaagggaatggaaagaaaaagaacccaaagagaaacctgttcctcccacaccccctttccctgaatgcccggggcacccacgactgattttgaggccaccaataaaagaggcttcataccggaga

SEQ ID NO: 516652 - DNA, 217 bp, Homo sapiens
gtggaggatagactacagtgccgctgttatctatgaacttctgggtgtggatgatataaacggggacaggatccaagatgtcctttttctttataaaaacaccaaacagcagcaacaatttcagccgatcctgtgtggacgaaggcttttcctctccctgcacctttgcagctgttgtgtcggggggcaacgcgaggacgctctggaagagacctgt

SEQ ID NO: 516653 - DNA, 178 bp, Homo sapiens
tggagagggacaaggcagaggaatggctgcgtaagactgaggaaggaaatggggtttgaccactcccgaggctgcatgcggtgggaccaccctgactgtcctgtctccgtgtggctgccccatctgccctgctccgtgattggctccgcattgtcatctccaagcaatgacttgtgca

SEQ ID NO: 516654 - DNA, 101 bp, Homo sapiens
  misc_feature (49)..(49): n is a, c, g, or t
ataccttgcctgttgccccatagaaacagctgtattgtgtacactctgnttgaactgtgtttgattcctgctattgtgaactgaagactgcgtgggtgact

SEQ ID NO: 516655 - DNA, 731 bp, Homo sapiens
agaaacttcatctttaacttaacaaaaaaaggagggggctgtcccccagcacactgttagaactttacttatcctcttgcttgaagtgtgggagctggagaccattcaggaagctgtggttacagtcccagacagggtccctaaaagcaaggagccattcccaatgcttcctccttagggaagccttccctactttctcttccctcttctgggcagagtttgtaccttcctcctttttgctctctgtttatttctttaatttaacacttaacaacataataccatctttatttgttccatgtttgtatcttctactgaatgtggcttcaagaacagaaagcacagaacgtggcacgttggaggaaatcagtaagtgtttgctaaaggtccaacaatgaaacagaacagatatatccagtgctatgccgcgtcaaaagagtatgagaggtattgtggtgatgcttttgaatgctaatcagaataaggagggtgactagtccatagttatatagaatataggatatacagaatatacctttttctgtaacgggatgtgtcacttaactttgttccttaaagctccagaagcccaaggtcacccacaatgattcaagtattatcaatgttgagagcctgtaaaagcatcaagtatattatagtttccaaaaaattgtgaattagactgaaaaccagcatttaaaaaataaagtgatgttgacttaaaaaaaaaa

SEQ ID NO: 516656 - DNA, 375 bp, Homo sapiens
gtgcagcgggggggcccgggggccctgtggccctgtgatggtgaaccgcggtggcttccgcggaggtttcggcagtggcatccggtcgccggggtcgcggccgtggacggggccggggccggaggccgcggagctcgcggaggcaaggccgagcgataaggagtgggatgcccgtcaccaaggttgtgcgccgcttggctcaacggacactgcaacgactcaacgctccctgcggcaggagactctactcctcttcctccactgcccactctaacgcgcaactcacgagcatcactctgactctctcattcacatgagcgggcgcccctcttcatccacacggcactgaggcgctccctcagacagcactttaac

SEQ ID NO: 516657 - DNA, 293 bp, Homo sapiens
gggggggggggggggaccccccccccctggggtcctttgggcccccggttcccccgggcccggggtttcccccccccccctttttttttttcccccgggggggggggggggggtcccctttttttttcccccttttgggggcgggggggccccttttttttcccccccccgggaaaagggtttgggaaacccttttttttttcccaatttttttttggggggggggggggtttttttttttttccccttttcgggggggggggggggccttttaaccccgggcccccccccca

SEQ ID NO: 516658 - DNA, 751 bp, Homo sapiens
  misc_feature (366)..(366): n is a, c, g, or t
  misc_feature (751)..(751): n is a, c, g, or t
agcgggtcatccctgggccacaggcagccacggacctcgcctttcccacttggttagagtcggctctgccgggagaaagcgattccagaattccctaagttaaaggaatttcttactccttcttgagcgccatccaagggccaggccttagtctaggaactggcaacaccgtggcgaccacgtcagacaagatcgctgccctcattgagttcccaggttggcaggggaaacaaaaatgtaataaataactgcactttgcaagaagagctatgaagaaaaaacagggtgatgggagagagaatgcttggatgttgaagggaggcctttctgagatggcgacatcttgagctgaataaagaaggatgngaaaggatggggcttgcaaagttctggcttcaaagaattccaggcagagggaacaagagtgaagtctccaggggaagccagcttagtgtttggagactagaaagaaggggtgtgcggctggaagatggtgagtagggacaagtggggtcagactcatccatagactggatggcttatacacaacagaaatttttttctcacagttctagaggctgggaagccttagattaaagcacccgcagattcagtgtctgctgagggcctgcctcctaattcatagatagcacttgatatggttcggctctgtgtccccacccaaatctcaccttgaattataatccccataatctccacatatcaagggtgagaccaggtggaggtaacn

SEQ ID NO: 516659 - DNA, 524 bp, Homo sapiens
aagcattggatgaagaaacagaaaaaagagagagagagtccatctctttgaagagactcatacttccatgatttcaaattttacttcagagccacagtaatcaaaacagtttggtattggcttaaggaagacatatagataaatgggacagaattgagagtctggaattaaacccttacatttataattttcaggaagggtacccaggctgggcacggtggctcatgcttgtaattccagcactttgggaggccgaggcaggtggatcactagaggtcaggcgatccagatcagcctgtgcaacatggtaaaaccctgtctctactaacaatacaaaacaatttagcccggcatggtggcagccgcctgtaatcccagctacttgggaggctgaggcaggagaattgcttgaaccccaggaggcacaggtaacagtgagccgagatgagatcaggccattgcactccagtctgcgtgacagagcaggactctgtctcaaaaaagaaaagattccttgaccatat

SEQ ID NO: 516660 - DNA, 781 bp, Homo sapiens
  misc_feature (366)..(366): n is a, c, g, or t
agcgggtcatccctgggccacaggcagccacggacctcgcctttcccacttggttagagtcggctctgccgggagaaagcgattccagaattccctaagttaaaggaatttcttactccttcttgagcgccatccaagggccaggccttagtctaggaactggcaacaccgtggcgaccacgtcagacaagatcgctgccctcattgagttcccaggttggcaggggaaacaaaaatgtaataaataactgcactttgcaagaagagctatgaagaaaaaacagggtgatgggagagagaatgcttggatgttgaagggaggcctttctgagatggcgacatcttgagctgaataaagaaggatgngaaaggatggggcttgcaaagttctggcttcaaagaattccaggcagagggaacaagagtgaagtctccaggggaagccagcttagtgtttggagactagaaagaaggggtgtgcggctggaagatgggatgagaaaactaaaaatccagggggattttagcaacttgcctacctcacacaactagcagcagagccaggattttaacccagacagttccagggctcaggtccttaccctctgggctggccttccccctctactgccccctgataccctcacttttctgaacattggactcattcctgtagctggaggtagaggacggaaactcaaaagatgatcgaagattaaaaaacaagatgattgaggctggacttctcaaaaccttgctgcagcctgagcttgagcgtagg

SEQ ID NO: 516661 - DNA, 885 bp, Homo sapiens
  misc_feature (23)..(23): n is a, c, g, or t
  misc_feature (26)..(28): n is a, c, g, or t
  misc_feature (31)..(32): n is a, c, g, or t
  misc_feature (35)..(35): n is a, c, g, or t
  misc_feature (782)..(782): n is a, c, g, or t
  misc_feature (796)..(796): n is a, c, g, or t
  misc_feature (800)..(800): n is a, c, g, or t
  misc_feature (826)..(826): n is a, c, g, or t
  misc_feature (856)..(856): n is a, c, g, or t
  misc_feature (859)..(859): n is a, c, g, or t
aacatcgagctcgctccggtggncgnnnccnnganactgcgaaacgactttttaaaggacggttatcacattcaaacattaattttttatgataaacaattccatccaattgatttaatcaatacaacatttgaagatcaagcagataaatatattttttggcgttatgcagctgacagagccaaaataacaaatgcctatggcttcatttggatatcagagctatggctcagaaaagcaagcatctactccaataaaccaatacatacaatgccaattatagatgaaagacttcaggtaattggaattgattcaaataataatcaaaaatgtatttcatggaaaatagttagagaaaacgaagaaaaaaaaccgactttagaaatatcaacagcagactcaaaacatgacgaaaaaccatatttcatgcgttcagtcttaaaagcaattggcggtgatgtaaacactatgaacaattgagtcatagaacttccattattctcctgaagataataatcgccaaataaaccaatactcagctttacaatatactaactaaccgcagaacgttatttcatacaacgtttctgcggcatatcacaaaacgattactccataacagggacagcaggccactcaatatcaggtgcagttgatgtatcaacacggttcagcaacacccgatacttcttccaggcttccagcacgaggtttcttcctccgttgcaatttccagatctgcagcatcctgaagcggggcaatatgctcactggctacctgnatcagggttttttngggnttcttcccgcctcccggatccggaanaggtttcttgttccgttttctcaaccaggntgngcggcccattcttgatttcccccccg

SEQ ID NO: 516662 - DNA, 106 bp, Homo sapiens
ccccttgcggtcatcatatgaaagtctcaaggtggcagaatgggtcagatttttccattttcctgttttccattttaagcactgacagtcaagtagcctaagagtg

SEQ ID NO: 516663 - DNA, 466 bp, Homo sapiens
ggtttttgctgttacgatgtttgagtttcttttgtattctggatactaatcccctatcagatgagtagtttgcaaatatttcctgccattctgtaggttgtcttttcactctgttggttgtttcctttactgtgcaaaagatttttggttgatataagcccatttgtttatttttacttttgttgcctgtgcttttgaggtgttattcataaaatcttttttaagaccaatgtcctgaggtcttttccctgctttcttctagtagttttattgtttcaggtcttagatttaggtctttgagttgagtcttataaagagtgagtgggagggtttaagtttcattcgtctgcatatggatatctagttttccccagcgccatttattgaagagactgtgctttccccaatgactgttcttggcacttttgtcaaaaatcgattggctgtagatatgtggattaatttt

SEQ ID NO: 516664 - DNA, 1637 bp, Homo sapiens
  misc_feature (282)..(282): n is a, c, g, or t
  misc_feature (295)..(295): n is a, c, g, or t
  misc_feature (417)..(417): n is a, c, g, or t
  misc_feature (428)..(428): n is a, c, g, or t
  misc_feature (606)..(606): n is a, c, g, or t
  misc_feature (615)..(615): n is a, c, g, or t
  misc_feature (625)..(625): n is a, c, g, or t
tggaaaaagtagttagcattaaaggaaactccctccaggtggcttcaacgccaccagggacacagggcccccccaacactcttgaatcttctcctgcagtctcttctggctggaaagaattggggccttcacgagatgagacagggctggctatgggagagctttccctattcccaaaatcttgggtatgtacgccccgatcgcgcacacaacatacaatgagatgggagacgcaggccccatgttctggtgttttaaacagacacgactatatcacacccnctgtggtttctgngttcacactctggacacacagaagtgtccacacacatacttgtggtcacacaggtgtgtgagacacatgtgtgtgtggacagaaacagctctgcgtggttctcctctctattatagagtgtnggatagagtgncttctcaatcaccagacactttatccgcgagcagagatatagcgcgtggggtgtgtgtatatgtgtgtgtcgacaagtgtgtgaactcgcggtgtggtgtgcatgtgcagacaccgaccaaggctatgtatcacgcgggcgagccgcagactctctataggaagatatatattccctntgcgagagngggtggcccncaagagtctatgatagcggcgtttaacccccaagactaatatctcgtgtgtttaccaacacgggtgtgggtctcccctataaatagcgtggagcctgcgaataatttaataagggcatagtggccactggtggaccggtacgggttttaaacaacccggtcccgtgagacctgggcggagaacacaacgtggcagtaaaagcttgggagagacatctctggggtgcggaacaggggacacccttataaatttcctgggtgcgggtgggtgggcaccattaatatgtggggacccaaaaatcttaactcttaaacaaggaaggatttcaacaagggctcacataaggggttaacctaattatacaacacattttgcacaaacacgtgtgtaaatacagcgggtgggggtcaaccacattaatgcttgagcataatgggtatggttgggtttggaagaacgttatggggctacaaacggagaaggtaatgtgaagtgttagtggaccccacctatttaatcccacgggcgtagttgtattgtgtcatcacaaacatcggacatatacgaagccccaagcgacagtccaaagacgaaacatccaaggaggccacaagagcaacagactagctaaccaagaaggaataccagataggaagaaaaacaaaagaacaacgaagaagaaaaagaacaacaaggcacaaatagcaagcgaacagaaaaaaaaaaacaaagatacaacacagacacagcaagcaagagaaacagacaaaaaaacaagaagacagaacaaaacaggagcagcgagggaacaaacaaacaaaacgaagaagcaaaagaaagagccaaaagcgcgagcaaaacaaaagggaaaagacaagaccaaagccagagaggacggagagataaaagcaagaaagaagacgagacagagaaggacaagacacacaagaagacaggacgaacaacacaaaaacaaagaagcacaggcgtaccggaccgccgcagcagagac

SEQ ID NO: 516665 - DNA, 190 bp, Homo sapiens
gaaactcaacaaaactgttcgccagacggtacgaccatcatcttagtactcaaaggacctgccggtgcttcatatccctctagaggagcctgttctgtaaatcgataaaccccgatcaagcctcaccacctctagctcagcctatataggcgccatctatcagcaaaccctgatagaaggctacaaagta

SEQ ID NO: 516666 - DNA, 476 bp, Homo sapiens
  misc_feature (203)..(203): n is a, c, g, or t
atcctctaggaggatggtgttttctgagtgtggggaagggtggttcttgctggattcatggcagtaaagtaattaatgcttcattttaatttgatgttctgctagtgacctttgatttggaattagttattttgcatgtctgtcaactgtatatgtatgacaatagaaaaaaaacatgctttttgtaaaaacccctaagattngtatatgttcatctttaggcttctgagagggagagacatcatatgggaaatcagtgttggtgtactgaaatctgcttgtaaaactctcatctcattttacattgatattaaaacattttaacagtgctggctagctgattacttgattaattatactcccatggccccataggaagctgttgtgggcctctgttcaaaagcacagaaaagagcagaaggaaatgtcttagaaagaatcaaagctgatgaaatcagcacagattgggggaaagg

SEQ ID NO: 516667 - DNA, 221 bp, Homo sapiens
gccgacaacagcgaaggccgctgcgaataatgttttcaatttcatattcatgttaagcgagattttgtgcctggcaggccattgggttgagaatattagagtattggaagcgcattataagttcattccagctcacagtgaaatcagatgtgtacgaaatcacattttttcctttggcttgagtgtagaccttaagcgaggagcaggatcttctttcagac

SEQ ID NO: 516668 - DNA, 191 bp, Homo sapiens
aaaggggaagggcccccccagttttttttaccccaggcttttaagaaatttgggcccagatttttttatggtccggtggttttggattaaaaaaaccttttgggttttttgggggggggccggaaaggaaggaagttttttcctttgttattcattgaaactttccccattaaatgccctttttggtttta

SEQ ID NO: 516669 - DNA, 429 bp, Homo sapiens
ggtctttgatgatggagtacatgagaggagtgatgagtagagggcttaatctggcactctaatcccagagaaggagctgcggccagtcagtcaagcagaaactgcattcggtgggtctttctttgagagtggttgtcatctccctgttctgtgttccagcccccagggaaaggtatggcagtagaggatgaccaggtccaagcttgccaagtcagagctacggaagcatggtccgttcaccaacgccacgtttctagagagcagtgagctgattctcccatggtgagcaggggactacatgtgaactgggacctgcaggccaatgtatccctgaggaaaagtccaccagaacgattcaagaaactagtaagaaacaatgggcagaaagctgtgggacgaaagcacagcagggctgtgggtggcagaatt

SEQ ID NO: 516670 - DNA, 170 bp, Homo sapiens
tctaagtcttgtgaatgtgtcccatgagtgtctgtgcttcctcaagggaatagctgtgagctgctgattgccctaggacatatgcatggactgtgtgaccatagcttctggcatcattgccacctggtatcattgaccctggcatacttttctctttgcccaatataaca

SEQ ID NO: 516671 - DNA, 153 bp, Homo sapiens
cccgactccagattgataacggcaatcagccgtcggacactagtctcagactgctgactgatttcgcatccgcactcaagaatgtgtcgtctaaggattgcgcgccgtctcaccattaggcactctctgtttcttgtcttagactttttctct

SEQ ID NO: 516672 - DNA, 897 bp, Homo sapiens
gggagccgatctgccgagatggaggcgaccggcacctgggcgctgctgatggcgctggcgctgtcctgctgctgacgctggctggctgtccgggaccaggggaccgatggccatctgccccccgggcccacgccgtaccactgctgggaaacctcctgcagtctacggtccggggcgctgtattcatggcctcatgcgggaggaaggcaaaagccaggcacagaattcagcaacaagaacatgctgcatgacagtcatttatttgctgtatgctgggacgatgacgggtcagaagcacggtcggttataccctcctgctcctgagtgaaataccctcatgtccaaacatgtgggtacgtgaggagctgaatcgggagctgggggctggcaaggaccaagctgggcgaccgtacccgcctcccttacaccgacgcgggatctgcatgaggctgcaggggctgctggtcgcgtggtgaccatgggaaatacgcccggaccactcatgcggagcacaaccgcttccgatgggtatggaaccgtggcccaaggggcacggaggtcttgcccacatcgcttgggatccaatgcatggatgagcccaagatctttcaagcagccagaaagagttcaaaccagaaccgtttactggatgcagatggacggttccaggaagcatgaggcgttcctgaccttctacttaagggcaagcgtgtctgcgcttggagagggacctgggcaaaagcggagtctactcttcttcacacatctacagcttctcctggagagccgtgcccgcggaaaacctgagcttagccacggtattgctttcaacttccccagctccagatgcagtcgacacggcttaatccacacgcgacgtaagaggatgcatggggc

SEQ ID NO: 516673 - DNA, 365 bp, Homo sapiens
tttctcaaagctgcagtagattatgtcttcatcaagctgttaatttgtgcttatatcatatagaactctcatatccctgtgaagagctgcccccacctcaatgatatttctctgagaacaacttttgtaggactgtgtgttatctttatatacatttagtacaactgtaggtgacgagtagtcatatattgcttgctagctacacaccatggttgatccattttaaaactttggccattttgtatctcatgggccataaattcagaaccttgtattataattaaattcttttacaaaatgaggctcattcgcaatctcaatgtcacaaacctcatacagtaggatgtatttaaccacagatactt

SEQ ID NO: 516674 - DNA, 217 bp, Homo sapiens
cgttcactccttaagtcttatgtcaagcttctgatcctctgtggttctgcaggcacttccaggtgcttaagggtccctaggcagagtcagtcagcagctggtgacaaggaccctgaacaaggtgtttggttccccgggccgacatcaggactggagtccagcctccctgcagattccacaggtgcttccctcacccgcattgcaacacggtctctca

SEQ ID NO: 516675 - DNA, 100 bp, Homo sapiens
ctttacctagtactaaagatgaggcccggcacggtggctcatagcccgtaatcccatgcactattgagagcgtaaggtagggaggatcgcttagagccca

SEQ ID NO: 516676 - DNA, 265 bp, Homo sapiens
  misc_feature (230)..(230): n is a, c, g, or t
cctcgaattacttgagctcaagcaatcagccggtcttggcctcccagagtgctaggactacaggcatgagccaccatgcccggccaggaacttgttatctggcaaggaaacatttcagtattggtattgaaaaaaaaaaagtgttaagctgaacttttatttctctaaaaggtcctactcatgggtccatttctggcacttaaacggaaatacaacttggagtcttctcntctcctacaaaatatgggcaaccaaggggggaggg

SEQ ID NO: 516677 - DNA, 129 bp, Homo sapiens
ccgcctctctcttctctaacaacacacacaccctttacttcattcgcgcgctcacagtggatcagccggcgtgtggtcagtgagtgtcacagggtggatgagtggaagttgtgtggtggtgagatggtt

SEQ ID NO: 516678 - DNA, 237 bp, Homo sapiens
  misc_feature (25)..(25): n is a, c, g, or t
  misc_feature (32)..(32): n is a, c, g, or t
  misc_feature (74)..(74): n is a, c, g, or t
  misc_feature (91)..(92): n is a, c, g, or t
  misc_feature (105)..(105): n is a, c, g, or t
  misc_feature (111)..(112): n is a, c, g, or t
  misc_feature (135)..(135): n is a, c, g, or t
  misc_feature (149)..(149): n is a, c, g, or t
  misc_feature (162)..(162): n is a, c, g, or t
  misc_feature (171)..(171): n is a, c, g, or t
  misc_feature (192)..(193): n is a, c, g, or t
  misc_feature (201)..(201): n is a, c, g, or t
  misc_feature (205)..(205): n is a, c, g, or t
  misc_feature (229)..(229): n is a, c, g, or t
  misc_feature (232)..(232): n is a, c, g, or t
cagaccgtttctacctgggccagtngcgggancggcctcggcaagctcttcagcttcggtggcctgggaatatngacgctgatagacgtcnnctcatttgagttngctatnnttggaccagcagatggctctttntacatttagctgtngtgtgtgcttcanaaaggagcngggcttagaaaaagccctttnntccgtagngttnatgtggtgtgagtaatatatttcnatngtttt

SEQ ID NO: 516679 - DNA, 312 bp, Homo sapiens
cacagtgttggtttctggcctctgaaccttcctcaataggaactcacattttactctttacccacaccatacattagtacccaagaggaatgttctggcttcttctctagccttctgagagtttatcagagaggataattataatcatccacaatacatctctcaatgtcactctaagtcatgggtctgattcaacatggcaattctgaccttctttagagaagcaagtttgggttaagtatcactcattaccctaaataccatattccttgcaggtaacctgaaaccaactctaaatgcaaggtcatctct

SEQ ID NO: 516680 - DNA, 1368 bp, Homo sapiens
gtgcagatggagtacccggttccagtcgtcgcgcctcagtgtaccgcacgactgtcgccggcgccgccagccacctgctcagttgcgatgagagccgccgatgcttggtcggcgatcatgtcagcatgtggctcgatgcggtagctaggcgacatggacggaggagcgactgatagcatgaagcaaggaagagataggtgtgcgatgttgacaggctgtggagtcgggtgcagtggcgatgtgcggcgaggtgcagcacgagcaaaggcgaggcgcagtgggaaggtccgttgccgatgcgacgtagacccggcgttcatcaccatcgagacaattcatgagagtccatatcgcccgtgatgtgaagaagacacacggagaggcctggttccaaaacaaatcgaaggcctcgttgtactagctcccatgtctgagtctatgtcatacacacggtgttgcatgtcaactcatgtcctgtacggtccagtcagtcaaattcagttcgatctagaagtaaacgcacagtgaatagctcaagatgagctagtaacacactgtgcaaggcaatcgcatcatgtgactcttaagactaaaaaattgccttgtactccatagcgctcatttgcagactcagtctattatagcttgtcggatatacagcttttgtgtgcctacgcgacatgcctttcgttgcgcacttagtaacggagtcatcgaggtagatctcgtatagatcgataagaagaaacattggtagaccctcttcccaactgacattgaaacaaccaggaggtagtagcactgccagtcaacgcagctagagttaccagcgatttcccatcaataaaataccttcttaaggaagttcgaacaacatttgaatcagggatttcacacgacgccaccacagtcgagtttccaaccgaatacagttctgggaacgataccaaggccacggacaagcaccacagtgtcgcctcagacgtagaaccgtagcaaacgcactagttacaccttccaaaatcaacagtcccgaacacacaatttagtaccactccttaacaaattaaagacattgagcggccacatgtcttattcacatcatatcagacaagcaaccacacaaagtatacaaaacacacatagaactcgcctaccttaccaacaaccagaccccgccattaacatgttaactaagaccacaccatcaccacaaatcacacaccctatgcaaccacacaccagaacacgaactatatgcaacatgtacaaatttcaaatatcatacaacaacgaccagacttacacaacaaacacatcacacttggacacacaaattcaccacacaacaacacgcatcgaaacaaa

SEQ ID NO: 516681 - DNA, 184 bp, Homo sapiens
  misc_feature (51)..(51): n is a, c, g, or t
  misc_feature (135)..(135): n is a, c, g, or t
  misc_feature (171)..(171): n is a, c, g, or t
ggatatattggacattgggtcagctttaccttactctctaattttcatganaactccattcagtaattactattacccacttgaagctgggcacggttactcacgcctataatcccagcactttgggaggccgangcgggcggatcacctgaggtttggaggtcatggagnccccgtctttact

SEQ ID NO: 516682 - DNA, 442 bp, Homo sapiens
caacagcaacaaatatgcgttgtgatgatcatctcatttaatctttacttaggcaggtgtgatggttaatactgtcaactttattagattgaaggttacaaagtattgatcctgggtgtgtctgtgagggtgttgccaaaggaggttaacattggactcagtgggctggggaaaggcagacccacccttaatctgagtggacaccatctaatcagctgccagcgaaaataaagcaggcagaaaaatgaaaaagatagactggcctagcctcccagcctacatctttgtcccatgctggatgcttcctgcccttgaaaattgaactccaggttcttcagttttgggacttggactggctctccttcctcctcagcctgcagacatcctattgtgggaccttgtgtttgtgtaagttcatacttaataaactctccatatatta

SEQ ID NO: 516683 - DNA, 992 bp, Homo sapiens
gcggcttgcccgtcggtcgctagctcgctcggtgcgcgtcgatcccgtctccatggtcgctcttcgtgacggctgctggcctctcggccctggctctggccctgtggccccgaccgcgaacctggcgggtcccgccaagatcgccctaccagactggtgctagcagccacagtcagagctcgcgggtggccgtcactagtgagcagggcccccaacgtgtgatgcatgtgcaagcaaggttattggcatataattaggaagttacattcaccaagcatgcaagtcagatggctaccaaaggaagaatctgtggcaaatcaactggtcatcagtctactgagttgctgtcctgtgatatgaaaaggtccctggggagaagggctgtctcagcatgcctctacctactcttcataatacttttactggagtacgccctgggaagtcgcataggattccgatccaccacatcaggtatgtaacacggatcagtaacaggagaaactcatgacggcctgaagataggcagggggcccggtaagttatcaccatttattgtgctttactaagtgctggtctgggcctccctctgacaagctgaacagtgcattggattcccatggatcatagaagtgtcaagaactcggcagctggctcaagatagacctccggataccatatggtgggcaaggcgacgctctgactgattggagcctgaacaataccgggtatggactcctctatactctatgagacgagaagattccgaaactccagcatttaccatttatcctaatggcatgtaagtgttcatgctgcgtccagtggatgaatacggaggacatgtttcacgtgttggtgttcccctagatacgtgaaccagcgacgcgaaaacttcagttgcaatgaatgagaccctgagcccatggttattgtgctccgagcgtgatcttgagccgcgagttaaggccgcaggggttaaacttggtgacggt

SEQ ID NO: 516684 - DNA, 398 bp, Homo sapiens
gagaactaggctcgagtggatattctgagtctgaaactttaaacagatgtgtattacacaaaggtcgacgaatagttggatacttccctactttgggcactattattctcactctccacagagaggctgattagcttctcatctggtggcggtaagcactaccttactgaacttaacagaatactagtaacaatgccttagtgatttaagctgaatgctggacactggaacatggctcttgtacccagtatcaggaatgcacaaatgtgttccagttaacaatacaccttacattatctgtaggcatggacactgacagcagtgccatttcttttgtgacctgactccagtacctgatggatatagtgattatcagccacacttgttcttcttgtctt

SEQ ID NO: 516685 - DNA, 489 bp, Homo sapiens
  misc_feature (91)..(91): n is a, c, g, or t
tcctgaggatccccatccggcgaggcagtctcgaagaagctctgtctcattgccaatgtcttcgattatcaggcagattcctaggggcttncgcgttcatcttgtatctctcttcaggccgctctgaggcaaaaaagcttctgattcctgaatggatttcttcactggttcttgttgagcgccaagctgttccttaagtctttgttctttacttctcccattatggagcctgaagttatttgaaggatccttgagactcttttggattgctgcttggagaacattcctgtaacttgtccctgctccttgaacagactgcttgtacttctggatttttgccttcaggtctattctgtggatgttctttaggcatttttctaataaatccagttgatctggggcaaccagatttagtttctccaactcaaccacaaggtccaagaaactcttctccttgcttatcttgcctcggcccatgtaatccttcat

SEQ ID NO: 516686 - DNA, 1570 bp, Homo sapiens
  misc_feature (206)..(206): n is a, c, g, or t
  misc_feature (253)..(253): n is a, c, g, or t
  misc_feature (1093)..(1093): n is a, c, g, or t
ggctgcactggatgctgacagggcctttaggcgggcttgtgcgcactatcgcgtaaatgccatggaatcttagtaatgctcgaattctagctcatagaatggcacgacgttgcttgggatatcatgtattccgagacacaagccgcggagttgccgtaacgattctcggaattgaacgcttaggagtgcacggacaaggacgcaanggggcagacagctctgtatttccgagcacgcagacagcgctcgctgngatacttggttctccagtgccaagctctcctacggtaacgactaggaccacttgtagtgtcaggagtgacctatgcctgtcaaagggctgtctggcgggctcggcggacggccagtgttattccaagaccagtgggaaaagggaatgactttcacagggaagatgtgcacaggtgtctatgtctctatcaaaaggcatcagtggtttgggcccgcgggggaacccaccaggtccaggaggcgaattttttctaggcttgcggaaatcccctggagcgcagacacgggggccgggcgaaaaacctaatatttgtgtcgcgcgaccttgtgtaaggcagtttccccaccattgatcctaccggttgttcgcccaatagctgttggttttgcagaccggcgaagtcgcctcctttgtgaagactgagacacacgattaaccccacaaggttttcccccacaaaagtcgcttgcgacatgcgccattccttttatcccccggcttgcgaataagacgaaaaaatggccgttcctgtttcttgcggcagccccacaacggcggagaaggcggacaaaggcgtggaagcaccacgcacccggcattcggttgggcctgttgcagagcacttggtggcaggccagtcccaccactgttttcacgccaacacgtttttggggcgccacacactccccaaacagttcggttatgacttacacctgtgggttacacctctgtgggtgttatccaacagtaacgccccccctgtaggaacacaccacggggaaaaacgacggggatccggtaatgtgaaggattcggcaacttcgggcgaagcgggaaaancacagcgcgttccggacaattcgatatcagggttcccaccccttttggaacgcggtggcaaacccgcaaagacaagaagggcacaaattctttgtcgcacatatagagtgtcccttcctttgttacgatgcggaacatgacgtgtttccctatgacaccgcagaggattggacatcttcggggaccccccctggttatgggccggcattgaacccgagaactgaccaacgttgccggcgagattccaaaattttgcgggcgacctaggttaaacacgggtgttgctgcccttagtcagtgacacaagcgcaaaaggcgccccacaaaaagcgtgtctcacataggtgttccccgcgcaaattgttggacacccacaagaggcggacctgtcgtgtttgggacaatacacacatccctgtttggtcttccacaatgaccacatttcaatacaacaattagtgcacggtgactggaacc

SEQ ID NO: 516687 - DNA, 1044 bp, Homo sapiens
caaaacaccaaatggcggatgacgccgtgtgcagcagggggggccctggggtgccctgtgtgtgccctggtgatgggtgaacctgcggtgtgcttcctgctggaggtttctggcatctggcatcctgtgtggcctgggtgtcgctggccgtgtgactggtggccgtgggccgatgtgcctgctggatgctctgctgtgatgtgcaatggcccgcagtgactaagtgcagtgtcgatgctcctgatcacccaatgcttggagcctgctttgtgtccacaggaacattgcaagaatcacagtaccactaggcaggacgaatctactctactatctacccgtgtccgcatataacggacatcgagatgcatcgatctgacttctctatcactggagggaccatctcatacaaggcatgacggtccttgcaagaattaatgaccagctgccagacagcatgactcctgtgccaggccaagctgcaccaaggattcaaatggcactattgttcgcctactacagagtggacctaacaaacatggccactgtcgaggctcttggcgtgctacaaaccgtgctaccaatggacgcgtgagtcaccagacattccgttggtgagccacatcatcctggccacacgctcatccatctgtcccccagtgcagcacaacggctactaggggcgaacaatactcggcaattccccaacactagtccctttgcacacgtgacatggcccgctgctggcatcatgtgctggtacgccctcatccctgcaccccacggggcactggcatcgaactccgcaacctgtgcctaacaagctgctacaatgatggctgctatcgattgaattggcttaatctcaagccggggaccgacctgccacccttgggcacacatatggccaaagggcaacgtttgcattccatatataaagaactaaccagatacctgaacccggacctcttggaacggaaccatgtaatccacaaggtctccttctataggttcatgacacctataaagtcctaatctagtacaaga

SEQ ID NO: 516688 - DNA, 1284 bp, Homo sapiens
tgctcaggcgagcttagtagcgtgcagctactcgagctatctcatgggatccagacttgaggctgaaggatgctaggcaagatcccagagatcacggtcagcacgtcagtggtctccttgcgaagagaagctgccccgtaggggataccgtgaaagggcttggatacctcgggaattagaggctctcggcagatggaggctgcttttccagagatccatgtgggccagtatctactggcatgtgggacggaaagagaaaagatgtcgcaatgcgctggccgatgcagggtggagtgctagaaggagcaaagttaaatattgattgcaatgggctcggacatatggtgcaagtcaggagatgagcaatggttcttgttatatgcaaactagcgctggaggctgggtgtccagaagggaagggttactggaacttgcaagactgaaatccaagaaccctgcaaaggggcgccgatttgaccgaacgcctacttagcacgatgtataagcacgtaacagaagaccaacgaaggtacgcgcttaggagccgtaactcgtggttatcaccaaggacagtgatcagcacggacgaggcccaagtgagcagaggttgcagaagaccaggctgtgtacgcaaatgtggggccttccatggctttcccggttaattatcccaggaataatatcgagccgaatcatcaactgccaagggcaggcttggtccgtttcccacacgttcctgtgtgacggcctttgaaactcgatgacgcaggcggtataattcccagcgcaatggtggtactagaaacattgtgcacagcacaccagggatttcgccgacaatgggcgcgaagggcgcataccacaacagggcgttccgcagcggactttttagacctcaacgacaaacaattttcccctcccggggggggaacccccaaccaattatatagtagccgtgtgcgtatagcggagcccttggtctgacctggccagatttgaccctccccgttaaggtcccgaaagacagggaaagcgatcgtgggggaacacacggaggacgacaccacaaggaaacgactagggcgcaaggaaatccccagtgccgctgggagtagatgcgtaagccctcggtcgacacgacatggcgcgaagaggggcgcggtcgaacacgaacaggagcccgctaagaacacaaaacgggctacaggagctaccatcgtgcgtagggcgaagaaggacacgaacactcgacacgagcagcaccacttagagcagagaaacaac

SEQ ID NO: 516689 - DNA, 1232 bp, Homo sapiens
gagttcctccttgctctcgcccctactctttctggtgttagatcgagcaaccctctaaaagcagtttagagtggtaacaaaaaacaaaaaacacaccaaacggctcgcagccacaaaggggatgaaatttcttctgggacattcctcctgggttctcccgttactggatcgtctggcgtccctagagtccttcgtgaagctttttattcctaagaggagaacaactcagtcaccgggcgaaatcgtggctggattacaggagctgggcgcacgggcaactggggagactggactggcctatgaattggcgtaaactctaaaacgcaagctgggtcctctggggatataaatacacgcatggcgactgtggaggaacacagtctggccaaaatcgcacagggcactggcggtggcccaagggtctcaatacctttagggcgggaacacactggcaagacacaccggagaagcatcatctcacacgctcctggccaccacgaacgcgtcgaactgcgccgaaacttgggcgacgaccttgctcaacggccacgtcttcataccgtaccacaactacactgggctcggctggaataaagctccataagttagcactaccagagacttcggggctactggcatacacaccgacacggatctccctctcaggcattgtggacccacacgaaccttttgtgcaaacagctacaacagggtaccctgtgccaccatcttctcccggaggacttaccaccaacggagcacttcttccttcaccctgtgacacaatggaccgcgacctgcacattacacgccattggggccccaattaattggtgtcccccaagtggctggcggcatttcctccggctcacgcctggagcaccaatttgtctcatgaggagtaccccgccttatctcttcaacttcgtcgaattcaaccacgggtgttacaccagacacagaggatcttcgcgacaggccagataggggatcatcacaccaagccaacctcatcgcgccgcaggccatcaaaaccccggcgagcgtgccccttacccaacacaacacgtcgcgacaggtcagacaagacaaccaaacaaccaggggacgggcggaccctcaattctcgtacggctcacacacccccggggggcttcacaactcaccaccaatcaccccagcatcaaacacgggtctgtgtcaacaccccacccacctgggaggcaacaccc

SEQ ID NO: 516690 - DNA, 157 bp, Homo sapiens
  misc_feature (40)..(40): n is a, c, g, or t
  misc_feature (43)..(44): n is a, c, g, or t
gtctgacgcacgctgggaccggcggactctactgaccttnacnnttggggacggttcactgacacggcacgcgtggactgttggcacgaccctgactacggtctacacacccttgtcatgtcccggacactgccggcaacgggacgacgtaccaacg

SEQ ID NO: 516691 - DNA, 295 bp, Homo sapiens
agggaaaaactttcttgcttgctgagacaaactttgtttttttgggagagaacagaccataatgtgggcagagtcttaggtcctagctattggcagagcctggtttctagggggtctgctgtcccgggccaggtaatctgagggctgacctgtttcttcctaaccatcagaaccaaacccagtttgacctacccacaaccattttgacacgtcttgacaaggtatggtcttgggcttggcctgttgtgtgcaaagctcatcgatgtttacaagatgaagaactgattccactact

SEQ ID NO: 516692 - DNA, 102 bp, Homo sapiens
tagctcttcacaaccccgtgcctactggaggtgcagcggccttcgctgcgtcactgaccgcctggcatccagtatgggcaactacaaaagtagaggcagctg

SEQ ID NO: 516693 - DNA, 263 bp, Homo sapiens
gatctagaggatcccgtgcgggtctcttccggacaaggtatataataatcacatcaaatataccttcagcttggaaaaacacagggtgaaaaaataaaataagacaaagtaaaagtacaaagcaaggaaaaggtaaaactctagaaaattttggaaaaatgaatataggccagccacgggggcgcacaccggtaatctcagcacttggggaggcggaggtgggcagatggctggaggtcaggaagagaccgggggtaccgagc

SEQ ID NO: 516694 - DNA, 420 bp, Homo sapiens
ctagaggatccctacccaccgactgtatctgtgcccagatcttcctggggctgctccttcttgtcattcaaagctcagctcacctcagagaagaaatcttccttcactcaaattaaagtaaagccacttactttgagatggggtctgggcatcttaatttctttttaagctcctcagatgagtctgacatatagtgatgctttgaatcactagctaagtgaatcttcctttggcttatatagcttttctgccaatttacttcttgctacttcttactgacagcgggctgaaaaaatggaaaatcaacattgtgggaggtggtgagaaagaaatggcaatcactagggacttgtactaaatcactgccaaaggggccgggtgcggtggctcactcctgtaatcccagcacttggggaggcc

SEQ ID NO: 516695 - DNA, 547 bp, Homo sapiens
  misc_feature (73)..(73): n is a, c, g, or t
  misc_feature (82)..(82): n is a, c, g, or t
  misc_feature (121)..(121): n is a, c, g, or t
  misc_feature (157)..(157): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (208)..(208): n is a, c, g, or t
  misc_feature (210)..(210): n is a, c, g, or t
  misc_feature (542)..(542): n is a, c, g, or t
cccttggaaccccaaaccccggaaaaatggaaaggcctttaatccaggggccaaaattggggccccccttggnaatggcccncccatagcccgggaaaatccattccaaaaaagggtatgngcaatggaccccaaatttaagagcaggtacagtggnctcacccctggttaaaaaaaatcgaagagccaaaaaatccnctantttntntnaattggaatgtattccaggtcccttcaggattaattaaataaacatgcaatttatgaaaacatataaacaattattatcactttatgaccaaatcacaataaaattgtcatttaggataaactggggagaatagactgaacatatggttatattcacagttatttattaacttaaatgttattccaacattagagctaatgttaaaagattaaactgtaacgtctaatatttggaataatatattaaagtattagcactgtggttgattttcttgaattatgttgcatcttgtactactaagcttgtgaaaataaacatttggatgttttanaaggt

SEQ ID NO: 516696 - DNA, 107 bp, Homo sapiens
caggagtattactacaactcgatgatgagtatcagctatattggagagggggtgatctaaaacactctttacgccggtttcatattgggcccttatccggaggggac

SEQ ID NO: 516697 - DNA, 108 bp, Homo sapiens
aagagttagagtcgtataggctatgttccctgagcctaagcttacccacgatgaaagagtggaaaaatagaagtacctaggtgtatgcatcacacaacatggcaccaa

SEQ ID NO: 516698 - DNA, 321 bp, Homo sapiens
atcatgcagggattcatcagggctttcaggcccctgcccaggcacctatgggacttgctggacttgaaacaaatggaaaaaccgggccgtttttagctcacctccgcctccaggaagaccaaactcccacccttccccacctccagagcagtggggcttcctcctgccctttcaaaaaataaccccagctcaaaaaacgattacgtggtcatttgtgtcgccatccccttcctgctgcacacctgcaccccggccatggggaggctgctccctgggggcaaagtttttggcaaaggttattaataaacccttggagcatga

SEQ ID NO: 516699 - DNA, 153 bp, Homo sapiens
tatcactgaaggaggagcagtgcgcagtgaaattggcaggtagtgcaagtcctggctgggtcctgccatttactgcagtgtggctttatctaagtagcaacagtgtctgtgtagcccgagctgctgagggaggcatcaccattgcaatcactt

SEQ ID NO: 516700 - DNA, 276 bp, Homo sapiens
ctgcgagtcagccatggtcgccatgtgcaaagctgatgggagggagcccacagtagctggtccaactggaagacggccttgtgcatattcatcgtcgatggagtgctgctcctgcttagaggggcagtcagggccctggcccaaatgtggctacctccagcccaaatagggaacggtttccccggtgcagaggctcccaatcagggccatcatctagcttgacagtgtgtctagctgtgtgcaaggaggcgagcggggttgggcttggtctggctg

SEQ ID NO: 516701 - DNA, 961 bp, Homo sapiens
tgcccctcgtttacattaaatgttatactagcattgaccatctcacttctaggaatgctagtatatcgctcagacctcatatcctccctatatgcctagtaaggaataatactatcgctgtcacatgtatacgtgactctcattgaacccttagatacccatgccttcttagggccaaatatgtgggccttcttgacgatactaggtctgggcactgcctgggacaggcatgaggtggtggcctagcccgtcatatgtctcaagtctccaagtagcagtattggcctgaggatttagcgtgacattggggtcgtaagatcataggccgaatcgctagaactgacctcggtcgcatcattatatatggagctaccgactgagcatggaacttttccataaaaaatgagtataagtggggaatgcagagcaccaagcgagcggagagccgtagtttgttagacatcatccctcctgatctatgtaattgagcccctgtgcaccaagaaatctgatttgagatgttgcacggaacctgttttcctgagggacccctattaagaagcggcccctatgtaatactaaggtaaacgtgatatcctgacgccgtctaagatcattggtgtgcccctgtgcaagggttcatcctgttggaccactattgtcgaaaagagaatgagaggtggtttatattgagttgtccctaagagatctcgttgaagtgatatatttcagatgggtgggaactaatgttagttgtaatatttgttgtgggaggccaaaattgttaccggacttaggggagcaataacgcagggagggagcaggccatgaagaatgaaaggaagggaatggtgcgaagtacacaaaggggggccttgcggataatagaaggtatgattacagagggctggcataagattttactttgggggtaaagagaaaaagagggggggggttggag

SEQ ID NO: 516702 - DNA, 138 bp, Homo sapiens
aaagacaaagcaagttctttcatcagtttacttaaacaggaagggttagccacaagtcacaactttcatgcaggcttttcctgaatttatttgaccagtgtccaaacttgaggtgacatcctttctggaaatctattt

SEQ ID NO: 516703 - DNA, 758 bp, Homo sapiens
gctcctggacgcgactgggtcctggacaacccgcctctccctggctcgaatgccccctccactcccgaccgggtggattactccctggctggggcactcaatgctggctacaaggagacccgggccagtgagcgggacagagatgatggagactcaatgaccggattgacagctacatcgagaaggttacgcttcactggaacagcaaaacaatggcgctggctgcgtgagactgaaccagctgcgggccaaggagacccaccaagactggcagacgtcataccaggcatgagctgcgagagacagcggctgcaggctcgatcaacgtcaccgacaacagacgcccggaatggaggttgagagggacaaatctggcaacaggacactggacaactgatgaggcaagaacgcctcccacggatgaagaccaaaccatgagcgctggaaacgccagagaacaaaccaatggcatgccataatacgaccaggacacgccagactgaaagccacacctggacaccaggtcatggactctggacgaggacaggactaggcagaacgggcagagaagggaagggcaggaactcacaggatacgtaggacagggaaaggaatccaaaagaaagagacgggaccggaaacgagagaaacaacccaggcagacagcgcatggacaccggaccagacaaggtacccagcggtggcaagctaggacggtggaccaaggaccagaagcatacaaacgaaagacccggaaa

SEQ ID NO: 516704 - DNA, 172 bp, Homo sapiens
acggatcctgttggcgatcactgtactgttcggtcgatcattgtactgcagtgatgaagctgagatacaaattcaaataatgtatctccaaagtccatgctctttttttttcctttttttggagacagagtctcgctctgtcgcccaggcgggagtacagtgatcgaccaag

SEQ ID NO: 516705 - DNA, 1065 bp, Homo sapiens
  misc_feature (213)..(213): n is a, c, g, or t
tcccggctggaccctgtggggggtgtaaaaaaaaaaaaaaagggaggtccctggctggtgccaaaaacctttaaaaaaaagcagagggattttcgcagacgctgaaagatcaacgcgcctgaaaaaagaatgtttggcccaaaagatgcttcgaagggcaaggaggaagctttatctatggaaaaagcaaagcatctatcacagggatattanagggcagtattgtaacagacatctggaatattcgatatggggcgaggtatggcgcaaagaaacagcttggcgcaatcttcttattgtccctggcaaacaccccaatattggcgctgttgtggtctactcaaatatcgagagtgttactcatgggatgtgagagcggcccaaggtgttccagaacagggtgtgtgttggcagtctttctttcggctcttgcgtacaaatattcttccatagtggagaccctctttggtgaggaagtctcacaacaagggtctctcgtataaacctatggtctgagaggtattggtaagagcctattatttttggctatgggggtgtaccccacatattctgagaatgtcccagtaatatgagaactctatattctaccaaaggctgtggtgtttatggcgcaaatatccatataaagaacgcagatattgggcttgtagaccaggtataaccgcttttgagattggctccagatctcctggggtaaaatacgggaattcaatccgtgctgtggggaggaattggaatctcagtgagcactctattccgtgctgggaaaacagggctttcaaagagagagggcaaaataatctcccgtggttggccccttctcaaaatggttctttcctcccaccgaagcgttggaactgtgacacgaaaaaaagacccaccccatttttgtgttaaaactgtttggacgattgcgtgggacaaccgtggggagggcaccccggaatttcacgcgggctttattcacgacacactttgacctaaggggtgttctcccggtgaattattttcctaagagtgttggttaatcacacgccctggtct

SEQ ID NO: 516706 - DNA, 730 bp, Homo sapiens
gaaagaggaaaggtcgttcaagaaacccctgcctctctgcccggcacgttgtacagcgtagacgagggtttggctgcgaggtagtcagccgtccagtccccgaagcccttgggccttcagaatggcagagcaggcgtggacaggccccagggagcagagccccgccgtggaggccatgtcacacgcccagtcagaatgactctcggacttcgcaagcgagccagcctgtatttttgagcccagccctgccaggaccaaggctgagcccacctgtgggagttccggaagctgggcagtagccagggactactgcacccgcttttgccttgtttggcctcactgtattccacccacccctcctggccctggaagcagatagggtgcctcctgccatcggggccaggtttgggtctcactccccggcccttattttggagggtccaaaggggaaatggggtggggaacttcctttgggttaattcccagggccttcttggtggtggccctttttgcacccggaagggggctgttcaaatttttgcccctggccattccctgtcctgtttcctcagcctgcctcccagtggccatggggggtcggggtgaagggctgtcccagctacttgtcctttgcagggccctaagcccctggccccagcccccatgccctttgtgatgagtggggtttttcctgcctttgatgatgggctccataaacagccctgggcaa

SEQ ID NO: 516707 - DNA, 845 bp, Homo sapiens
  misc_feature (672)..(672): n is a, c, g, or t
  misc_feature (680)..(680): n is a, c, g, or t
agcggacaagctcatcttagacacagtaaacagcacatcaaatctagtacttcttcataacaaaaccgttcagcaaagcaggactagaaggtggtacctgtgacctgatgaagccccacagcaggaatcatacctgatggtaccggcctaaatgcttctacacgaagagaaggaacaagacaaggctgtctgctcgcaccgattttattcaacagtattggacgttctagctgggacaactaagcaagaaaattaaataaaacgcatccagactgaaaaaaaagaagtaaaactatagttgtagatgacacaatccttatagaaatcctaagaaatccaataaaaactattaaaataagcaagttcaacaaggttgcagtatacaagatcgatatgaaagaataattgtaggccaggcacagtggcttatgcctgtaatccttgcactttgggaggccaagatgggcagactgcctgagctcaggagtttgagaccagcctggccaacatggtgaaaccctgtctctactaaaatacaaaaacaaatcagctgggcatggtggcgcacgcctgtaatcccagctacgcgggaggctgaggcatgagaactgcttgaacctgggaggcggaggtcacagtgagccgagagggtgccatttgcaacttgccagncctggggncagacaaaggtgaaaacttcctgtctcccaaaaaaaatacaaaaaaaaaaagaaaggacaacaacaatcacgggggttcctcataaacggtgcgcaccatataaacgcggaacagttaaattggaaaacttccgaaaccggtggggggccaccccggtggcgcca

SEQ ID NO: 516708 - DNA, 610 bp, Homo sapiens
cgacattcaacgttgtaacgatgcatgtgacaggctctgattggtgatgggagcacccatgcttccttacagaatcctgatactatggcgaactgttacatgcagaattgatctaggctggtgcatgggtcacacctgtaatcccagcactttggggggcccaagcgggaggatcacttgaagccaggagttcgagaccagtcaaagcaacatagcaagaacttcgtctctagaaaataaaatacaataaattagccaggtatggtaatgtgcacctgtagtaccagtgctttgggaggccgaggtgggagaattgcttgagcccggaggttcagggctgcagcgagctgtgattgtgccactggtcagacagtgctgcttgtatttaggacagtgcttctgatcaagccagtgctgcttgtatttaggacagtgcttctcaaactttaatgtggacactaatctcctggggatcttggtaagttacaagattctgactctctaggtctaagctggggtggggtcccaggtgatacagatactggtggtccaagacacatgttgagtagctggatgtaggagaaaatggagaatctgatgttgacttggg

SEQ ID NO: 516709 - DNA, 181 bp, Homo sapiens
ctgttcttgcctaataagtttcttttaatccaatcccctaaccctttagttatattccctggttttacccagagaaatccaaaataaagatcccccatcaagcctatctccaaaaatttattatatatttccagaagaaaagcatgcatatcattaaacaaataaaatcctttttttccca

SEQ ID NO: 516710 - DNA, 493 bp, Homo sapiens
ccttttaagggggtgcccaagttgtcccattccccgaaaagtccccccttcttgtgtccccgccgagttcttcattccccaaattttcggccgaaccctgtacccccccgatattggggggaaaacctggggattgggttttcttaggctttttttgtttcattgagatggagtctagctctgtcgcccaggcttggaatgcagctggcgccatctcggctcacctgcaagcctccacctccccggttcacgccattctcctgcctcagactcctgaggagctggaactacaggtgcctgccacacacacccggctaattttttgtatttttaggtagagatggggtttcgctgtgttagccaggatggtctcgatctcctggacctctgtgatctaccttgcctcgggcctcccaaaagtgctgggattataaggcgtggagccaccaccctgccaagcacatggattttaatgagaagacttggtttgtag

SEQ ID NO: 516711 - DNA, 283 bp, Homo sapiens
gcagcgcctagaggtttgtcttcgtggatggcgcgtgtctgtcccgtctgtccctgctgtgtttccaagcacatctcagcccatgccaggcgccagcaccaacatgggaatcatgggtgaagctgatgcagcgttgccgagggggtgggttaggtcgggggtggggccgggcccccctacgggatgcccacggccgttcatcatcttgtccctcgtccccctaccacactcccacctcctagaccgccgccccttaacacagtaagacttggaatatatgcta

SEQ ID NO: 516712 - DNA, 769 bp, Homo sapiens
  misc_feature (16)..(16): n is a, c, g, or t
  misc_feature (66)..(66): n is a, c, g, or t
  misc_feature (87)..(87): n is a, c, g, or t
  misc_feature (92)..(92): n is a, c, g, or t
  misc_feature (109)..(109): n is a, c, g, or t
  misc_feature (121)..(121): n is a, c, g, or t
  misc_feature (137)..(137): n is a, c, g, or t
  misc_feature (143)..(143): n is a, c, g, or t
  misc_feature (153)..(153): n is a, c, g, or t
  misc_feature (178)..(178): n is a, c, g, or t
  misc_feature (227)..(227): n is a, c, g, or t
  misc_feature (250)..(250): n is a, c, g, or t
  misc_feature (259)..(260): n is a, c, g, or t
  misc_feature (286)..(287): n is a, c, g, or t
  misc_feature (301)..(301): n is a, c, g, or t
  misc_feature (320)..(320): n is a, c, g, or t
  misc_feature (334)..(334): n is a, c, g, or t
  misc_feature (344)..(344): n is a, c, g, or t
  misc_feature (346)..(346): n is a, c, g, or t
  misc_feature (350)..(350): n is a, c, g, or t
  misc_feature (353)..(353): n is a, c, g, or t
  misc_feature (366)..(367): n is a, c, g, or t
  misc_feature (374)..(374): n is a, c, g, or t
  misc_feature (384)..(384): n is a, c, g, or t
  misc_feature (390)..(390): n is a, c, g, or t
  misc_feature (518)..(518): n is a, c, g, or t
  misc_feature (533)..(533): n is a, c, g, or t
  misc_feature (578)..(578): n is a, c, g, or t
  misc_feature (653)..(653): n is a, c, g, or t
  misc_feature (670)..(670): n is a, c, g, or t
  misc_feature (768)..(768): n is a, c, g, or t
ctcagtaaggggacanagtctacagcagcctcggcctcataagcctaagggagcgatctgggagangtttcccctttcaagaaaatnttgtntccttcctgtaacccanccctggcctggnaatctgtgcaggaccncccgtnattatctctnccctccagggcctggcccgtcaaancaggcaccagcacaccctccctgggccgttgccactctgtgtctttggntcagcccagcctggttgtacggntatttcatnnatggaagccagaggagaagagggtgnntgctgaggtccccncaaatctgcccccagagcnttttcaattggacncgctaatccngntgangancctgatgacttgnnatagctnatatcaccangtctcnaagtccttgttagatacaagagcaaaataaattatttttgcctaatcctttttccttctaaaaatggttgccttcgtctgtaccgtcccctccttttctctacataaagttgtccttgttgttctccnaacaactgttcatgnaggaaaccccacctgggcagcggtcaggtgcggaggcagcctctnatcggtggggaacattcacagtaactgctggcaggctgctgggcgccctccaggagagggggtgctgggccgtgncgggctggcaggagttntgtcggccttcgggaaatgctgggctgctaagggtttggtccacccatcccgggagtgcccggtcctcgacgtccatctgttccctagcccatggcgnt

SEQ ID NO: 516713 - DNA, 908 bp, Homo sapiens
caatgtagaatctactatgaagcaacactatcgtgtcttagaaaaagttgtgcatatgtaattgatcatcaagattcgtagaaatgaggcccggtgtacagggggcttaacggcacagttcgcctttaatacgacagaagatgtgagcaccgggtgtcccgtagagtataacgtagaggtataaactcaggacgttaccaagtggttgacggtagtaaacccctgtctattggcacctggagaggggcaggtccaaatgaccaataagggctagaaaactttacaacattgttgttccttaagagacgtgagaattatacctgaaaataattttaaagccacaaaataatgcatggcctatattattgtcatatacatacacacaatatttttatcagaactatattattatagaaaagttttcttttaaaacgtcgtaccctatggggacactcaaatctgtcctataaaccatacgttggcgcactacgacaacaaaacgatatactacttatatttaaccaagtaatactttcgggtactcgtttggggcccactctaacgtccctaaaacattatgcgcgtcggggtataacacaacattttacctattatttcaatttgccttaggaccgtataattcttacactcattgttgaagtggaaaacattgggggacatgggtgctcaattgaaggacggaaaccatcttaggggacaacttcacgacacttaataacggtaacacagttgtggcgcattattctccctccttttctctaccaacagggttctcaacatggttcctggagggtattagtcggtcatccgaggtggtaactgttggtcctggtcactcagggttggatttggatcttggccttaccttcaattcgctttataacaag

SEQ ID NO: 516714 - DNA, 115 bp, Homo sapiens
cacccgatgtacctggtccaggccgatgatgcggtccacatccttccacagctccgagacaaacttgtcagaggactggtggagcagtgtggcgatgttgtcattcggacctagt

SEQ ID NO: 516715 - DNA, 418 bp, Homo sapiens
  misc_feature (415)..(415): n is a, c, g, or t
acagaatctcactctgttgctcaggctggagtgctatggcgcgatctcggctcactgcaacctccgtctcccaggtccaagcaattctcgtgcctcagcctcccaagtagctggaattacaggcatgtaccaccacacctggctaattttttgtatttccagtagagatggagtttcaccatgttggccaggctggtctcaaactcctgacctcaagtgatcctcccacctcagcctcccaaagtgctgggattacaggtgtgagccaccgcacccaacctcccatcatttcttttttgttgttgtcgctgttgtttttgagacagggtctcactccattgcccaggctggagcacaatgacatgattatggctcactacagcctctacctcctgggctctggcgactccgtcangcc

SEQ ID NO: 516716 - DNA, 419 bp, Homo sapiens
  misc_feature (3)..(3): n is a, c, g, or t
  misc_feature (81)..(81): n is a, c, g, or t
  misc_feature (96)..(96): n is a, c, g, or t
  misc_feature (117)..(117): n is a, c, g, or t
  misc_feature (137)..(137): n is a, c, g, or t
  misc_feature (183)..(183): n is a, c, g, or t
  misc_feature (193)..(193): n is a, c, g, or t
  misc_feature (207)..(207): n is a, c, g, or t
  misc_feature (224)..(224): n is a, c, g, or t
  misc_feature (239)..(239): n is a, c, g, or t
  misc_feature (257)..(257): n is a, c, g, or t
  misc_feature (402)..(402): n is a, c, g, or t
ggnaaagcatccacaatggctctggcagcatcaggatcacacttgcgggggctctgagacaaagttgttttcatgcaactnagtcctttcccattngttttcttagtgactaatgcnttccaatggtcatgagtccnttcaataatatcaatggcaaagtccttatctttaaattctgcattnaacgcaaacncatttcctggtttnccatcagggaccttatnccttctaaaccagtncacagttgcttctgagtngcgaggtgtcagcgcgtgtgacagcattaaaataattataattggctgcatcaggatcatccacattaatggcaattactttccagtgggtttccccttcgtcaattatagccaatatgcctagaactttcacgccaattatttnacctcttgcacatacct

SEQ ID NO: 516717 - DNA, 498 bp, Homo sapiens
ggtggagatttgagtgaataacattgctgaagggctgcggacctggggcagttcccctgggaactggtttagggatggaagctaggaaggcagtggggccaaaaggcaacatattatatacgcaggcaaggggcgtggctggcaagcaaaatgtccctgggcattgcagtttttccctataagcgcgacaatcattctagcaggctggcatggcgcaggggcctaaaggtctatccaactatatacgcacattgagatagcctagatcattacgaaacacaaccttgaagacaatacctacacagaagacctacgatagccagtcttgcatggatagcatacctacactaacatgatatgcccaatacacagtgaccacaagacgaaacttagttagtctacacagagaccgaatagtacaccttaccccttggaccagaaccaccctagagagggacttagagaagacctaaggaaccaagaggcgcacatgtatcc

SEQ ID NO: 516718 - DNA, 236 bp, Homo sapiens
  misc_feature (9)..(9): n is a, c, g, or t
  misc_feature (25)..(25): n is a, c, g, or t
  misc_feature (57)..(57): n is a, c, g, or t
  misc_feature (81)..(81): n is a, c, g, or t
  misc_feature (140)..(140): n is a, c, g, or t
aaagtaagnacttttaagccttggnggaatattaaatttttcctcaaataaatgggnttttttcttggacttggttcaagnaaccaaaattaaaaggttttccaccgggcaaaattttggttttcatgcccgaaattgcncaatttgctggcttcaccgttctgaatcctttaataggttctctgcgtgcagttgtaggttcttgcatccatcataataagccagtgacatgttct

SEQ ID NO: 516719 - DNA, 421 bp, Homo sapiens
ccgcagctgcggcttggcactggcactcaatgtacctgtctttgtggtagtcaccaagattgacatgtgtcctgccaacatcctgcaactaaaccctgtaagctgttacagcgcctgctataagtcaccagtgctgccggttagatcccctgtgctggtgcatagcaaagtatgactgtgcttgtcacagacctccaatcttcagcctctgataacggatgtgcccgaatattccagaatctccaactgttacaggtcgagaacctcagatctgctgcacagatgttcctcgaacctcctctccccccgcaccagctacagggaggaggagcctgctgagttccagattgatgacacctactccgtcccgggtgtggggacagtggtttcggggacaacactgagaggcctgatcaagctg

SEQ ID NO: 516720 - DNA, 535 bp, Homo sapiens
  misc_feature (76)..(76): n is a, c, g, or t
  misc_feature (151)..(151): n is a, c, g, or t
gacggaaagtttatggcatggctttccgtgtccccaacgccaaggtgtcatggtgcacctgacgtgccgtttaaanaaacttgccaaatatgatgacttcaagaaggtggtgaagcaggggtgggagggccccctcaagggcatcttgggntacattgagcaccaggtggtttcttttgattttaaaagggacacccattcctccccttttgaggttgggggtggcattgccctcaacgaccattttgtcaagttcattttttggtatgacaacgaatttggttacagcaacagggtggtggacctcatggcccacatggccttcaaggagtaaaacccctggccccccagcccccccaagaggcccaaaggaaaaaaaaagcccctccttgttggggggtccctgccacattcagtccccccccccattgattttcccctcctcccagtttccatgtagcccccttaaaaaggggaggggcctagggagccgcccctttttatgtcccatcaataaagtaccctgggttcaata

SEQ ID NO: 516721 - DNA, 349 bp, Homo sapiens
ggtggaacaggaaactggggaggtggactgggatgtatgtgtcactacgaaaatcaaagtctatgcttttctaacattcagtgtcatgaaacagaattcatatttacaaataggaatatgatcaaaaaacaatctaccatgagaaaaaaatacttctaagatactaaaaacactaagctaattattttcggtacaataaagaacagattcaataaagaaagagacaagctacagaaattagatgtcaagaaaaggtaatcttgggtgtcccattattactgtgcatttaacattttaattgcattgtaccatataagtttctatctcctgatttccaccttgccagggt

SEQ ID NO: 516722 - DNA, 253 bp, Homo sapiens
  misc_feature (39)..(39): n is a, c, g, or t
  misc_feature (67)..(67): n is a, c, g, or t
  misc_feature (111)..(111): n is a, c, g, or t
  misc_feature (116)..(116): n is a, c, g, or t
  misc_feature (126)..(126): n is a, c, g, or t
  misc_feature (239)..(239): n is a, c, g, or t
  misc_feature (245)..(245): n is a, c, g, or t
gctccgtttcttccaccggttgcccctttaagaaaaatncccccggagaggggcccgtgtggctgantaaagggtgcgtcgcccgcacaaaggcgccgcgttgttggcggnctccngacccttgtntcctgggcggggcggcgtgggaagaccggggcgcctgggcggggagaacgacgttggcgctagcggggcagggcagggggagggagtcactggcatttagcaacagcttctcngcgacnagagcgac

SEQ ID NO: 516723 - DNA, 1104 bp, Homo sapiens
agcggaggagtccagttggcttcacccagtgggatgccgcacggggttccgcatggtggagctgcactgccagtcccgacgccgtgcgcccgcacgttactcaggcccttgggcggtcgatgggactgggcgttagtggagacaagggagcggaagcatcgtctgaggaggcatcaggaccagcagcagaagctcacggcgggggcgggggctcaggcatggcgggctgtcacggtcccagagccctgcgcctgctggggaggcagcgtaaagagccgctgctggagaaatcgtagcacagcgagtcgtgcgtgacccctaggtgactaagactcaccatcaactggcgccgggcgcttgtccgggtcgcggaccaggctcagtgtcacataggtgtcgggggccagacgatgcaccgacgcgccacgcgccggggaacatcggacgacatgaggctctctgcacaaagccgcactggcgtgtgcccagtctcgctggttgtctcgcggcacctgacagcccatactacgcacatacacgatcaacgtctttctccccaaggatacatggcttgggacgagtgaatgtctcggaacgtacacgcgcacccttctgggacctcatgtggcacaacggaaaaggggagtgtcttcgcacaaactgaagaatcgacgatggcggggcgggtgcctggaacatgagggggcgtccccatcttaaaagtcgacagggaccccaccgtaggttgcgggacggtcaccaaagggggccccgaaggggtaaagtggcaggcggctggatccgagggcagcatgcccagggagggcggcaagttcgccaagaccaatgggcttgatacgagccggttttgttcaaggttaagtcctaagattttctcgagggggaaccttaagccagggtagggactagggttgaacgcggaagaacaggttctaggtcggggtgcagagcgataggttatctggataggagcgcagggacaccttggcgtttgaaaaagagttgagtgtttgaaacatccacgttcactttcttactatatgaacaactttaaatttcatttataacaaattgagtttaatc

SEQ ID NO: 516724 - DNA, 600 bp, Homo sapiens
gaagactccgcagaaggaagccaaaaagagtagcaagaagcggaaccggaagcacagtggtgacgacagctttgacgaggtgcagcgtgtcagagtctgatgtcggatgtcatgagagcgggccaggctgacggaggagaaaggatggaggccgacagaagcgctcaatggagacaggagaagcccaaggacgaagacatgggagaagcccaaggacgccgggggctggagtgaagccgcggcgtgctaagaactgtccctcttcatgcgcaacatcgcgcccaacatcacccgggccgagatcatctcccttgtggtaccaggcttatagcgggtggcgctctcagagccccaggacagagaggaggtgaaacgtcgtggagtgggtgagcttcgagctggattgttaacattttagagttctgtaggaagcatgtagaagaatatagagtacgggagtgtgagctgagcgctggtgtgaacatgggatatgaacaaggcgcgttcgaaacattaagagggatgtgccatgtgctgattgtgcgcattgataataagctggatgacaagctgtatcggacgagcatgtgttgggtcgtc

SEQ ID NO: 516725 - DNA, 160 bp, Homo sapiens
gggttatcccctcgggatgcaaggtcgctcctcttcatgtcgccgacgcttcctcaggtatccgagctaggtgacagccatccctcttcctgtcaccgacacgttccatcaggctatcataggcttcgaagcgcttgtccatccatcttccgtcacggcc

SEQ ID NO: 516726 - DNA, 115 bp, Homo sapiens
acctcactcgttacaggcctggtactgtggcgctccgtgaccacttcaccgttactccgacacgtccacctgaaccttctgacttcgcaaaacttcccttccacgcgtctggatg

SEQ ID NO: 516727 - DNA, 322 bp, Homo sapiens
tttggggggcccttaaaaaaggcaagggccgttcttctgctgggcggggccggagaggggcctggcccgtgttccccctttaattcccgggcgggcgcggggaagcaaccggccccccctttcggcctgaaagccccccctccaaaaaggtgtgcgggaaaaaaaaggccccggcctggggatttgggttttaaagggccttttatgcccgttaatgttccctgggtgggtagggggtggtttcccgtgttccagtgccgaaatttttggctttgctccccgttccctttttttagaaattaccgttcccttgggttttttt

SEQ ID NO: 516728 - DNA, 479 bp, Homo sapiens
  misc_feature (83)..(83): n is a, c, g, or t
tcgactctaaggacccgacgctctctctgtggggcgatcacgggtctgatgctctgcctgagtgctgctggggtggtgctccntgcgtggtgcggtgactgcccaattgacacaggccctttcaccacccaaccctgggatctgtggctgtggctagaactggagaaaagagcagagaaacttgtgcccaccaaggaccctcaacagcacctactgccactcagtgacctagggaactctggccacaatccctgcacccatccccactcccagcttggccactggccacggtcaccacaggagaatgtcagcggcacgcatggtcccccacagagagagctgtcgacgctcctctggggaaggcatcaatggactcagagagaataggccgggcatggtctagacacagtttcagggtgaggtgtgatcatatcacatacaaatcagtcaggacttgttgggtaatgaaagcctgggca

SEQ ID NO: 516729 - DNA, 127 bp, Homo sapiens
ctgggccctcacagaccgggactggctgctgctgacacccaggtacctggtcgcccacagtttgagctggacatcgagcccaaggtgtcaagccgccgagtagcacagaggccctgaatgacagcca

SEQ ID NO: 516730 - DNA, 195 bp, Homo sapiens
atgccaggaacacgtacttgactgaggccactagctgttctagacgcgcactactggtgacccaggtactggctgatcccactactggctgatccactactggctgacccactactggctgacccactactggctgacccactactggctgacccactactggctgacccactactggctgacccactactggca

SEQ ID NO: 516731 - DNA, 123 bp, Homo sapiens
ctagccatcggctctaccttgtctctcggctctaccttgtctctcggctctaccttgtctctcgtgctctaccttgtctgtggtttcgctggatagtaggtagggagacaaggtagagccgag

SEQ ID NO: 516732 - DNA, 468 bp, Homo sapiens
gcctgttgagggacggtgccacaaaaccccttcaggggaggaaaacctctctggttttccagaggccccagttccttcctgggatagtctggatctcactccttctgcctttggactacaagttcagatccagcctggtcttagccagagcctcctccctgcccttcatcaaatctgcaacctgtgtggccgggcgtggtcgtcacgcctgtaatcccagcactttggaaagccaaggcaggtggatcacctgaggtcaggagttcaagaccagcctggccaacatggtgaaaccctgtctctactaaaactacaaacattagccgggcgtggtggcgggcacctgtaattccagctacttgggaggctcaggcaggagaatcgcttgaacccgggaggcagaggttgcagtgagccaagattgcaccactgcactccagcctgggcaacaagagtgaaactccatct

SEQ ID NO: 516733 - DNA, 256 bp, Homo sapiens
agactccaagagctgccaccgctggggctgcactgcggccccccacgtgaagtcggttgcccgggccccgccacagccaccaaagtcacggtcacaaaactgggaagggggcgttggggcccaggttctggaaaagcaaggactcccctgcaaacaggcagtccttctcagctctggacttttggatcccggggtaaatatcctttggaactcgctcttgccttgaacacatccccatttgattaatccctggaaa

SEQ ID NO: 516734 - DNA, 104 bp, Homo sapiens
tggcccgttcccctaaaaatctgatatagtcatgtacttgtcaaacacctttctcaaatgagacacacttcgtgttccaaagatggtgataaacttttcttcat

SEQ ID NO: 516735 - DNA, 549 bp, Homo sapiens
  misc_feature (532)..(532): n is a, c, g, or t
ctgtgagcctagacaacagaaataaattcctagaaatgttgagttgagcaaatagttcaatgctatccctatcaatactaccaatgacattcttcacagaattagaaactactttataattcatatggaacctaataaagagcctagccaaggcaatcctaaacataaagaacaataggggaggcatcaagttaccaagacctcaaaccatactacagatctacagtaaccaaaacagcatggtattagtaaaaaaacagacacacagattaatggaacataacagagagtccagaaataatgctgtacacctacaatcatctgatcttggatcaaagctgacaaaaacaagcaatggggaaagaagtccccatttaataaatggtgctgggattactggctaaccatatgcagaagattgaaactgggcccccagcttactctgcatacaaaaatcaacttagaaagggattaaagacttaaatattaaacattaaactataaaaactctgaaaaataacctaagaaatancattctggacataagac

SEQ ID NO: 516736 - DNA, 608 bp, Homo sapiens
cacggtggcttatccccataatcctagcactttcggaggctgaggtgggcggattacccgaggttgggagttcaagaccagcctggccaacatggtaaaaccccctctgtactaaaaatacaaaaattagccaggtgcagtagcacacacctgtaatcccagctactctggaggctgaggcaggagaatcgcttgaacccgataggtggtggctgcggtgagccgagattgcgccactgcactccagcctgggctacagagcgagacttcgtctcaaaaaaaaaaaaaaaaatttaaagtattcggtaattttgaagagtagtgtaaatcacctttagttggtcgatattttcataaaaatataccttaattaaaatactcattaaactgacaatcataagtaaatttaacaatttcttcaatttgaaacaactgtgttttaaaaagtgggttgcgagaattaatccccgtggattgggaaagtagcgggggaattgggaacgaattctttagatcttgaagaccactaacagattttggtgagaccccacagtaagcagccattccgctccaccttctcagtctacatccttctccactctccgggc

SEQ ID NO: 516737 - DNA, 195 bp, Homo sapiens
ggatgtagtagttatgctaggatgaggatggatagtaatagggcaaggacgcatcctagtaggtaagggacggatcgtagaatgtgtagtcgaatataaaatatcattcgggcttgatgtggggagtggtgtgagtggggttggctatggtataatggtctggatcgccttggtatcgtatcgggtacctgagct

SEQ ID NO: 516738 - DNA, 419 bp, Homo sapiens
gtactgcttgcaagaacggtaacagtgagaaaattatgacagtgaaagaggtctgatctaaccaatccccatcttgcctttacctccaaaccgctcatgatcattcctgggcttgggtcaagctaactttcagagacatttagtttatactttaaaagatagcagtccttccccaaaactaaaccacctttgtaaagctaatgtaggtccattaggttacaaggattaaaaggagccttggccaggggcagtggctcacgcctgtaatcccaacactttgggagcctgagattggtggattgcctgagctcaagagttcaaaaccagcctgggcaacatgacgaaactcccgtctctactagaaatacaaaaaattagctaggcatggtggtgcgtgactgtaatcccagctactccag

SEQ ID NO: 516739 - DNA, 267 bp, Homo sapiens
atcccctagtgggtccctgcagtactgtttgcggttaggcgctacggccatcgtctattggttgaatagtagtgctgatgttatcgatataactagttatggggataaggggtgtagagttgccttgtggtaagaagtgcgctacggcatttttaatcttagagcgaaagcctattatcactgcgcccgctcataaggggatagccattgctaggtttatagatagtttggtcgttagtgtaaataagtgaggcagggacccactcg

SEQ ID NO: 516740 - DNA, 94 bp, Homo sapiens
  misc_feature (8)..(8): n is a, c, g, or t
  misc_feature (27)..(27): n is a, c, g, or t
aagcttcnactgtatatgatcttcatngttcagtttccgtcctaagctgttttataattttcttggctacctattatattattatgccactgca

SEQ ID NO: 516741 - DNA, 148 bp, Homo sapiens
cctgatcgacggttctcttctgatactcttctcatatgctatagtgtatttttttttttaaaacaccagaaatctttttaagtttaaaaaaaaggtgtagtgggcctggggcatactggggtccggcgctccttaaacccaaccaacc

SEQ ID NO: 516742 - DNA, 476 bp, Homo sapiens
tgttagacatcactgccacagaagcgacctaagaatcacctgcaagtatgtacacttcctaaatcccagctgtaccaattatatttcgcaagtaagttttacctagttcaaagatattgcctttcaacattgaagggatatcgatgcgtctacttcattaaaaattacgctgcacaggccaggcgcagtggctcacactctgtatcccagcactttgagaggccaaggcgggcagatcacctgaggtcaggagttcgagaccagcctggccaacatggcaaaaccccgtctctacaaaaagtacaaaaactaggtgggcgtggtggcacacgtctgtaatcccagctactcaggaggctgaggcatgagaatcacttgaacccgggaggcagaggttgcagtgagccaagattgcaacattgcactccagcctgggcaacaggagcaaaaccccgtctcaggaaaaaaaaaagggt

SEQ ID NO: 516743 - DNA, 174 bp, Homo sapiens
ataccgtcgacacgatcaaggttgtagctgccggcctatgtcacagccacagatacatcagatccaagctgagtcttcaacttacaccacagctcatggcaacaccggatccttaacccactgagcgagggcagggatcgagcctgcaacctcatggttcacggtaacaccaca

SEQ ID NO: 516744 - DNA, 418 bp, Homo sapiens
tgtgtcatgcacgcgtgtgtatgcacatcagcacaggcgccaggtctccatctgtcagtccacagtagcagtcaccatttaccactgcggggtttgcgccaactccagcctccatgaacctgcctccaacacgcagtcggcaacagaatagtttcccagcagcacaacagaactgtctttacgcaccatccttctcacgttcagccggcgtaataccaacccaccccaacatggcccacgtaaccttcattctcatagtaccgtccggacgtggttccttctcatccaactgccccatgcgcgcaatgaatgctaaattgacgaaacagtcacccggggagtccccaggcccgccctcgccttccacagttgcctacaaagcccattccagtctcggcgcaacagcgcattttcccct

SEQ ID NO: 516745 - DNA, 162 bp, Homo sapiens
tgacgcttcccttcctccgtcaccagaggagaccagactttctgttcagatctggctacagtgagcgtcaagttgtctgtgcaggcctttgattctgttctgagccttccaagtgtgtcatattgctagtattttccccatccacatagttcagcgtctgga

SEQ ID NO: 516746 - DNA, 480 bp, Homo sapiens
  misc_feature (210)..(211): n is a, c, g, or t
  misc_feature (224)..(224): n is a, c, g, or t
  misc_feature (242)..(242): n is a, c, g, or t
  misc_feature (270)..(270): n is a, c, g, or t
  misc_feature (449)..(450): n is a, c, g, or t
gctcaaactcaactgttatctagaaaaaaggactgtgtaaatatgtgtgagaggcaagtatactctgtttgccctcttgtaagagggataggggaggccactcagctgctagcactctgttctctcccctcatcctctccagaatgtattttagaacttgactcttctaatgactgaagaaaaggtggggtatgggaacgactggcctgnnggactagcagggntcacgttacagctacacncctggctaaacgagttgacgatctagangctggtagccctggcaagtggcaccgtgccagctcaacctaagtccgtaaacaatccagggtgtgggcccaggattgccctctgccttttgaaagcaccctacccctggttcctggctttctttaagaccgagacagggcagcgactaactttatgagatgggcaaagggcaagcctgnnacttcaccactccagattggaactggaaga

SEQ ID NO: 516747 - DNA, 265 bp, Homo sapiens
cacaattttacacacgtcttggtggtgcggctcagttacccctgtggctattggctgaggctgggccctgtgctgggggtgtggtagaaaggctgctgctgaggcgctcgcggcgtgggagtagctcagcgcggcgggctgttggctgtatggggagctggcagagcaggtggccgtcactgcgccacggagggacttgcctctcttctcattattgtgtccttatgctttagtgtcagtcctggacttgtagcaggcctgtgtg

SEQ ID NO: 516748 - DNA, 320 bp, Homo sapiens
ttcttatagatggtcctcagacattccatgccatgtctccccatgcgaggggttctactactttagtgtaaagatgcacaaggtgacccaagttggcatgaatctctgacaaaggaagagtcctaaacaggctcaggtggcgtctatagcctgtaagtcccagcaatttgggataggcgacgcggatagatcaccgtgtatgtcaagaatttgagaccagcctggccaacatggtgaaaccaagtatctactgaaaatgcaaaaatgtgctgggtgtggtggcgcacgcctgtaattccagctaccagggaggctgacgc

SEQ ID NO: 516749 - DNA, 137 bp, Homo sapiens
tatttctgaaggtgcccccacatgtactgattcatggacgggatcttgtcccattcgttcctcgtcgggttgtacacgtccacctcagcggagtcatccctgacaaagtacatgagtccgtttagagtcgcagcctt

SEQ ID NO: 516750 - DNA, 298 bp, Homo sapiens
ggtttttggagttttcccctttttttgggaaaccccaccattggtttggaatgattgtgggcatgaatttgggagattgtataaaccaaaactaccaaaatgtttttaaaactttttcccgtgtatgaggagggctaaaaaatgcaaagtccaatatttcccccacccttcaaatgtgggagcttggaccaatgttgaaaaataattttcctcaaagtgaaaatgttggttcaaaaaaatttcccccctccccctttgcatgtttgttgctttctaattaaaaaaactggttgtttta

SEQ ID NO: 516751 - DNA, 555 bp, Homo sapiens
ccccccaaaaacccccataaaaaaaaaccccccaggggggggaaggggggggggctaaagggaaaaaatttttggggggggggggtttaaagggggggggggggccctaaaaaaaaaatttttttttttttttggggggaaaaaaaaaaaaaaacccgggggggggggaaaaaaaaaaaaccccccggggggcgggggttggccctcgggggggggggaaggggggggaaaaaaaaaacccccccccctccgggggggggggggaaaaggggccaaaaaaaaaggggggggggggaaaaaaaaaaaacggggcgggggggaacccccaaagggggggggggggtttggccggaaaacaacccccccaaaaaaaaaatattcccccccccccccgggggggggggggggggcccggggggcccccacagggcattaaaaaaacccccccccccacccgggggggggggggcccccgtcccaggaagggcccgggaaaaataaaaccttggcctttgggggggggggaagaagccccggtttccgctcggggggggc

SEQ ID NO: 516752 - DNA, 667 bp, Homo sapiens
gacgacttcatttacctatgaggctgtcccgaagcattggacacacttcaggcctgtaaaaggatccccttggtgaagcccttgtccagtgaaccccacgagacccaggctgttacaggccctgacatcttttgccaaaactggtacccatggctgcccacgaggcctcgatcaactgtacagtgagagagaaggccagatgctgcgttccgggagatgatgtgccaacgattgaggacaagaatgaggtcctggaccagttcatggattctaatgcagttggatcccgagacggtggacaacttgatgcctacagtcacatcccaccccagcgtcatggagaagtgcgcggctctcgagcgttccaggcctggacactgtcaggaaccttgtacatgtccatgccaagttgcttgtcaggtgttgttcacggatgttgtgcatggcttccctgaacggacaatcagagatcttggtcggaagggacgcgcttgacgcttgactactacgcctcaaagctgtcacagaggctcgcggtcctccccgccgcgtgccatcatccatttatctacagacggtgatccggcaccaagtgatgcccgcactgtcgccccttactgccagagccatgagaaagaggccttcaccccactcacctcccctccct

SEQ ID NO: 516753 - DNA, 1178 bp, Homo sapiens
  misc_feature (9)..(9): n is a, c, g, or t
  misc_feature (511)..(511): n is a, c, g, or t
  misc_feature (527)..(527): n is a, c, g, or t
cgccccccnccaacgacaatagagcaaactaaaccagagaagcgaagaaacacattatactctatcttagatatatatcatccaacttgatcacttcacactatttgggtgtcacatcccattctggttgccgtaagtatttctctctcttggaaatttcgtttttttattaatatccgcccacacttgttgggtcaaaattaattgccctcctgaagagccttacaccaacacgtggtgactcttatggggtttcccaatctagaggcacacatattggggctatgggactttcgaacaaaattgccaaggttttatgaatattttatgggggggcacacacgagttcccacacagatatagtgtctttttcggaatataaaggattattgtctccccctaagggctcctgcattttgggacaagaaggaatctcagcccttgtgaagggactcctgacttctgaggaaaagccccgtttgaagaaagagtggcaagaaaacaactttgnggggatcccacaaagngagctcgccattttgaaagtcttctgaagtcaaatcacttcaccgttctaggctacaacagggattttaagtggagtttgtgcatagttgtgccctttttatctgatactcgtgatttaagccagtgaataattcttaagaatggactggggaaaaccatcacactcctgagagttagaaatatagagatggtttgtaaaaatccccacgctaaaatcctgaatgctggaatggtaattaatcttgggtagtcttcaagctggttatagcgtgaaaataagttttgccaccctttgagcgcaaccacctgccaaatgctgtaacgtactgcactttgccccctgaggccacggtggaatgtttatccctgtgttaatataaacttcctgggtccttcacctggaacaatgcctagtccacacacttgtttttcccacgtgaggtcaacaatcctgggagtccacgtgtataaaatcccatatcaatgttttgtgcataaatttttcccaaggagttttatttttgtgagaactataatcacgtagtgtacacattaccacatataatgttaaaagatttacataccaacaaagcaacccactatccaagtgttatacccacttaaacccccctattaaccttggacagtga

SEQ ID NO: 516754 - DNA, 191 bp, Homo sapiens
  misc_feature (22)..(22): n is a, c, g, or t
  misc_feature (27)..(27): n is a, c, g, or t
  misc_feature (127)..(127): n is a, c, g, or t
  misc_feature (175)..(175): n is a, c, g, or t
ccgctccggcaacgccaaccgntccgntgcgcgcaggctgggctgcaggctctcggctgcagcgctgggctggtgtgcagtggtgcgaccacggctcacggcagcctcagccacccagatgtaagcnaatctggttcccacctcagcctcccgagtagtggatctaggatccggnttccaacatgtggcag

SEQ ID NO: 516755 - DNA, 213 bp, Homo sapiens
cagagcagaattgcagaatgatgggcagaaagaagagaaggagcatttgaatgccaacagcgtttggtggcagtggttggagagatcagctttggatggcaaagccccaagggaagatctcttcccattccatcccctttccagctccccatccatcccattgactgccacctccaccactcaataaaacccccacattcacctcaaaaaaaa

SEQ ID NO: 516756 - DNA, 145 bp, Homo sapiens
  misc_feature (93)..(93): n is a, c, g, or t
gctcacatttaatttttattttgattttttttaatgctgcacaacacaatatttattccataagaaatttcctcctcccttttttccgccgcngctgctgctttatttatttttactgccagtgagagggaacttttgtggcctt

SEQ ID NO: 516757 - DNA, 383 bp, Homo sapiens
aaagtgggatggagactagaaaaggtctagcttggagaggacctactcacgagcagaacacgctttggaaactcatgggtgaaaagaggcaaaattctgtgcatttcacttttgtcagaaaggtgcaaggaaggtcaagaagaaagaaaaaaaatgctaacatctatctaaagaaaaagtttctcccacgagcatatagcatgtaaaattgtgtctttgcataggtggggttgaatacagaacactggactgaacatggggaaatgtggattctagtccaaactctgtagttaaacaagctgtgtgattcaaaccacatcccttactttctgggcttacactccttaatctgtaaatgaagcatttcaacttacaaaaaaaaa

SEQ ID NO: 516758 - DNA, 169 bp, Homo sapiens
acgcggcaccgcggttcaaagaaggattttggattcctatcttaaaactacgatcaccagtcactttcctgtctagatctggcgcaggacaccatacgaggtatccaatagaacctgggaatcgctacagactctcacagctacatcaagtgcacgtggtgctcatatg

SEQ ID NO: 516759 - DNA, 141 bp, Homo sapiens
caggtcctaagtagctatagtgagcacacgcattgatcactatacacgtagttgtatgtgaatgagactgattggctttaacatgaattttctgcttcaaggccaatatctctacaaacgttctgtagaagtattgctcag

SEQ ID NO: 516760 - DNA, 354 bp, Homo sapiens
acgttagggtttgtggttggcccatgaaagctggaccatagggaagtggaaacagctttggccttgttagcttggtcctgggattggtagatgccagatcatcaattgcaaactctgtgcaaattagaatacccaccgcccatgccaccatgcaccggaggaggtcagctgcgacacactggaagtcagatctagagtcaagaagcaggaaggtatcagtgaatgagaaaaagcaacgcctggtaccaaccctgagatgacagttagagaccctgcacctgggcctcaaacagccaccagcgcagagctccaaaagccacaacagagcagaacatgtgaaaaacagatctgggc

SEQ ID NO: 516761 - DNA, 743 bp, Homo sapiens
aggctaaccgctgtatcagtccctagctcggattccagccaattgctgcgagcttgcgtccactagcccgttttcaggacccaataatagatcgtaagcctggtgttccgcagtgatggtgatccagtgtatagtattggcagtcttcctgctggcttctagcaagcagatccaagaatgaaactaatagagatcgtagctatggtatcctatgaagccagagatccataggattctgaagaatcaagcattattgcacgccaatgaagagaatcggaagtggactgagagaaacatgtacctgacaactagtcgaccagccacaggttaccccctgccacctcagattttcaatgaaagccagtatcgcggggactatgatgccttctttgaagccagagaacaataatgcagtgtatgccttcttaggcttgacagccccacctggttcaaaggaagcagaagtgcaagcaaagcagcaagcatgaacctttaagcactgtgctttaacgcatcctgaaaaatgagtctccatggctttactaacatagccagaactaacctttgccttcaacaagcacataggcttactgtcgcacatacctagactagctaggagttacacatgccaacaccattccacactgacattaccaacattaacaattcgacacattactggtgaccctggtgacgaagaatgggcatactaaccttacaagtctattaatacagtacgacta

SEQ ID NO: 516762 - DNA, 253 bp, Homo sapiens
  misc_feature (16)..(16): n is a, c, g, or t
  misc_feature (68)..(68): n is a, c, g, or t
  misc_feature (95)..(95): n is a, c, g, or t
  misc_feature (108)..(109): n is a, c, g, or t
  misc_feature (111)..(114): n is a, c, g, or t
  misc_feature (116)..(116): n is a, c, g, or t
  misc_feature (121)..(121): n is a, c, g, or t
  misc_feature (124)..(124): n is a, c, g, or t
  misc_feature (130)..(130): n is a, c, g, or t
  misc_feature (145)..(145): n is a, c, g, or t
  misc_feature (246)..(246): n is a, c, g, or t
gagtcccattgcattncgggttgctggccagatcccgcaatacagtactgctttagaaacaaagtaanagaacaaaaataaaagggaatagagtnctcgcgacgtgtnngnnnngngtggnggngggtanggtgtaactactttngatctgtagagtaagagaggctccttcattgcatgtatagcggggtgtcagtgccccagagaaagcaatggtttccagatggaagctgatggacagatgcnggaagca

SEQ ID NO: 516763 - DNA, 1092 bp, Homo sapiens
agcggcgcgcgcgtcgcctgtcctccgagccagtcgctgacagcagcggcgcgcgagcttctcctctccacacaacatacgagcaccataatgggaacatgagcatgcaggacatgcaggataacacatatatgatggccacactggacgtgaaactgcggccctcctgccacaactctttccgaacgcacatggacagcatgggaagcacatgaacggcacgacgaactaccactggtgagcacactggcatatcccctgagaatgcacaacacgcatacccacaacacaccaacagacgacacgaacgagcatcaagagaaaaacaaaacacagacacggactgaacggaacacacgaccatacacaacaagacagacaatgaaagagacacagaacaccaccaaaagcaaagaacaagcaacaacacaaaacaacaaagcaacgaccacccagcacaaccacaagacactgacaacacaaacaaaaaaaaaaggaaacccaacgaccaaacaaacacacacacagaaaacaacaaaacgaaaacgaaacacacgcagcaaagaactgacagacgaaacgatgagaacacaaagaacagaagcgagaaacaagaaccagcaacaacagaggacatcgagaccagacgaacccaacagcagcacacgacacacaaggaaaacacaaacaacgacgccaaccgtgacaaagcatcaccagtaagatcgaaccacaattcacaagtcactcacctcgaacacctattgccgaacgcacgatcacaaaccaacataaaacacacaacatcgtaacaaaaacaagctgaacaaacataggaaccggaccgcaaccaagcgacacacacaacgacacaagaaaaaacgagggaagaagcacaaaaacaaggagcacccaacgccccgctcgcaacaaacaccgaaaacaaaagacaaccaccgcgcacaccaccacacacaccaaaccacaggagcgcaagaacaccacaacccgaagcaacgagcaaggctaagaacaagacaggacacaccgagacacgacgaaaaacaaagcaacagccacagaacaagaaaa

SEQ ID NO: 516764 - DNA, 547 bp, Homo sapiens
tagcacgtcagcccgtggtgaataggaagtcgtcactaatttcgtgtaaaagtacttggtgcagggtgtaatggcagtttgttaacatttggaaataaaagatctgggtttgattttggcactaccatttcctataagtgaagggacaaggtaccattactgaattattttcctcagcaataaatggatattaaaatctctgcctgtcttcttaaagagtagttatgaaaacaaagtaagtgaacttgcattatacagactataaaaatgccatatatgcttattattaacacctattgtatagtacatagttcttttaactgaattagagataatccatccttagggcttccaagattaacaacagtaatagttaatattgctttatatgtgatagatgttggacttcaggatctgtgcttttgatgttagatgtgttttagagctcctaaatccctaattttggtgtctgtttcactaattctgagctcactagtcatctctactcctgagtctaacttctgaaaaatctaacatctagaaagag

SEQ ID NO: 516765 - DNA, 137 bp, Homo sapiens
tgtctgtagtgatctacaggatcttattgcatttagactagctacttcataaactgccccaccaagtaaaagaaaaatcgcgatccctgatataaaccattctagtgtctaaatgcaatctgggtacctgagctcga

SEQ ID NO: 516766 - DNA, 718 bp, Homo sapiens
gagaaaatttaagttgaaaaaacagcctctcttcttattatttttatatttatttatttatttatttatttatttatttatttgaaacgaagtctggctgtgtcaccaggctggagtgcagtggcgtgaacttggctcactgcaacctctgcctcccaggttcaagcgattctcttgcctctgcctcccgagtaggtgggactacaggtgcaggccaccaggcccagctaatttcggtatatatgtatttttaatagagacagggtttagccaggtggcccaggctgatcttgaactcctgagctcaagtgatcagcccacctcagcctctccaagtgctgggattacaggtgtgaggcaccgtgccgagccatccggtcttctgaaaaaaaaaaaaaagaaaaaaaaaaggtcaaagaccgggtaataatattacactaaaatcatggcataaggctacttaactgattggcctactcttagaacatttcctaaggataactagaagaaaaaaaaatgcgaataacgataaagggggttctctaaaataacaaggctaacattaaagaaacatggcataaaactacacaaaacccctaaagcaaagggcaaaaggagggcaaaggaaaaccacccaaactggggggagacacgcccaaaacaggagggcaacaagccactaaccacacggggcaaagacacaatcaagtgcaagtgc

SEQ ID NO: 516767 - DNA, 587 bp, Homo sapiens
tgtaaagcaccatgtaaatagttatactgtatgttgagggaactaagtgacaagagagaaggtctgtatgtgtttaataaagacaaaattttctgccaaatacttgcagtctatagttggttgaatccacagatgcagaaccaaaagacatggagggccaatgatagtttcaatactttcaaatacaatgaagagcttgttatgtgggacagaataccatccatctcggtgaatatcccagatgaacttgataacatacacagcagggccaggcacagtggctcacgcatgtaatcccagcatattgggaggccgaggtgggcagatcagctgaggtccggaattcaagaccagcctagccaacatggtgaaaccctcatctctactaaaaatacaaaagttagctgagtgtggtggcatgcgcctgtaatcccagctacttggggggctgaggcaggagtatgtcttgatcccaagaggcggaggttgcagtgagccaagattgctccactgcactccagcctggttgacagagcaagactccatctcgaaagaaagataaacaataaacagtagttagacggtta

SEQ ID NO: 516768 - DNA, 456 bp, Homo sapiens
ggtcactagtattagaacgggagatctctacatggaaccggctgtcctctacactgctgacctccctaaacatagatgactagtactcgataatagagacagcaaccagacttagatgtgtgtatatttctaggggtaggggagtggggacagagaaggttcttgctctgtggcccaggatagagtacagtgtacatgtacatagctcaatgcaaccttgaactacctgggctcaagtaaatagctgggacttcaagtgcacaccaccccactcagctagttataaaaaatctttcgtacagacagtgtcccaccatagctgaccaggctggactcaaactcctggcctcaagtgatcctctcacctcagtctcccaggattagaaaggtaagcaatcttgcccagaccatgtgtagtctaaatgcactcatgattgcattaagacatctctacaa

SEQ ID NO: 516769 - DNA, 549 bp, Homo sapiens
tcgagtcggtaccagatgatgagagaacccaagaatctcccaaccgagagctttgctatacagcaaggagcctcctttcaaggggactggatagtcaaaaatcaaaagctcgtcctcccctaagagcagaccaaagaaattctgacatctcttcaccaatccttccatatcagtgtgcgcccccatacctactccttcaccctatttctcctccccccatctattcacctcactaagagacataacctcaaactgtcctatatgctctgttacttcctcccaaggggccctccactctccctccatccctacacatcccctcagaggaacactcccaggggaggactggcaaatagacttcacccacattcatcccgtcaagaggacaaaatttattcttactcttatagacaccttctctaggtgggtagaagcatttcctacctcttcagaaaaggccgcagaagtctcccaaattcttgtaacagaaatcatccctagatttggtctccctggctccatacaatcagacaatggcccctagcttca

SEQ ID NO: 516770 - DNA, 560 bp, Homo sapiens
gggtgacaagatctgagctcactatcacagctgctgcgcagactataccgctgagtgcaagccccaagtgactctcggggatgtgtgcactatgccggaggatgagtacacgggctatgacaaaggccaggagattcaggcccagaccaaagggaatcccgagcagacacctgtgctgaaacctgaggaagaggcccctgtgcctgagagtgggcgcctctaagcccgaggggagagactcaaaggctgagacaccttattcagggagacctcagagcccagagaggaggagcgtgtgcacagggaaggcctttgacacgcttaccgagcttaagaacgggtccctctttggctttcgagaggcagactcggatgaactggacgagaaggcaatgaggcctcgggaccccaagctcatacgagatagctggggcatataggggcccattgatgccgactttaaccgcattaactgtgaagggaagacctacctcttcgggtccgcagtactcgggctctgaggatggggccccgggccctgattacccccgagtctctgc

SEQ ID NO: 516771 - DNA, 612 bp, Homo sapiens
  misc_feature (13)..(14): n is a, c, g, or t
  misc_feature (84)..(84): n is a, c, g, or t
  misc_feature (89)..(89): n is a, c, g, or t
  misc_feature (119)..(119): n is a, c, g, or t
  misc_feature (152)..(153): n is a, c, g, or t
  misc_feature (245)..(246): n is a, c, g, or t
  misc_feature (321)..(321): n is a, c, g, or t
agcccccgattcnncctcatgcccgagataggcttgggcctagcctttggattagctcttagaaagatctcacatgcaagcatncccgntccagagagttcaccctctaactcaccacntccaacccggataagcataaagcaccccaccanngcacatccactcccgccccccttcacaccattgaccctaacttacccacaccccctccccccccctccctacaatctcctctcctctccccnngagttcttttatctctctctttcccccccccaactttcccctcctctacaacctctttttcccctttctttaccncccaccacccccgtttttttctctcctctccactcccgttcgcacccctctttctccatcctcctccctccccccccgtccctctctctcaatcctttcttctacccccccctacccctccccctccctcccccctcccctttttcctcccccccccccacgcccccactccccccccactacatacccccaaccctctcttcacgctccctctcccccccccctgccccccttatattttaacctccatacatctctcctttctctctttccccttttatcctcctccct

SEQ ID NO: 516772 - DNA, 170 bp, Homo sapiens
aaaatgtggagcgtatggttctttcaccagtaatatcatgccttatgtaacttcactatggttattttattgtaaatgagtacacaaattcttaatttaagagattgtcatgtaatcatttatttcatataatttctattccttggtttacgtcaaattttgcaaagatt

SEQ ID NO: 516773 - DNA, 123 bp, Homo sapiens
  misc_feature (16)..(16): n is a, c, g, or t
acaacagagacacttntgaggctggagcaaggtgtgggtggcctgtgtatgtgtttccgagtgtccccttggtggaatgtgcgcaatttgtgtgtaatgtgtatgtgcatgttggtgtgcaca

SEQ ID NO: 516774 - DNA, 507 bp, Homo sapiens
  misc_feature (14)..(14): n is a, c, g, or t
  misc_feature (54)..(54): n is a, c, g, or t
tttggtggattttnattatattttaaagagttttaaggatttataaatatatgnatatataatatatataaaatatatatattaaaataaaattattaggaatattgttttagttattgaatttttttttttaagaatattttttttttaagttgagaagtatagggatgaaaaagatgttatattgtgtttgattattttttaatttgtatttttatataatttatattttttaaaagttgaaaatttagaagtaagatgaaaaaaaggaaaagtaggtgttttttaaaaattagaattgaggtagtttagagatgtagtgatgtaagtgttgatgtttttttaaaaaaaaatgtaaaaaaatttttatggtggagttttttgtttgtttattttagtagttgatgttggtatattattttgttggagagttttttatatattgtagtttgattttatattgtattttaaattgtgtgaaattaaaaataatgaattttatttata

SEQ ID NO: 516775 - DNA, 137 bp, Homo sapiens
tctctggaggtttcttcctttatatccttttctatttgccttttctctttcaggcacttctcactaattcctggttctttacatagcacacctcttttgctactgctgtacattaccgggctttacagtggcaggct

SEQ ID NO: 516776 - DNA, 148 bp, Homo sapiens
ccagtcaaccaacgcttcaacgcgtatgcgctggcctgggaagaatcgctggccgacgggcgctcgttggaggactaccccgccgtgatctcgcggctgcagggtctgtgggagacgctggcgcgggcactggaggtgctgcaggctg

SEQ ID NO: 516777 - DNA, 378 bp, Homo sapiens
  misc_feature (174)..(174): n is a, c, g, or t
  misc_feature (252)..(252): n is a, c, g, or t
ttttttgtttttttgagacagggtctcactctgtcactcaggctggagtgcagtggggtgaacacagctcactacagcctagacctcctggactcaagcaatcctcccacctcagccatccaagtagctcagatatgtgcgcgtgtcacacatctggctaactttttatatttngtagagaaagggtcccactttgttgcccatgctggtctcaaactcctgtgctcaagtgatccttgagatccacttggnctttcaaagtgttgggattacagccatgagtcaccatgccagccaaagttctttctcttattcttcctgttatatttttttctttaaaattaatttatttgtttctcaggatggacagggggatct

SEQ ID NO: 516778 - DNA, 1052 bp, Homo sapiens
  misc_feature (568)..(568): n is a, c, g, or t
  misc_feature (642)..(642): n is a, c, g, or t
agcggaacgctctaccacagatgctgaatgatcgacatgaagtaataccttcctagtgaagatgacttttatttcacggactatattaagttgtgccccaaccttctgtcatgatatattgtccaaagagaacctgggaccatcgcctgacgtcgcaacaagtatacatgtaacgctgtacccaattctatcacgtgacgtatagtgctgacttggcacaaggaccatgatagaagatggctcggtatatctaaagacacgctctattgattacatccgtgtgtgacacttatgttgacactaatgtcgacaagaatagcatatgaacataattgtgccccagctaaaggaattatacgccgaggagcctcatccatccatacctgatttaagcattacgttgacgaatcgattgaagttggatagacgcacatgtgtcgtgttatctagagacacataaggcgccccctaagtttgaaatctaacacatagacgcgatcttgtttaggaaacaatacaacagccatgcattgggaccttgcccctcagcgttactcttcaatcatcntcatcatcgtagagcgcataaaatcgacacgactacaatgggtcaatgatatcctcgtgtcgaccctggacgtntccgtagtgatcgtgcgtaccatgttcgagtattagagtaccccttcagagagaatcttgtggagtttcgcatttgacacagcctataatgacgtaagcatcgaaatcgaattatcgcgacaaactcgagagattgacgttggcatctagccttttctggactctcgctgagtgtaggctaaatgcaaagagttgaccatgtctcctttagtgagggcataatggaatgggcagcttggtaatatcttctctcagcgggtggcgattttgcactttcctcaatgtaggaacctatggagggaataaccgaagaatgcacttgcttcaactctctaataaacccaatgttccagcatgtttgtcccagtggactctttagcctaaatttaagggtgcatcacccgggctga

SEQ ID NO: 516779 - DNA, 175 bp, Homo sapiens
gttgatgctgttggagataaagcaaatggtgaagtgactgaaccacagagaagatccgcgatgttgtctgctacacctgctcctccaaagccagagcccaagcctaaaaagtgcccctgcaaagaagtgtgagatgaagtgtacccaaatgtgtgaaaaatgtgtgaaaagcttg

SEQ ID NO: 516780 - DNA, 856 bp, Homo sapiens
acagaaatggactatgttgatgacacattatccagctgagattggtgttcaataagcccaaaacatcaacagggacttgcggctgtggagaaagcttcaatattggaaatctcaggactcttctggccgtagcttccaggaaagctcggtggaagcttagcggctcactgctgagatatcatgtgcactgtcacgatgctggtagaataaacgcttgaatacatcttgaacaatgaatccagtgtgttggattccagaagaaatgatatttatattctctataggggacagaaaatgagaagccatcactctttatggatcatttaggtctcttgtatcctttgttttagaaccagtttcattaaagttgccttcctgggcacctgttttatccatttcctgaactgtgtgcagctccttagatcgctattgatggcttgatcatccctcagcatttctcccaaaccagatcggtgactcctaaaatctgagacaggacatcgtgactgctggtagtaatatggtggtgcattgtattgccagccaaattaaagatagcctttttatacattgttatgaaaaagttgcattgtcagctgcctcactgaatactctttaatagctaccaggccaaggattttcgttcaactatagtacagaattaggttcttgagtgatgcgttcaacaggtgcgaagacgtccatacggcgtattaaatcaaatacttttggccacccatatgttctggtgcacagaaggggccccaacggcggatggatcttccaagggaaaggcccaaaggcttaggcgcacaccggaataccttttaggagacaaacccaggagggcaaggcc

SEQ ID NO: 516781 - DNA, 161 bp, Homo sapiens
ctggacttgctgctgctgctgtgcccgtggtctcttctggtgtgccacggagaggggaaggacctttgtctgggcgttaccaacgcctggaaactttacctggtacctcatggtttcatttggcatcagaccggagacccttgggttctcccgtctcacca

SEQ ID NO: 516782 - DNA, 337 bp, Homo sapiens
tcaatcgagctcgtaccgtgggtagcacaacctagggtcagttttgcaggtggtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 516783 - DNA, 163 bp, Homo sapiens
aatgtgtgtggtgatctagaggatcccgaatgactaccacatcacaacctttcaggcagtcaggcagctgttcagtgtccgaggtagcctttcacagcggctttggtctcgatgtgtgctcagatctgcgtgacactccgtggtgtgtgcgcgatatcataga

SEQ ID NO: 516784 - DNA, 396 bp, Homo sapiens
ccctggttagctgtattcctaggtattttattttgagtgtgtggcaattttgaatgggatttcattccaatttggctctcagcttgactgtgtataggagggctagtaatttttgcacattgatttagtatcctgaaattttgctgaagttgtttgtcagcttaaggagcttttggaccaagactatggggttttctgaatataagatcatgtctgaaaacaggaatagtttgacttcctctcttcctatttggaaactatttatttctttcttttgcttgattgtcttgtgctggttttcaaggaaaatgcttctagcttttgcccattcagtatgatgttagctgtggcccctgtggatttttcgcaagaacattaataaactaaaaacttcca

SEQ ID NO: 516785 - DNA, 128 bp, Homo sapiens
ccctgtgtgtatctatgctttggttctcatacgtatcattaagagtgtgctgctaatatattcttccattcaatgtcatgctctacagtgatgctccaatgagtgaactgtccctcgcagctgcttct

SEQ ID NO: 516786 - DNA, 1040 bp, Homo sapiens
  misc_feature (802)..(802): n is a, c, g, or t
  misc_feature (1014)..(1014): n is a, c, g, or t
  misc_feature (1040)..(1040): n is a, c, g, or t
gatcctagctggggacgatcgatttcgtgaggtctctgtgcagtgttgcccggctcacctagacatgagattcctctatggcttgtgtcgaaaacggcgagacgatctcagttgatgaaggtgtcccgcttgcctcaccgatgaccagtgcaggccaggctccaacactaggagccattactcttgcccaatgactctcgtttggcgtggatcacagtgctctgcgccccttgtcagtactcgttagcgaacatcccggcatgtaagaaacaaaggggccatcgttgcctgggcgtgtagagctatcagtgatgagagtatccggtggagtcccgatggacgtacgatcccttggaatgaaaaaatgcacttcttagtccgtccgttaactaaacgaagggcatgaactgtgctgagttaatagcttatctctgcaaagctgagtaatgattagtaattgggccactgtctttatttgattgagcactattcacaagtgtttgcatgacttggctagtgtgtacgcattgcgctttaatagatctcatacacgcataaattcggctcgtgaatgtctggccggatattctcgtgtgggtctggtcctgatcttagattactaactactggcttgtggtcaaatgaatgtgcttcctgtttggggatccaagtggtcggctccattgcggtcgatgggtcttcctgtttaccccccttttaaggattatgatagcgttccgtgaacccggtctgcctgtcacgagggatggggtagtcgcccttgagcgtcccggcgactggntacaatgtgcaccacactagggacacagaattttccgaaatggacaatgtccggtttaacaaaggacgcacactgttggtaccacccttgcacacaagggagaagacaacaacggcagcgaaaagataagagagcacaattacggagagagaaagctcagtgttagagacaatacgacacacagataagtggagaaccacttatatgtttgngtatgcttatatagacaatcatatgn

SEQ ID NO: 516787 - DNA, 627 bp, Homo sapiens
aggagagagagagagagagagatagagagagtgagacagtgagagagagacatcgtgagagtgagacatatagagaccgggcgcctcatacccgtctcggcatccaccaccttggctttggatttctctcctgtgcctggcctgggtcactatgctggagctgctgtctaccgcggtgttcccgtcctggcacgggcggccatggttctggagcccgcgctccttcctatgctttttgcgccccctactatgacgcccacctgttggacctcggtccgctcaccaaggcctggtttcttcattcctgcgacagcctctggtttatgacccacaagctgtgccctacgcttgcttgtggtgacgaagtactctgttgaaatggtcttgacatactttgatgttgcgttcgcatgtattcacactttctcaggaagcctttccgtagtttatatcctgttccccttaattttctaccaaccctttgcccccctggtgatataattgggggtaaacccattgggggaattcattaaattgggttcccattttccctccctggggggggccgtttccccttttcgcctctgctgtgagttttacttcacttggcgttttttcctttcccct

SEQ ID NO: 516788 - DNA, 139 bp, Homo sapiens
  misc_feature (21)..(21): n is a, c, g, or t
aattccctctctcgttacccnaaacccccagcgtgcatactccctacctctcagtacttccacagaagtttgtcacacaaagcctatacccagtattacaccgaccattcctctccctcgtcacaaacctctcggggct

SEQ ID NO: 516789 - DNA, 827 bp, Homo sapiens
ttactgccacaactcgaatagtcccggagatcgtgatgtaacaaggattgagcgaatcggtgcccacatcccacattccggggactggaggctggacgatgccattggagcctcggcaggcttcgcaaggcatggtgggtcagcttggtcggtacggcggtggcggcatggcgtggtgctggagatgatccgcgaaggtatgattgcctggatcgggcagtccttaattgcatggccatggtccgcgagcacggcggtaataccggccatcttccatgggcatgtgcgcatggccctgggtgcctgacacagcctattcactatgccatcgccgtcagtgaaatcttctcccttggagatgagcatagaccagaggcactgacgcagtgccttcccggcggtccatcggccgtcgcatcataggaggagacggagatcatcgaaggggaggtggtgtagatcctgattgatcgaccagcaacaggaacgggctccaatggtgaagctaatacttgaagctcctcaagaccacacgtagatgggagaccatctacgattctggggcaccaagatgattgaagtccctgacctagggacaactgtccaggccggggaacgtgatcaccatcgtacaaggcgacttggtcaccgcatctcccaagctgggccgttccttgactacgcgcccgtcgatacgacgctattgggctccccagaccaagttcgtgctgtgcccagatgggggaaactcaaaaacgccagaggtggtgcacaccggtcctcggatatattcttattctcccccaggttctgggttctcgggaacc

SEQ ID NO: 516790 - DNA, 118 bp, Homo sapiens
ccgtccatcagtgaacggaagggaagggaatgcaggcagcaggagacagagacatcattaactacaggtctgaaaccctagttctttactcactcatcaggttgcttttaatcactgc

SEQ ID NO: 516791 - DNA, 1003 bp, Homo sapiens
ggttcaggcttcgggggccagccgccgccatgatcctgctggaggtgaaccaaccgactatcatcgaggagacgctcgcgctcaagttcgagaacgcgggcgacggaaacaacaccggaatgcacgtacgaagtaacatttgcagatttcgagtggggtcctcctatcattagtttcaacatcctaatggcagcacgaaaaacctagaaagttgcatggtccagatattctctttgacaattctaccacaggcaacttcagggccacatggtgctgcatgagttattgaaaggagggtgtacgggagttgctctgcgtaaatccagcaatcaggatacaatgtctctttgctatatgaccttgtatcactcttccggcaatcccaaggtatgccattgtagcatcaatgctggcgatgttgaagcgaaattggtttttagcctctgtctttgaaaaatacttccatattccaagacagagggcgaggaaggagagaacagggccagttatccattatagggatgatgagaccatgctatgtccgagtctcaaacacggacaggcagtcacagtaatctccggcacagagtccacggctgacgacgcatgttggtcattgtaaaaggtgttgcagtgcgacggaagttccaacgaaacgacgggaggagcccggccacccgacggcccacaggggtcctactttaaggccacaggggataccctcccagctgggaggcttgagacgaacacacgacgcccaggtggggggctgaacaaccatttggctcgacattcacctttggtggctggttgccctcgtcacacccaattggcagtggtccgcgaacaaccatccacctctgatccccagcgtcgggctacctggacttaccccatcaaagcgatgaagcgggtatctcccccgctgatcgacgaaagggcttctcaagggtgagcgcagccgtggaaaaaattcatataagcggagaagaacaccgaatgg

SEQ ID NO: 516792 - DNA, 143 bp, Homo sapiens
ggacggatacagaggtcaggcgatcgagaccatcctggctagcacggtgaagccctgtctctactagaaatacagagaattgtgcctgggtgtgagtggcgggtgccgtgtggtcccatgctgctcgggaggcttgaggatgg

SEQ ID NO: 516793 - DNA, 1460 bp, Homo sapiens
taggttggagggggaatggctgggagattggtgaatggggtatgggaagactattttcattataagtaatggctagggtttgggtgggaaattttttggtgtatagatagtctggtgtgggaaacgcggttggtgcagactattcaattggttattattatatgtgtcctaacaacgcacaaaaaacaaaccaaaaaaaaacaatccgcgagaggagcttcctatagtgcggcggcgtggcgcggagaacaacgagagggcctacgagagaatcggggcgcatgtgtggcgctacaagcgcgtggtaccctcggcccccacggtattcctgtgtgccaccaacaggagggacaacaccatccgcgcacgggctcctccccaaaaaaaggggaggcgcgcgcgatatattaaattctccgagaaaaacccccacagagagatacaccccgtgggcgatataaacgaaaaaacgcggcgcaaaaaaaccaccccccggaacgacaagagaacgaggcacggagcagattaggaacagcagggagagcaaaagacagtctagggatacgacagagagagcataacacgcaaaaaaaatagaggcaaaacaaagaatataaaagaggcaaggggcagaaagaaaaaagccaggtacaagagaacaatgagaacaacaaataaaaccaaacacacacgcagcagaacaccaaacacaagaaaaaattcgtcaatacgaccacgggaacagacagaagagcacaggaacagagtaaagtactacgagagagaaagcgcaacaaggggtaaccaaagatgacggaacgaaagactcacgcaaactcaaaagcgacaaacgaacaagaacggaaacaacgggaaaaaaaagacataccccaccaactcacaatcaataaacaatagaacaacacacgcaaaataccaataacaaaacacaacacactttatttaactgaaatacacaaagtcaaataacagcaacacgaagcaacaaaacaaacaacaaattccaacatgctacattaaaatcaaaacaacacactaaaacactcacaacctacctaaatcaggtgtttgtcgacagaccagcagagaactagcggcacaaccccaaccgaaacggcaagcaaggaacacgcaagacgaacgagaaaaaagaagagcagaaaggacagaaaaacaaaagtaagaatagacgaacacacaacatggagatgagagccaggccaatgatagcgaaacagataggaggcgaacgagcagaacacggtgcacaaacaggagaacaaagacaaatagcagggaagaaaacacagacgacaagaaacagaaaatccaaaagagagataagcaagagtaggaaaaggcaagagaggacgtaggacagacaggggcgagacagcgcaagaacaacgcagccggccgaccagctgactagcataaac

SEQ ID NO: 516794 - DNA, 439 bp, Homo sapiens
  misc_feature (3)..(3): n is a, c, g, or t
aantgtttaaagcattttaaaaaagatctgtccttaaaaaaaaataagtaatctttgctacccagcaccctagcttgctttaaaaagcatttgttaagattcccttctctggctttggcttggtttttttggaataataataataaaaaaaaaagttggcccaggtatggtggttcatgccctggaatcccagcactttgggaggccaaggtgagtggatcacctaaggtcagaagttcgagatcagcctggtcaacatggtgaaaccccgtctctactaaaaatataaaaattagccagacgtggtgcgcacgcctgtaatcccagctacttgggaggctgaggcaggagaatcgcttgaacctgggaggcggaggttacagtgagccgaaattgcaccactgcactccagcctgggcaacagaacgagactccatct

SEQ ID NO: 516795 - DNA, 423 bp, Homo sapiens
ctctagagtatctcctccccgtacgcccaaaggaaactgtaaatagaaaaggaaaataaatctgtatgtttaaaataccctatagccaaaggatggtagagaggcacgtgggggaaactggtccccttaagcaagacacccatgtctcaaagaaggcaaagggcagaatgtcctcctgtggaaggaactgcacaggtgcccaggaactagctgcatggagcaactgtcacagctaaggtgggtgtcagggtcccgcccgtcagaggcagcccagccacagtcaaaggccccggatgtcccactggtttggggaagtcatggtgattctcaggatgtcagacccactctccctgagtggtcgttcgttggtgagcctgcagaaagggtgagtctgcgttgggcgtacggggggtaccgagctcg

SEQ ID NO: 516796 - DNA, 499 bp, Homo sapiens
aaagaccatgctagcaggatcattcacaagctgatatgtgaaaatccagaagacagcagctatgactccaccagaggaggaattgaagagaataggctccccagaggaaagaaggcagaactccgtgtcaaacttcccaccccctgctggccgggaattcattttgcgcaccactgtgccacgccctgctccctactccaaagctctgcctcagcggatgtacagtgttctcaccaaagaggactttagacttgcagttaaaataatcgatgaggatgtatagcccccccgtgtgaggatgacatcaccacatatctagtttcatggagctcaagatgtcttatgtcagtgtggctagatggccacgggtttttaatcttatggtaagccagaattcccacttaaatccaaagtaaaaatggttatactgaagcataaaccttgcctgtataattttaaaaaattaatagagctgtgcaaaccctattatttttgtaaa

SEQ ID NO: 516797 - DNA, 351 bp, Homo sapiens
  misc_feature (224)..(224): n is a, c, g, or t
aggtcaataagggatatatctcttcattaaaatggatgagaagtttgtcattactttactgcttcttggctagatgtgtggcttatgcctgtaatcacagtgctttgggaggttgaagcaggagaatcgcctgaggccaggagtctgagaccagcttgggaaacatagtgaggccctgtttgtgcagaaacaaaaaattaaatttgccaggcttggtggtgtgnaccttcaatcctagctactctggaagctgagtcaggaggatcccttgagcccaggaatttgaggttacagagagctatgattgcatcactgcactctagcctgggtaacagaataagacctgtcttt

SEQ ID NO: 516798 - DNA, 721 bp, Homo sapiens
gagtataccctgcagtgcactgtagaacaggagataagaacttttctcctgaatttgggtcttctagacttaggtgcagcatatctctttgttattactaagcacaccgatcagggtcttcaggcctggaagacttgaagacacttccagctcaacacacaagtgtccagttgcgtggcagcctacccacaatatgcctctggttacagctgggtgagttcatgttctctgtcacaggtctttgagttttcttattctcaggctccctctagcatgtaaatctgtgctccaggcagcttggctattgacaattgcagttgggaatatcatcgtgcttgttgtggcacagttcacgtggcctggtacagtgggccgaattcattttgttttcctgcctcctgctggtgatctgcctgatctatctccatcatgggctactactatgttcctgtaaagacagaggatactgcggggttccagcagataagcacattcccgtcacatgccaggggcaacatgatcaaatctacgagaccaagaagacaaaactctgatgactccctagattctgtgcctgacccctaattcctggccctgtcttgaagcattttttttcttctactggattagatcagagagactagcagcatatcagagctgatctcgtccacctttctccaatgacagaagttccaggaactggttttccagtacatcttta

SEQ ID NO: 516799 - DNA, 308 bp, Homo sapiens
  misc_feature (146)..(147): n is a, c, g, or t
  misc_feature (154)..(154): n is a, c, g, or t
  misc_feature (173)..(173): n is a, c, g, or t
  misc_feature (181)..(181): n is a, c, g, or t
  misc_feature (295)..(295): n is a, c, g, or t
  misc_feature (297)..(297): n is a, c, g, or t
gccgtgggtgtgattcctgtcctgcgcggttgttctctggagcagcgtcttttatctccgtccgccttctctcctacctaagtgcgtgcctgcacccggatgggaagcatttcgaggtgggcacaattgtgaccatttgaatgccnncccttgnatgcgccccgagaaaactnaatctttntgcggttggtgaactaaaggccgacaaagattatcactttaaggtggataatgatgaaaatgagcaccaagttaatctttaacgaaacgggttcgaggctctgtaggcgggcgncntggggttgggg

SEQ ID NO: 516800 - DNA, 842 bp, Homo sapiens
ccaatggggggcaaaatttcccccccgaagagtgggcacgttccccaccctctcagtggctcaccccctgggcggtgggttcaaaaagtcgtcccagtgaggttcatacttcccgccaccagtggttggatctcataatcgttgttcacagcgagccactccctcggagatgcttcttagcaaactcgcggggggtaaaaaaaaggtggtgtaatagcgcggggacaattctagtagggaaagagtttctatatatattatagagatcacccaccctcttcgtgtgggtggccgctagctctgtctcacaaatggagatgcccacggctacatagggtgggacaccgcgctcggaaagagactaggggcacgcacggcctcgctataaaatcagccgcgcgtgggcgcacgcggggacgcacacaatggggtcgcacgcgcgcgggctacgtcacgcgaatgtatatgtaggtgggggtgaaaaacaaggaggggctgcttatagatgcattccgctcacacacacgttgcggggagcatgagaggccactcacatgaggagacgaaaacaaaacacatagaggcgcgcgcggagtgataatagaaagaaaaatacccgacatacattatggcgagcatggcaatgtggggcgaacatagagatcgttgcacatggattcactctctatgttctctgagagaaataagtagtgcgtttttttttctggtcgcccggctcggactccccgcagaactctccctcatcttgcggaataataactagtgattacattcgctagcataagcgcgtgcacccccgggcatttctgccaacaaagaaa

SEQ ID NO: 516801 - DNA, 106 bp, Homo sapiens
aatctcaaacacaagcgcactcacagtcgcagtcataatcctctctcaaggactactaactctactcccactaatagactattattgatgacttctagacacgtcc

SEQ ID NO: 516802 - DNA, 1160 bp, Homo sapiens
  misc_feature (251)..(251): n is a, c, g, or t
  misc_feature (278)..(278): n is a, c, g, or t
  misc_feature (328)..(328): n is a, c, g, or t
  misc_feature (341)..(341): n is a, c, g, or t
  misc_feature (357)..(357): n is a, c, g, or t
  misc_feature (363)..(363): n is a, c, g, or t
  misc_feature (389)..(389): n is a, c, g, or t
  misc_feature (392)..(392): n is a, c, g, or t
  misc_feature (460)..(461): n is a, c, g, or t
  misc_feature (465)..(466): n is a, c, g, or t
  misc_feature (480)..(480): n is a, c, g, or t
  misc_feature (483)..(483): n is a, c, g, or t
  misc_feature (491)..(491): n is a, c, g, or t
  misc_feature (526)..(526): n is a, c, g, or t
  misc_feature (530)..(530): n is a, c, g, or t
  misc_feature (532)..(532): n is a, c, g, or t
  misc_feature (560)..(560): n is a, c, g, or t
gagtctagctatgctgacaccgaagaaacagaatgctgacccgcaggctgtgacaatgcctgccactgagaccaaataaggtcatgccagtgtggtctgactacaaaggtcaatacaaaggctcaggagactgaggctgcaccctctcaggccccagcagatgaacctgagcctgatagtgcagctgcccagtctcaggagaatcaggatactcggcccaaggtcaaagccaagaaagcccgaaaggtgangcatctggatggggaagaggatggcancagtgatcagagtcaggcttctggaaccacaggtggccgaagggtctcanaggccctaatggnctcagtggcccgcagncttcanggggtcccatagccttttgggcccgnagntcaaaggactcggttggctgcttgggcccggagagccttgctctccctgagatcacctaaagcccgtnngggnnaaggctcgccgtanagntgccaagntccagtcatcccaagagcctgaagcacaccaactngggntntggcctttttgcaagggagggcaattantttggtgaagtactttttggttaaagaccagacggagattcccattcaagcgctcggacttgctgaagggacatcatcacgaattacctgattgtgtaccccgaaatcttgaagaggcagctattccttgcagaacgtactcgggcactcccatcgacgggcacatggactcgacatgccccattgtgcattctctcacaagactttaaaaaccccattattcagcctactgcgacacaccatgagatcaccacaacggtcctcccacaggacatataaaatactcttcgaagggtaactgcccaaagacctccagagcgacacacattgccgcccgaacacaccaaccatacggcgacacgcccctcacatctttacacccatattaatgcacaagcaacccaacaaaatctaggaacatatacacatgcaccttgcaaacaacgcagaagataaggagacagcacaatgtcgatgctctctgttcgttcctttctctctccgttgtacatagccggaaccaacccaaagaaccagaaaatgacgcacaagcacacatccgaaagcaacccacacgaacacacgaacccacaccccagt

SEQ ID NO: 516803 - DNA, 699 bp, Homo sapiens
gctccgaaattgtgtagcgagacagccctgtcccaccctgaagggccgcccgattcattgggggtagacccaccccactgcgcccttattcctcgggaccacgactgccgagaggatcccctccgggcacttctccgtcggaacacctcttaagaatttcctcgtagaattgcccccccgagaagatcccccgcgagcctgtatggaattgtgggtttcgattgcccgaatttgtcggtgaaagaacttgttcacacccccctcttcgctcttcgccctccaaagtggagaaagaggagcctcgggaaccccgcgcgagacacgccccgcgagcgcgaaagggaggaaccagcgggagagaagagcctcatctctctatgatttatgacaaatgaacccccggggagcacaccgagactcgttacctcgctctgtttgtgtccccccggtgccttctgggccctcccccgcacacgccatagggtgcttttcaacccgtgcccccgggtgtcctagtctctttcacctgcccctagtttctgtttcggctgctctccccttatggttttttttttatttggggcatgggcaattatgtgggaggggagggggtttttccaaccccaggtccccactgtttcaccttgtttttttttgcgtccccttttcccaaaaaccaacccattggggcgtgggcta

SEQ ID NO: 516804 - DNA, 957 bp, Homo sapiens
gggatgagtgacgctgtccggccaaacgaggtatactgtactgagactctcgccctcagtctcgtctccggcgcgattacctgccccgttttctcctgtgagttgacctgctcctgggacgcgggcctgcaatgggaggggcctgtccagaccatggccttcgggcaggcggtgatcggcctgcgggctcagggaagaccacggtactgcctgggcatgaagtgagttcccttgcagcgggctggggccgcacacttgcgagtgtggagacatgtggaccgcggaacaaacgaggggtctgcggaacgagtgtgccgtggacgtgggcgagcatgatggggctgtagcgagtgatggacgcgctgcgtcatggggcccaagcggcaggctgatctactgcattggatgtacctgtgaaggccactgcatgtgactggcatgctgtgccaagactcgaccccctccgaaggaccacataagtatccctcttcgacttgcccagggacagggttggatgctctgcacgacatcacggagcctttgcggcaggcaatttttctcccaagatgggtgctatgtgggacctccaggctgaattgcgtacagcctcgtggattactcactaatgaacagaccctgccaagttacatttcaaggtacttgtgtcccttcacttgccaacacattgctgaacggtggaactgcgccaaattaagctcctttccaagatgggccctcattgaggccatatggggaggctggcttcaaccctggataactaacacaagaggtcctggagacctctcctagcttgttgacaacctggtattctgaaccatttatacgggagtaaagtcacgataataggaagatgatgcaggtaatacgagaactaaagcatagtttctaagtcctctcaagtccacggacagggggcaccctaggagacacgaggat

SEQ ID NO: 516805 - DNA, 159 bp, Homo sapiens
cgtgcagtattccctaagaatgcagtcacaggatgacaccgaagacgttccctaggctaatttcacgggacctcactgaagacgttccctaagcatgcggccagtggacagccacctgtgtacatactgaacgacatacccaatatgcactgtggccac

SEQ ID NO: 516806 - DNA, 448 bp, Homo sapiens
atcgatctaatatcgatgggggctcttctcccactggccaagtacccagcatgaggaatgactcttcattggtctcttcatcagaagtggtaaccttggtctctatattcacgaagtccgacagtcttgtaagtagactgtggaagcagacagaaccagcttcctgtagccacagaccagtacatggtatctaagctaaagcaaagatgaacaattatccagattcacttgaactgtaactaaaagggcaaggttcaccattacaaacaggaagttgtctaaaagcaagaattcaataaaggctgggtaagaaaagtcacaccactaatgagttgtccatgaagccaactgctaagaacgcgctcaagtatacgcgacatgaagacactatgcacgaagccttacttggcgagtctgacattctattaacctagaggccgagtgaggg

SEQ ID NO: 516807 - DNA, 467 bp, Homo sapiens
  misc_feature (50)..(51): n is a, c, g, or t
  misc_feature (53)..(53): n is a, c, g, or t
  misc_feature (78)..(78): n is a, c, g, or t
  misc_feature (84)..(84): n is a, c, g, or t
  misc_feature (154)..(154): n is a, c, g, or t
  misc_feature (191)..(191): n is a, c, g, or t
  misc_feature (214)..(214): n is a, c, g, or t
  misc_feature (260)..(260): n is a, c, g, or t
  misc_feature (387)..(387): n is a, c, g, or t
  misc_feature (399)..(399): n is a, c, g, or t
  misc_feature (434)..(434): n is a, c, g, or t
  misc_feature (453)..(453): n is a, c, g, or t
  misc_feature (464)..(464): n is a, c, g, or t
tcagaagtcgcttagctcttcggtggttgtcacacgtccggagcctagcnncngcgtacctaggatgccgcgtggaanccgaanccgcacctcccgcatggcccctccggcagccggcccctcagatgagagctgcaccaggccagcacaagtngctcagcaccagcagcgggaccccatctgcagttggntcttctgctgctgcgcccggcancaggtctgatggccagatggcaaccactgcagctggcgtggctgtnggctctgctgtggggcaacattgggtcacgcattactgggggcttcagtggaggaagtaatgctgagcctgcaaggcctgacatcacttacaaggaagcctcagggaacccaagccagcacagcagnagaagccttttnctcttattaagatcaaacagttttttggagtgttnccagaacaagggtgacatnaactctgtganggg

SEQ ID NO: 516808 - DNA, 81 bp, Homo sapiens
agccccaaccagacctctctgtacttctgtgccagcagtaagactagcggggggctaggtatcctcaatgagcagttcttc

SEQ ID NO: 516809 - DNA, 1618 bp, Homo sapiens
ggatgatctggtagtttgtgaggcgtggtggaactctgatggagtagagcacgctggttgtagtggacccatcggtgttgtggctgctacggtagttcggcgctgtgttgcggacggcgatttagtggctcttgtgtgcgtgttgggggcgtgtgtggttgtgcgcttggtagggatgtggcgccgttgctttcagttggttggtggggacaaggtggggttgggcttcgtgctctctgcgggggcgccccacgagtgggctcccggggggagttcttcggctggtgggtgggagccccccgctcttggtggtgggccccaagggttgtggttggtgttccgcgaccaagggggggggttttccccccgggggggggttgatcccactagcaccatgcctcaccgcgtgtacccacagaaaaattgttgccggttgtcaaagggagtggttcagcggctccgtgtatgggaagatagtagtctcgtgtgggggaggaggagtacttgaggaggcgtgtggtgagacgagggtggtgaagaaggtgtgtgggctgggcagactgtgaatggacagctggtttcggcccccccacgtttttaagagtaatgggggttataaggaggccccttcgtggtgggggcccccccaagagggttgtgtggtgccccgcacgcctgtggtgatctccccccctgttcactgcacgacacgcggtcgtggtatgcccgcgacagatggggggtgcgcgctggtgtgccgcccccccgtaggggtggtttggtaggaggggtgggacgccccaccgctgtggggtggagtggcgttggtggtctggctctctgctccgctgccctctcggaggagacagaggaggagagataggagagagaaaagaggaagatctgcggtgggtgtgtgtgtgtcgccacaccctcggagagttttatagcccccacactgtggagagacactctctacggtcgggcacgtgtgaggccccctctgctctttctgctgcgggtgtgtggggagaaaaggtgccgccgtgttgtctctctcaaagagagagggcggccacatgtctgcacactgttggtgggcgcttgtggagatacacgcgcgcacgctcgttctgtgaggagaaaatatcttgtagagataggggcgctatatgggacacacacaaactctctttataaatgtttatgataattatatttgtgtgacaactcttgtctctctgggtgtttgtgggcacaccctcgagccaccacccacttcttgggcgcgtgggagcacgccctctctggcacgctgtccgctcggggctggcacactactttgttggagagttgttgtataagtgtttcctcttccctcatcgccccgctgtccccactctttttggttaagagtgtttttagagaggtgtctcttttagagtgggaccaacctcgccgctcttattggccttaaaagtgtactctccctcttttatatggtgtcttctttggggccccttggggagaaaaaagaaaatacccatatagggccacagttttgatactgaaaattgaccaggtgtttttttgtaaaaaaaggacccctcccccccca

SEQ ID NO: 516810 - DNA, 255 bp, Homo sapiens
acccccccttttttgggggggtttgaaaaaacggtttttggggggggggggccccgggccctttttttccctttttttttgggggggaatacccttttttgggggcccatttcccccttttttgaaaaaatttttttttttttccgggggggttttaaaaggggggtttttcccccccggccggggggggggttttttgggcccccccccccctttttcccccagggggtttttttttttttttgggccccccga

SEQ ID NO: 516811 - DNA, 292 bp, Homo sapiens
  misc_feature (27)..(27): n is a, c, g, or t
  misc_feature (140)..(140): n is a, c, g, or t
  misc_feature (225)..(225): n is a, c, g, or t
  misc_feature (232)..(232): n is a, c, g, or t
  misc_feature (242)..(242): n is a, c, g, or t
  misc_feature (250)..(250): n is a, c, g, or t
  misc_feature (258)..(258): n is a, c, g, or t
tttttttgagatggcgtgtagctttgntcacctaggttgggagtgcaatggcgcgatctcggctcactgcaacctccacctccacctccagggttcaagcgatttacaggcgcccaccaccacgcccagctaattttttnatttttagtagagacagggtttcaccatgttggccaggctgatctcgaactcctaacctcaggtgatccacccgctcggcctccnaaaggtnctgggattanaggtttgngccaccanacctggcccagaacccatttctttataagcctct

SEQ ID NO: 516812 - DNA, 152 bp, Homo sapiens
caggtggatcggttacataacagcactagcgcatcccacactctctgccccaagctttatcttctagccacagcagagcgtgtgtttggttgtgtctggaaaaaccaggctgtttctcacccgtctgtacctttgctcaaggtatgccttct

SEQ ID NO: 516813 - DNA, 680 bp, Homo sapiens
  misc_feature (27)..(27): n is a, c, g, or t
  misc_feature (46)..(46): n is a, c, g, or t
  misc_feature (77)..(77): n is a, c, g, or t
  misc_feature (112)..(112): n is a, c, g, or t
  misc_feature (155)..(155): n is a, c, g, or t
  misc_feature (157)..(157): n is a, c, g, or t
ggcacgaggtggtgtagaactcatggntggcggttccgggcctctnaggaagctttgccactgggcttggggttaantgggtgtggggctccgaaccctaaatgggtgaganttgaaatgaaagcggcacctgtagtccgtttggggtgcaggtntntgccaggggtcttcagccccggctgatggccacatgaaccacatgaggagaggcagggcgtgtcagcagcaaacctaagtgtgtgctcatttctgtgggcccttactctgtgacactgcagctctccagagagacgctttgaaaacaaaacaggaaagaacacacggccccgcgtctgttgcctgagtcactgtattccttaaaaggtgaaggaccctggtccttggcttttcgtgcacatgagaaaatgttggccaaggttagcgattatgcttctgtaatctgtaaccagaagtgctcttatgcccaaaccttgatgtgattctgctgtaatgtaacttcggagccagctggatggatgtgactgtgcaggtcctgagccccggcccccgtaaccaagcagtgggccgagacactgagccgggcagtcaaacaggagctctctaaggctgctcccgggctgggacctgggtctaggattctcagtaagacctttgaataaaactaacttgaattcttcaat

SEQ ID NO: 516814 - DNA, 784 bp, Homo sapiens
gagcggacgctgaacgagggcgagggccgaggggcagctaggaagcgcggtttgagagagggcggtgcggcgccgcaggcctctggcagtgtcctcgagctgcctccgcgcgccagtgtctacagccgcctgataccgcgcctggcggtgcctgggtagtagcgtcactagctgtagcctggcagtgtcgggatcttggctgtaggtggtgcgcgggagctcctagtgctgcgcaccctgtgagtctggcttctccattccgctcttatgccgggacgagctctggaccgcacaagactaaggaatggccaccccgcccaagagaagctgcccgtctttctcagccagctctgaggggacccgcatcaagaaaatctccatcgaaggggacatcgctgcagggaagtcaaccatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagcatgatgtatgagaaacctgaacgatggtcttttacctttccaaacatatgcttgtctcagtcgaataagagctcagcttgcctctcttgaatggcaagctcaaatgatgcagagaaacctgtattattttttgaacgatctgtgtatagtgacaggtattattttggcatctaatttgtatgaatctgaatgcatgaatgagacagagtggacaatttatcaagacttg

SEQ ID NO: 516815 - DNA, 154 bp, Homo sapiens
agtgaaggtcttccgtccccactatcctggctagaagtcttcaggggaaataaactccattttccatgagttcacttactatttgcaataatgtaatactacttctactataaacatttagaaagtggtggatttagtgggccggggtgctgtt

SEQ ID NO: 516816 - DNA, 275 bp, Homo sapiens
tagcggcccagcaggctgggcccgataagacgtaagtgatgcaactaaaatacatgacattttaaaagatatagtggtggtgcttaataatggttaagattattcctccttatagccatctattgcagcttctaatatatttttcaatattcctcaaattattacaatgcctgatataaaactattttttaaaaaaatcacattttctgtcattatcctttgctacttgagcatccactaacatgacctttggatatcctgtcctttcagttttt

SEQ ID NO: 516817 - DNA, 934 bp, Homo sapiens
agagcaaagggcaatgaagagtgactcgaagagtgaagggctgcgagggctccaagggcagcgactgagaacgaaagagaaaagtgaaggcgggtgcctgactcatggtcctggcgtgcagctgggtgagtgacgtggcctatgctggcctgcatgaactactggcaggcttgaccgatcactcgactgcttgtcagctcttgttcgtgcccatgcaggaaggctcagtcgtgcgacagatgtagcgagactgagtgactcaaagtagtcgggttataccagtgcccgttgctttgcccaggtccatgtccaccctctagttccccgatcgtatgtgcatccttcttcaactagcttggcttggcacacgtcaggtcgccacgtatcactagcaagagcaacattggccattgaagctgacgttggccacgttgaaccaattgtgtgcacctgccgatgggacccttgctccagttggctttgcgttgtcaggaggtgaacttgcttgctagtgacttgaaggaagacgggcttgcttcagtcttcatgctggtggaccccgactcgcttgcggacccttgtgttaccccttgactaagtgaaggggcccctgagtgcccttgcacccctggctggcccttgcacaaaggaacagaataaaccaagccggccatgccaaccaacggtccaggaactgggtgccctgggattccagcgtggacgtaacttccaaggaactataagtgccccccctatatggaaagtaaccctggcgtggcctgagtgtaattgccggtgcctagtgtggcccatggtgggtgtgtggttaatggtggccaacctaaaccaagggaaagcctacgcgacgtatcggagcatttttcttcactttggcgggttcagtgccctgtgcagccggggaacctggtccatt

SEQ ID NO: 516818 - DNA, 327 bp, Homo sapiens
  misc_feature (8)..(8): n is a, c, g, or t
cgcagtancagtgaagatgcagactgataccacctcaccgctgagcagtgacttcctcactttctcttgtccagcttctcccctgggggcctgagagacctcaccttcttctggccatcttccatgttgtaaaggaacagccccagtgcactgaggggaggggagggagtgaggggcagtggtgtccttcctgcagaagagacatgcagcagtagcgctggcgccctctgtatgagctggcgggctggcattctggaccctggattatccccactgtaacgcctgttacacacaaaatgttgtgggttcctgtcgggctagtcggga

SEQ ID NO: 516819 - DNA, 480 bp, Homo sapiens
  misc_feature (14)..(14): n is a, c, g, or t
  misc_feature (30)..(30): n is a, c, g, or t
  misc_feature (66)..(66): n is a, c, g, or t
  misc_feature (234)..(234): n is a, c, g, or t
  misc_feature (284)..(284): n is a, c, g, or t
gtcgtatgacctanacaaggccttggccgnctgatcggggaacaggatacctgcagaggctccggncctgtacaatgccttcagatccatctcccaccaaagacctgtgtggtgtcagcagcagccccatttgcagaacttcccagagcaggttatctgcaatggaagcattgatgcagcacccacatgtcccagaggaagggttgtgagctgacagaccacagcccctcgccncaagggggttgaaaaacaccccccgggagaaaaggcaaccaaggaccccnccacaggaccaacagaaccccgttcttttgctcacctgggcagccgacccaacaaaacgcaccccctgagacctgctctccgggccccccacacccggctccgcacgaccaccctgcctgacgaccccacactgggctcctccctccctctcgccggatcgacacacacaagcaccacccttcccacccactgccc

SEQ ID NO: 516820 - DNA, 700 bp, Homo sapiens
tcaagccgtaataaccatacacacacacacacacacacacacacacacaggcatatcataatcagattagtgtaaactagaaataaaaaagaaaaatctttacagcagctgaggggttggggtaggatgcgtggacagagacactatatacaaggaaacatttttttaacccactcgaatactcacaaagttatgcaagccaataagacaatggatcaaaatctttaaagtaaaaaatctatctaccatagaacttctactatccacacaaaagatgtcccttcaaaagtgaagggccactagtggacgaacgtggcgacgcatgacacacgtgcgtggatgagatataaaaaagtggtgcacgccactcacgtgtggaagggcattcgtggcagctccctcagaagggtcaaaatatagatattcctactatgacccagaaagtctgctcccaagaaaccgttgagaacatatatccacataaaaagttgtatatgagtgttcatagcagcagatgacttattcacaggagccaaagtgtgaaaacaatccaaatgctattaaatgatatgtgggtaaataaaatatgatacaaccatacaatggaatattacttggcaataaaaagacatgaagtagagatatatgtggcaatatgaatacactttcaacatgttcactggtatggacgctcggcgtg

SEQ ID NO: 516821 - DNA, 301 bp, Homo sapiens
gcagctgaacaagatccaattagaaatctggcacaaacttagctggcattggtggtaaagcttttaatacttcttacaatataccacagcgggatccaagtcccagtctgctgcccagattgcttggtgtaggagcaggctttagatacaactctatcctcagtgagcattatcccagggcaggcaaaggaccacatccaaaaagacgttatggcaaggcagcacctttcatttatagaatgggcagacatcgggggtatggtaatactcatcccaataaataagcaataagttaagcaac

SEQ ID NO: 516822 - DNA, 502 bp, Homo sapiens
gatgagcatagatgagaagaatatattcagtcacacactaatggatattcttactttctttgaaccttattatttccattctgggcaataagtggatggttataatctggccttataccttagctgttctcacagacatcaagtatttttccttcaggctttcaggctaattgaaaaactatctaacagtccttaaagaggccttcacttccataattctcagttggtgagcatctccctcttgttctgttgaagcagatactttcctgttgttaagcaaaatagtttattatttttctgaaatttcctggacttgccaataattacctgcttggagaatgtttttgtctggaatgtggcttttactctttttttatttttaactattgactgtttgttttttaatttttttttctttttttgagactaagtctctctctgttgcccaggctggagttgcagtggtgtgatcttggctcactgcagcttccacctcctgggt

SEQ ID NO: 516823 - DNA, 556 bp, Homo sapiens
  misc_feature (7)..(7): n is a, c, g, or t
  misc_feature (29)..(29): n is a, c, g, or t
  misc_feature (42)..(42): n is a, c, g, or t
  misc_feature (56)..(56): n is a, c, g, or t
  misc_feature (86)..(86): n is a, c, g, or t
  misc_feature (102)..(102): n is a, c, g, or t
  misc_feature (484)..(484): n is a, c, g, or t
ttgtacnagtgatatgacccccccctatnctttaaaagcccnccctctgagcaacngctcctccccctgtgtaagatgagaaagtnccctgtccctgttccntctcggctggtcacaggcagaagtgaatgaccatgagtgtgacaatgttttatgaacctatagtcttatacagtgatgagaactgttttcccaaatgatcctcattttaaaacactagctttcccagatgctaataaaatcttacttcattctcagtaaactatcgcaagaacaaaaaaccaaacaccgcatattctcactcacaggtgggaattgaacaatgagaacacgtggacacaggaagggggacatcacactctggggactgttgtggggtggggggaggggggagggatagctttaggagatatacctaatgctaaatgacgagttaaatgggcagcgcaccagcatggcacatgtatacatatgtaactaaacnctgcattgtgcacatgtaccctaaaacttaaaagtataataataataaaataaaattaaaggaaaaaataaa

SEQ ID NO: 516824 - DNA, 852 bp, Homo sapiens
cgtggtctggcccggagattttaggatgacgggctgcggaggaggaggttcccggatagccacgcgcagctggaacagctggcgacctgctgctggaggcccggagctgcctgcgtggtgctggcagagtgcgatgggaggttgcgggtaggaagggcggactgctgcgcgccccctgcgtcccgcgcacctcggggccggtccatgtctcccgacggctgctgggcttcagcatctggggccatggttggggcggcggtggtccagggcgcaagtgtggtgcgtgccgatgcgccgggccggaggctgatgccgcgctgcggggcttgggacagcacttggcatctccagagcaggcccggggcagcaagggaggcgcctgggatgccagacgaaaatatcttcctgttcgttgcccaagctcatcggtgagttgcttgcccacggccccgggccgaacgagagggcgagggggccttggcggggctcccttgatcctggccttgttctccccggcggtgccgttccaagggttattgcccgggattggtcttcgcatcatttcttttctacttcattgcccttgtggcccctcacgggctcctcctatctaccttgctcagcggcctggcttgtaccgctttcgaatggagcacgcctgctcggggctctttaatcaaggaacccggggtttggggccatgcttggacattgcttgacgggaccgcttgtccaacaatgtgcctgttgggtcaaccttggccctgcttgtaccctggagccaacgctggtcttccaaaatcagcattgagtttgggattgtggccaaggtcacttggcctgtaccttcca

SEQ ID NO: 516825 - DNA, 247 bp, Homo sapiens
tgccgctcagcctcccaagtatctgggattacaggagcctgcactacacacagctaattttttgtatttttagtagagatggggtttcaccatgtggccaggctggtttcaaactcctgacctcaagtgatccacccacactggcctcccaaagtgctaggatcacaggcatgagccactgtacccggcctcaaacaggtttttttaatgcagacataagtgccctattgaggtgggaggagaggaa

SEQ ID NO: 516826 - DNA, 124 bp, Homo sapiens
accagccggccctggagtggtgcgtggcggtgtacgccatctgcttcatcctagcggccatcgccatcctgctgaaccctggtgctgtctctgctgggaagagaatacactctttgcaccacca

SEQ ID NO: 516827 - DNA, 81 bp, Homo sapiens
  misc_feature (65)..(65): n is a, c, g, or t
  misc_feature (75)..(75): n is a, c, g, or t
caaccccttaccccaggccttgccactaggtaaccatgtgcgaccgaaagccgtgatcaaaaatncggacatgtnggaaga

SEQ ID NO: 516828 - DNA, 355 bp, Homo sapiens
tcaggtctgcacgggggggagaagatagcgtaggtatcatgaagagtagacagaaaagatcttgttaacagctaacatgttggacgacggctgtggactagtagctgattttagacgcatggtcgatcttcatggacgttaaggggcagtgagtgcgtatacgtcagcgtagtcataactgtctacagtctgtactaaccagtagcatattggcgaattctaagtacgatacaagggccctgacgaggtatggcaccaaacgatggtgtcagaataagatctcagcacagaggtatgagccaaaagaaacaggatatggtctgttcctttcaagcttcccacagggtgccaggag

SEQ ID NO: 516829 - DNA, 902 bp, Homo sapiens
gacctggcagtggtcctgtgcagatccctgagcgtgtggcagcagtgcggtcgtggtccctccctatgcatgctggtttctagcgtgacacgcccttgagttgaggaccatgaactcgcagacctgcaggtgacgtgcgtggactgggttccggcctgctggcgtgggcgcaatgagacatccttagcagaaaggtatgaggctgagtaatagcaagtaagtaagaaacgccctcatctggctgagggcgaagaggacgaaatgtgtcacgaacgcaaaggtgggtggctgtgagtggcgaggacacagtgagtccttcggaatgatggcatgctagagtgcagcgtggccctaggggacgcggcaatagagcccctggaggatggtgatcccgaggatgacaggactgcttgatgcatgatgagctgggtgagtacggactttatatgtcatctgatgaggaaggtgcatgccagattgctgagacttcttggtgaatctctctgggggatttgaacggtctaggggagtaatgatcaggatccttatgtgactctgacagcatacagaacactatgaacgtgaagattgttgatagacgccaagtgattatcgtatacgtctgtgcgagctgaacaaggacgagtgcattacgaggtgcatgttgtcatcgagaagaagactcttttatgtccgcatgattatcgtggttgtctccccgagtgtggagggttgagtgtctaagccagtagttggtggattcgtggtggggaaattgcccgcatggaggggcggaataacactgggaaggttgtcggaaatagagaaaaggaaacgtaggtcggggacaacggattgggaacaactaagaaacggacaacaaaaaaaggaaaacaaatggc

SEQ ID NO: 516830 - DNA, 651 bp, Homo sapiens
  misc_feature (372)..(372): n is a, c, g, or t
  misc_feature (421)..(421): n is a, c, g, or t
  misc_feature (428)..(428): n is a, c, g, or t
  misc_feature (442)..(442): n is a, c, g, or t
  misc_feature (448)..(449): n is a, c, g, or t
  misc_feature (457)..(457): n is a, c, g, or t
  misc_feature (467)..(467): n is a, c, g, or t
  misc_feature (482)..(482): n is a, c, g, or t
  misc_feature (494)..(494): n is a, c, g, or t
  misc_feature (516)..(516): n is a, c, g, or t
  misc_feature (527)..(527): n is a, c, g, or t
  misc_feature (531)..(531): n is a, c, g, or t
  misc_feature (543)..(543): n is a, c, g, or t
  misc_feature (573)..(573): n is a, c, g, or t
  misc_feature (586)..(586): n is a, c, g, or t
  misc_feature (600)..(600): n is a, c, g, or t
  misc_feature (615)..(615): n is a, c, g, or t
  misc_feature (640)..(640): n is a, c, g, or t
gaattcggcagaggttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaaagggggattctctgcctttttgtatcaaagaacaagcaaatggacccccgnccgctgcaagggcccatagccatcgggtctctaaagctgagtgggcaancagcgtntgtttgttggttgntttttnnttccgaangtgggaaagnaattcctcctccctncccaaccctgtngaatcaagtgcgactggaggantgggcaaaaancgtnatggaatgagtnaagatctggaggacctgggccaaggcaagncccatgctggggnaggtaaaggcaagngtaaagtaacgaggnttaaaggcaaaaaaaaaaaaaaccncaaaagttttt

SEQ ID NO: 516831 - DNA, 261 bp, Homo sapiens
tcccagcgctttgggaggccgaggcgggtggattccctaaggtcaggagttcaagtccagcctggccggcatagtgtagccccatctctgctaaaaatccattaattagccaggcgcagtggcgcacccctgtaatcccagctgctcgggaggctgagggaggagaattgcttgagcccgggagacagaggttgcagtgaagtcaagatcagaaacaaatgcaatacagaatgaacaacaaaagaaaaactgtccccaaca

SEQ ID NO: 516832 - DNA, 235 bp, Homo sapiens
ctaagtaccttctacatcccctgatatgtggttacttttgaatgtcctagacttgcaatatctgtcgtctgaaagctggaacagagaacaatgacgaagaacataatacagcaaaccacataacagacaacaaatgcgacatactctaagttccccttaaactacgtgtgtgttgattaggatcccgtgggtcgggttttgtagggatctgtgcagggttcaatgccttttctgt

SEQ ID NO: 516833 - DNA, 156 bp, Homo sapiens
cgtacaaggcccgccgtggaggtggcgcctgccggagtttcctacaatccatcctttgaagaccaccagaccctgctctcagctggcccacgaggtggagttgcagctggcagaagtgaggcggagaatgctggagcggcagtctggcccttgccc

SEQ ID NO: 516834 - DNA, 444 bp, Homo sapiens
ttttcgacctgtcgctgtatcggtgggcacagtgtggggcgaggtaaacctcccagaagtgcgagtcctgccgcagccctaggcgccgcggtggtggctgctatgtgcatcaccagacctcgtgtgctccggggcccaagcaacctggtcgatgggcagagctggcagctctcctgctctgtgggctctgacccgtctgatctccctagtccccgtgtctcaacctcaccttgtcctcccaagaaggttccacagagacttcggacctcctggagacaaggcaggtgtgctgaggggctgtgcaacgattgtcacccgagggcagcggggagggttcctcaagttttggcgggaaggcgtgcagcctgccccagcctgattgaaccctctgtttacacaaccttgctatggcccctttccctcttccgtgccagtcctccaggc

SEQ ID NO: 516835 - DNA, 990 bp, Homo sapiens
cgttactttgaaatcatgtgacatgtgagctgccggtgaagtaggcgggcatgaagcaagcacgacgagaatagcctatgggaacaacaagatgattaactgccaggaggtaactaagcaaagtcacgacaggtcccgacactacctcatcagcatttaaaaatttgcggttggggactggacgtcggagggctagatacgtacgatagtccgagctagtgcttgggacagatagttagcaagttcaattgcagagctgactatagtttcagatgagtatacgcggaataaactagtgaactcggaaaggagaagaagtttaacagtatgaagggataatatcgagtcgtcagatggctatttcataaatgtgccatattaaaaaaatagggtataacgaagcatcgatgatggatcaggacgatcgccgaataggaggcgaggccggctattaagaagggctcggttagtggcgcgatcacgaattaagagtcggatacggtgatcgtgaggttcatgacccgggaggtaaagtcaaaggtcgggggatcctaatcgtagttcaaaattccttccctgtacgacaatggacgtagatgaacatagacgggcaaacttccactagagcaggctttcctcgccgtggagatggatatcagtcctccaagattagtattataccgcgagaacccacaccaagaacaggggtttgtgtataacagagtgggcgagatgacacgggggaattcggcgtagggaaattaagagagattaacagggtcgagaggttcgaaggttcggttgttcatgtaacaagtatatccaatgggcaatactacctagatcctcatttgtacgccattcttagttagcaagtggaattcgtaaatgcaaacggaaggaagaatgtaggctaaattcaagtaggaaaggcgcaatgtggtaggccatagggtactaacagttagagaagaaaaagtataaaagagc

SEQ ID NO: 516836 - DNA, 411 bp, Homo sapiens
  misc_feature (161)..(161): n is a, c, g, or t
atctcagtcatgagctctgcttcgggtcatctattctcctgttcagcctctgagtagctggactacagcgccgcacacaccggtatttttgtatttttacgtacaggatgcggttcaccgtgttagccacgatggtctcgacctcctgacctcgtgatctngctacctcagccttccaaagtgctgggattacacagcatgtttcttataattaaaaatgtgatgccagaatttgagcttatgagatgaaggagatgtacttttccctattcctcctggtaagtacaactaaaaaccctggacattatatgtaaaatcaataactaggtaagaagattctgagaggtggagagaaggcagacaggaggctaggaacctcaacacacaagtaacaaaatgataaggagttcc

SEQ ID NO: 516837 - DNA, 657 bp, Homo sapiens
tgtacggtcgcgagtttgggatcgagatgctggtcatggcgctcgaacgtcctcctgctgctctcagcggcctggcccgtgaccgagaactgggcggctcccactccatgaggtatttctacacctccgtgtccggcccggcgcggggagccccgcttcatctcagtgggctacgtggacgacacgcagttcgtgaggttcgacagcgacgccgcgagtccgagagaggaggccgcgggcgccgtggatagagcaggaggggccggaatattgggaccggaacacacagatctgcaagaccaacacacagactgaccgagagagcctgcggaacctgcgcggtactacaaccagagcgaggccgggtctcacaccctccagaggatgtacggctgcgacgtggggccggacgggcgcctcctccgcgggcataccagttcgccctacgacgggcaaggattacatctgccctgaaccgaggacctgagctcctggaccgcggcggacaccgcggactcaagaatcacccagcgcaagtgggaggcgggcccgttgtggcaggaagcagctggagaacctacctggagggcacgtgcgttggagtggctccgagatacctggagaacgggaaggagacgctgcagcgccgcggacccc

SEQ ID NO: 516838 - DNA, 501 bp, Homo sapiens
agcatgcactttttggtagcagaatggaatgaaccctccctccacttttataaaaaaaaaggtgcttttgatttgtccagtgaaaagggttggagactgttcaagatcgccaaggagtacttgttaaaaatggccccaaaggagtgaggagtgctgctgtaaatcacacccccccttttattttagaataaattccccactttttttgctttttatgctgtttgtagtgaaataatagaatgagccccccttccaaagctttattaccagtggcgttgttgcatgttttaaataaggtttgtttaaagtggcaatttcaaatgcagtttggaaagtcagatttttttccttgaatatctttcgataaacaacaagggggggtgattttaaaaaatttgaaaaaaacttcattttcgtgagtcctttaaatgtgtccaaggtacccccggggacttaaagtttctgtttgattcttttttaaaaaaccactctttggtttta

SEQ ID NO: 516839 - DNA, 1199 bp, Homo sapiens
acaggtgtcgggaagactacccctaaagagccaagaatgggaaaggaaaagactcagtatcaacgattgtcagtcacttgagactacgctagtattcggggcacagtccacacacatactgcgccatcatgagtctataaggtgcgtgctggcagtcgacataaagaaccagttgaagagaacttatgacgacaggaggcgtgtctggaggaatgggtcaatcagtggcttccattctagagttcattgccatgaggctcattaggatcaagactgtaaagacatgcacgcgtgcaacggtgggtgagtcagacacatgtgtatatcatccgtgtgatggaaagattatgagacccagtgcaaggtacctagtggtggagcataatcactctcgagtgaccacacaagggagcacaatgaagcacattatagtcaacagagacactgaatatacacgtggaagcgatgctcgagagcatgagcctagtgcgatgatccgtggatgtctgttgcttgactgagctgtgttggttcgataccttgtgatacgagctggctactcgtccagaagaaatatggggcaagaaccactgcaagaagtctattgactcacattacatggggcctgtaaactagctaacgtaggagatggtggtaacaccaaacgttaaatttgtacacgaagatggttcaaacgatagagcatggggatttgcaccaacgtaggaggccctcaaccccctttgagcttagggctcccaagccagagaggcaaggattctatcgggagggggcaacataatttcgggtctccacctcgggcacaacggtcccgcatggcgcacttcttcacccattttccacaggcaacatacatgttcggggcctgcaccaaaacacacaccggaaaactaatgaagactccatggccccaattaagaggttagccgccaaaaaataatatacagatggcgacatccgggcggcaccgacatgggggcctggaagcaagaaagccagattctgccccgcgggcgtaaatgtgccccccaaaaactgacatggactttataaagccacagttggcacaccctatttttgtgcgcgctctccccacacacatggggtgccaagattgtcggcaaaacacacaggatttccaaaaccctccaccgagtgtacaaagggagggcaaccag

SEQ ID NO: 516840 - DNA, 216 bp, Homo sapiens
cttcagagggtatggcgcagcatcatgttgatgccatttcaaagagtgactctatttcagtctacgtactttccacgaatgtcaccatctctaacatggaaataatccttgtcatctcagaactactttggtgcctccatattctgggagaagaactttatctccaacttacacgctaactcctttaacctctccacccttatcacaacacaagaa

SEQ ID NO: 516841 - DNA, 177 bp, Homo sapiens
aggtgatgagaacaaagtggggaaacattgtaaactattgcccagcattgtaggacatagggtatttgccacaattgttggtcttaccttatgcttgagcttatagtgatgttcttgtgtcccctgtgtttttctagagtgattttttctatatgttgggattttcattggtgtcgc

SEQ ID NO: 516842 - DNA, 605 bp, Homo sapiens
  misc_feature (32)..(32): n is a, c, g, or t
  misc_feature (124)..(124): n is a, c, g, or t
  misc_feature (173)..(173): n is a, c, g, or t
  misc_feature (176)..(176): n is a, c, g, or t
  misc_feature (185)..(185): n is a, c, g, or t
  misc_feature (192)..(192): n is a, c, g, or t
  misc_feature (195)..(195): n is a, c, g, or t
  misc_feature (296)..(296): n is a, c, g, or t
  misc_feature (406)..(406): n is a, c, g, or t
  misc_feature (493)..(493): n is a, c, g, or t
cgaggagtcctagcgactctgcggaaatacantaaatacagcaaaaatatcctggaccggcaagatcctccctctgtggtggtcaccagccaccagccccaggagaaaagaagaaactgaagtncctggcctacgacttctacccagggaaaattgatgtgcactggactcgngcnggcgaggtncaggaanctnagttacggggagatgttcttcacaatggaaatggcacttaccagtcctgggtggtggtggcagtgccccgcaagacacaagccccctactcctgccacgtncagcacagcagccctggcccagccctccgtggtgccctgggaggccagctaggaagcaagggttggaggcaatgtgggatctcagacccagtagctgcccttcctgcctnatgtgggagctgaaccacagaaatcacagtcaatggattcacaaggcctgaggagcagtgtggggggacagacaggaggtggatttngagaccgaagactgggatgctgtcttgagtagactttgacccaaaaatcatctcacttgagccaccccacccattgtctaatctgtagaagtaataaataatcatcctcctt

SEQ ID NO: 516843 - DNA, 308 bp, Homo sapiens
gacagccggagatactacactggattagaacgatgagttaccagtcgaggtgtgggaaacacacggtagcaagtaattacaccaggcagagacatctacttttacatgagaataataataataaatacggtaaaggcaacaacatacaccagtagtataactacaacaataatgatggtaataatgacagcagcataacattaaactgagcatctacaaggtgccaggaactgtgataaatgctaagtacacctgatctaatataagcctcacattaacactgccatgcaaatactgcagctatctca

SEQ ID NO: 516844 - DNA, 400 bp, Homo sapiens
aggaaactcactctagattactagctcacaaccttagacacgaccattaccctaagtacgtgtaggcgatatggagaggaacctcgggcagtagacatagagaccggaggcatagatgcacaattataaccacgcctaatagatcgaggactaacccctgtaccttctgcgtatatggattaaccagaaataagcttgcaaggagagccaaagcttagacccccgccagacgagctacctaagaacagctcaaggaggctacaccctatatgtttccgaactatgggaagaatcattggtagagagtacgaacctaccgagcctggtgagagctggatgtgcaagattgagacctattttaactttgaatttgcccacagaaccctgtagtgcccttgtg

SEQ ID NO: 516845 - DNA, 237 bp, Homo sapiens
tagtcgtcgctaagcccatctgacttaaggactttgctattttaaatagaaatgtccacttaagagatttcatagttagaaatttcttagttagattcattgacttcctagcaatagtggtccctcttagagagcagcatcccatatatattaggacaagttataacaaagagaaatgaatttgagcaaaactgcatccattttgagaaactattttttattatgcatcactaaccc

SEQ ID NO: 516846 - DNA, 109 bp, Homo sapiens
gactgcactccagtctgtgtgacagagtgagactcgcctcaaaaagatttaggttgcaactgtttcaaagcatgttgcaggtatgtgtggtgtggaatacctattatta

SEQ ID NO: 516847 - DNA, 84 bp, Homo sapiens
agcagcatatatctctgcagcgttggggagtacgaccttgcctacgagcagtacttcgggccgggcaccaggctcacggtcaca

SEQ ID NO: 516848 - DNA, 216 bp, Homo sapiens
aaccgagctgtgtacctgaacattcgtgtcagacagcggagagatctagttatctgtgagactgaagagcctccttgtgaacgaactaatcctgaaagaagaactgacttgtgaagggcaaacagtttagttcaaggaaagcagaggttatgcaataccacagcaaacttcattcattgaagactgagctccaaccacgtcttaagagcgggaaga

SEQ ID NO: 516849 - DNA, 195 bp, Homo sapiens
ctgactataaagcaatctaacatgttcagtgttttcacctactaaaaaataacaccttacacagaaggggaggttggggcaacacaaagtacaacaaaaacaaattaaactaattgtactttttccacacacatcaagcacactaaggtgaggacacgggcctcaacacacagcaacttgtgcagcatagtcatg

SEQ ID NO: 516850 - DNA, 682 bp, Homo sapiens
ggacttgtgcgcccgggaaaccccgtcgttccctttcccctggctggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccactttcagccgagggctccaagagtgtggcccgccgggtcctccaaagccctggaggggctgaaaatggtggaaaaggaccaagatggcggccgcaaactgacacctcagggacaaagagatctggacagaatcgccggacaggtggcagctgccaacaagaagcattagaacaaagccatgctgggttaataaaattgcctcattcgtaaaaaaacaagaaaaaaaaagagaaatcggagagataattgtggaggatggagaaaaagggtggtaatagaagtggagttgtgcataaggtatactgaccatatttgtgagaagtgaaaaatggggaatcaaaaagg

SEQ ID NO: 516851 - DNA, 882 bp, Homo sapiens
ggcttctctcgccaggcgtcctcgtgcaagtgacatcgtcttaaaccctggtggaatccctgacgcaccgcggtgatgcccaggaagacagggcgacctggaggtccaactattccttaagatcatccacctatgtggatgataatccgaaatgttccatgtgtgggacgcagacaattgtgggctccaagcagattgcagcagatccgaatgtcccttcgcgggaaggctgtggtgctgattgggcaacaacaccatgatgcgcagggccatcgggggggcacctgaaaaacaaccagttctgacaaaaatgttggctcaatatcggggggaaactggtgggctgggttgtccacccagggagggacctctcaagtggaggattcaggggaacattgtcttggtggccacatagggtgcacacctttgttggcctgttgtttggttgcatttttggcccccattgtttgagaggttcacttggtggcaagcacaagaaaacgtgtctcgggcccagaggaagacctcctttcttcccagggctttgagtggtatcaccactaagattcctccggggcaccatttgaacatcctggagtgttgtgcagttgatcaggactggcacgacacatgtgacgagcaggacgccacgtgtggggcttgttcaaatctccctttttcttgtggctggccctcaggagggttcggccatggcggctttaaaccctgaagtgttgttccggggaactctgttcccgtctggggtgcccatgtccgtgctgttgcgattgtaccattgtgtcggcctctcatcgcgcaccggcggctttgggcggacctcctggaggggcctggcccattggggccctgtcacctcgtgca

SEQ ID NO: 516852 - DNA, 378 bp, Homo sapiens
  misc_feature (332)..(332): n is a, c, g, or t
cctgtccaacatggtgaaaccctgtctgtactaaaaatacaaaaattagccaggtatgatggcaggtgctgtaattcgagctactcggctgctgaggcaggagaattgcttgaacctgggaagcagaggttgcattgagccaagatcgtgtcactgcactctagcctggacagactcttggtctgtctcaaaaaaataaaaaataaataaaaattatccaggtgtggtcgtgcgcatctgtagtcccagctacttaggaggctgaggtggggacaatcactttgaacccggggaggcgggaggtttgcagttgagctgagattcgtggccantgcgcttcccagctttagggcaaccagagtgaggattctgttttca

SEQ ID NO: 516853 - DNA, 100 bp, Homo sapiens
  misc_feature (1)..(1): n is a, c, g, or t
nagctgaggtttatatatggaccaaaaaaaaaaagcaattgattggtttggtagctggaggcttgggcaaggggggtcccaggtagtaaactccccaggt

SEQ ID NO: 516854 - DNA, 844 bp, Homo sapiens
cccaactggatactaggatgacagcagatgcgagattacagtctatggacaatactttgctcgggtattctcttcacctcctctcagtgcttggcatggtcacacctatcagtgaccttcctggtgcatgatacaatcctcatatgtgagaagggagaatagaacttacctcggtgtgaaaagcttggccagaccgtgtacagacttgtatgacttgtcttgagagtgggcagcaccgtggacagagatacctatattctcagataagaataatgtaaggagtcaagaccatcattatgatagtaatttcccagaggcctatctttgtctgaagctacatgcctccaatttggtgaaagtcaatataataggagaagtggttgaccagggaagtaccaactttgaagattgaccatacaggattcaggccccatgctgctaatctattcaacgacgtcctgatgttgaaggtgtgtgatacactatccatacgccttgccaaacagcgagtctgtatcctccatgaaatgtgggatccttccagattgtctcaacgagtctcttcttctggggagatgtggcctattatgactaccaagggtcacttgaagaacaggaggagagtaattcaacggcataaggtgctgggaccaagttgtaaggtgctggtactccaggaatcgtggtgtggttgccttggagaagcctttaaggaggcgttcaggtatatatgaatgtgctatagcctgtgagattccgtgcatgccctatggtgccgggggggaaaagttcctgtactggattccggagtttgaggttccctaactggcccctgggaggggtg

SEQ ID NO: 516855 - DNA, 264 bp, Homo sapiens
ccaactgtggtggcttgtgcctgtaatcccagcattttgggaggccaaggcaggaggatccattgagtccaggagcttgagactggcctgggcaacagggaagaccctgtctctacaaaaaaattaaccaggtatgatggtgtgcgcctgtggtcccagctacttgcgaggctgaggggcgagcaccacacagaagtttggttgagcacagaagttcgaggctgcagtgagctgcaatcacgccactgcactccagcttgagca

SEQ ID NO: 516856 - DNA, 231 bp, Homo sapiens
ccttttggggggggcttttttaaacggggttttttggtttttccccccccggttcccccccaaagtttccagggggggttgggggggggtttttccccccccggggggggggccccttttcccctttttttggggcccccccccttttcccaaaaagggattttttgggggtttcccccccccctttttttttggggtttcttttaaaaaatccctttttttaaggggcca

SEQ ID NO: 516857 - DNA, 690 bp, Homo sapiens
  misc_feature (666)..(666): n is a, c, g, or t
  misc_feature (677)..(677): n is a, c, g, or t
gtcttgagactgtaggctgcaaaatgtttcgttgttacagctactgggctctatgaaggatgtggttcgccagagccagcagcatccagcattccgttggaacttcctgttgtaatgcaaatttctcaaggccccgctgacccagacttactgaacttcgaaaactatgtgggacggagcccagcaatctcgtgtttcgcgaaaccctccacgaatgtcagtaaaacttggaatcagacgtatgtaccttgtcaggttgactccgtactccatggattacccgtttctacaatggacagtttaagaaactaattttagaactgatatctaaagctacaatagtaggcattgtcctatatactatactaatcacccagtgatgacgaagttttctttgcaatgtacatgcgtagcatacgtggtagaacggatctgactccagtgctacaacatttcacttgtagatgtcatgtctctccatccgatgtctgtgatacgtttctgtcttttcggtgttttttgtacgaccttgacagtccagaggagtattgctgtagaatgatccccattcagggtttgatgtttttctgcatgattaccctgtagtaactggattttggggaaacagaccatgcagatgaagtgcctttctcaatacatctgtantactccaggtncactgctactaca

SEQ ID NO: 516858 - DNA, 134 bp, Homo sapiens
tgctgagataacagacgtgagacactgcacccagcctatttctgaagctggccgtgcacagtggctcacgcttgtaatcacagccctttgtgaggccgaggtgctgagataacactggcaggagatcgagatca

SEQ ID NO: 516859 - DNA, 148 bp, Homo sapiens
gggggggtttttttttttccccccccctttttccccgcgccccccgggggggggcccttttggggggggggggggggcccccatggggccccccccggggggggggggccccccccccaatttttttttaattaaatttggggggccc

SEQ ID NO: 516860 - DNA, 1707 bp, Homo sapiens
  misc_feature (547)..(547): n is a, c, g, or t
  misc_feature (661)..(661): n is a, c, g, or t
  misc_feature (722)..(722): n is a, c, g, or t
taaaaaggtccaaaatcttaattaattctcccgggtcccgcccccgccccaggggatgctggcaagggtcaccagggcctcagggtccaggggggtccagaagccgccgaagagagctggctccgggtcttccagggtccttccggaaccttctggcggctttgtagaaagatggggcgcagtcccgggctgggtggcaagataagacggtcctccgtggacaggctggccctgggacaagggctggagcatctgggtgtcccaagagggcggcagaagaagcggctctctccacagggggctattccagagatggggagataactctcctctttctgagataacaggtctccaagacactctcccgccggggtctggggacaaagaatctcacacacacacacgcggtgctcccctccgggtggggtctgagacagccactctgtgtggcgcgagaaaggcacaaatggggcaaagacaagtttggcgaggagctgttggggaggcagaaactgcggcacaagagaaggaggcccaggcgcacatncctgtgtgtgcccgcgtgttgtaaagaacacctgcggagtacttgtgagcaagtgtgcgcgtgttgtggtgtgggtcccccccccgcgagaaaagtgtaagcacaacacaaggncctctgcgacggacacaggggagccccccctgcggcccccaccaaagaggatgttgggggnctctccagaaaaaaatgtggcggaccagagaacgggggggtctgtgggccccgaagccgtgctcgtggacactcccgaggggataagacacacacgggggcgcgtggttcaacacgtgggggcacacgggacgtgtggtggctctcccacaagaacaagcgaacaaacacaaggggggggaatcccttaccagaaaacacttctcaagtgtataagggggcggggaccacaacaaacccctcattgttgggcggggaaccactctgagagtataatcaccaccgggtttgcaggggcgacccacgcaggaggttgcggcacccacaggatgtgggggggagacaacctcacccccgaggggggatcccccagcatgttcacccacaaattacctttctaccgggggccacacggctcccccacaaggaggagacgactatcgatataggcccgggacgataaatacacggggaaggcgcgagggccggggtgacaaaagctctcgtctgggcggtgatgttcgccccaccgtctggggaacaacaacatcatcagcacgcggggggtcgcacaccaaggcagtgggtgctccgaacaaaaataagaggctcccgtgtgctgtgtgatgacccaccggcgcagcccaccagaggtggcccgggggcacaaagaaacaacgagcgtggccccagagggagcgctcgggacaccctcgttggcggcccccagtgggggggcactaggactcccaggacgcgcgggccacgggcactccacgaaccacacgggggcgagaggcggcggccgcgaagaaaagacaagcgccgtagtttctcgcagaatgacaggaggagagagcatcccacaacactcgacgggagaggacggaacacgaaacgaaggacgccgcagagcgcagcagcgacacagccagtggagagccaccaagtgaggccgagagatgaactaggaaggggcatactgc

SEQ ID NO: 516861 - DNA, 882 bp, Homo sapiens
  misc_feature (13)..(13): n is a, c, g, or t
  misc_feature (64)..(64): n is a, c, g, or t
  misc_feature (116)..(116): n is a, c, g, or t
  misc_feature (130)..(130): n is a, c, g, or t
  misc_feature (167)..(167): n is a, c, g, or t
  misc_feature (174)..(174): n is a, c, g, or t
  misc_feature (176)..(176): n is a, c, g, or t
  misc_feature (181)..(181): n is a, c, g, or t
  misc_feature (235)..(236): n is a, c, g, or t
  misc_feature (240)..(240): n is a, c, g, or t
  misc_feature (276)..(276): n is a, c, g, or t
  misc_feature (279)..(279): n is a, c, g, or t
  misc_feature (284)..(286): n is a, c, g, or t
  misc_feature (290)..(290): n is a, c, g, or t
  misc_feature (304)..(304): n is a, c, g, or t
  misc_feature (310)..(310): n is a, c, g, or t
  misc_feature (314)..(314): n is a, c, g, or t
  misc_feature (316)..(316): n is a, c, g, or t
  misc_feature (318)..(318): n is a, c, g, or t
  misc_feature (335)..(335): n is a, c, g, or t
  misc_feature (339)..(339): n is a, c, g, or t
  misc_feature (347)..(347): n is a, c, g, or t
  misc_feature (353)..(353): n is a, c, g, or t
  misc_feature (364)..(364): n is a, c, g, or t
  misc_feature (381)..(381): n is a, c, g, or t
  misc_feature (438)..(438): n is a, c, g, or t
  misc_feature (455)..(455): n is a, c, g, or t
  misc_feature (465)..(465): n is a, c, g, or t
  misc_feature (478)..(478): n is a, c, g, or t
  misc_feature (507)..(507): n is a, c, g, or t
  misc_feature (537)..(537): n is a, c, g, or t
  misc_feature (542)..(542): n is a, c, g, or t
  misc_feature (546)..(546): n is a, c, g, or t
  misc_feature (578)..(578): n is a, c, g, or t
  misc_feature (808)..(808): n is a, c, g, or t
  misc_feature (855)..(855): n is a, c, g, or t
tactcttagtacntccacaactatttccacctaaatagatctttaaaataagcatacacaagtnttgactattatctacaaatatttattgtaacacttgaatagaactacaggangcccttggcactgntggggagaatattgattgcactgttaggttacacaantttatananagcgnaatttaatgctctttacataaaagatattagactacttaaacaaaactttcaannattnctggtaatagctaccagaattagaaaagtaaaattnggnttttnnntctncctcttctagttcnctggtntctntntnctcctccactgctgganagantagttaantctgtnatgcaacaggntaacaaaacactaagcnattattgggacaactgttctacacagaagagagctatctcttaatttaggggggagngaaaatcccgggtgggngtttttgggngttagccaaaagngggggtccgggtggggtgttgtgcttggngttcggttttggtggcttcttggtaagggnttgcntccnttcgtttgggtacatttctgcgcatgtgtgtnatggggtccaggaaacagccaaaccacaagttaactcttaacaatgaatatacatagttaaccctatagtaagcagcccctttgaaaagcactgatgcacccaacagttatatggatcatttcataaagagcaacacaaagtttaccatcactaatacccagtacctacagtcacttaatgttctggaacacaataatgtaaaaggcaagtttcttttgaaaatggcttnaactcaagcagttctcttgctgaacatcaaactttattattccaggnaactaagatttagataagaaaaaaatg

SEQ ID NO: 516862 - DNA, 123 bp, Homo sapiens
gtgcatgtattatcggaatagctcttctggatgtagctgagagtgtaacctgctcatgtacccacaaggacaggtgtgagtgcccatgtttcgggccggtgtgataaagagctacctgagtgg

SEQ ID NO: 516863 - DNA, 306 bp, Homo sapiens
atccaccctatcacctgtgtcgtataactcacacctgtgttcaacaagccttctccccacctggagctgctgtcaggaagccagggcgctggctgttcctggaggtccgtcctttccatcctggtcccttctccaggacgagagcacccatacagcatctccactggtagaggggttggttcctaggctccctatccagcgcgcagatgcagccaaaaggcacccatcttctacactagagagctagacccataccactcaagggccccctagaatccttcaatcccatactactagctctagact

SEQ ID NO: 516864 - DNA, 267 bp, Homo sapiens
ctactgctgcgcagcatataagctatgggtctcactgaatctaagacatttgtcttcaagccagcgaaacgaaagcctgtggtgaagggatttgcgtgctggcactgcagactgcaggcaggaagggctagggccaggcgctgggacatgcatgaggtgctcggaggagcctggctaaatccaagcaccagcacctgtgagtctgctctcttctcagctggctcccaagtaaacctgtagctttgcctcttctcccagctctcgtgc

SEQ ID NO: 516865 - DNA, 208 bp, Homo sapiens
gagaatcgcttgaacccacaaggcagaagttgcagtgagccaagatcctgccactgcactccagcctggatgacagtggagactccgcctcaaacaaacaaaaaaagactctgagaattcttgactcactaattacacacttatgtgtctaaaggactaggacagagctattcattactgtggtacacgtaaatgacttttctcatga

SEQ ID NO: 516866 - DNA, 478 bp, Homo sapiens
  misc_feature (30)..(30): n is a, c, g, or t
  misc_feature (37)..(37): n is a, c, g, or t
  misc_feature (128)..(128): n is a, c, g, or t
  misc_feature (176)..(176): n is a, c, g, or t
  misc_feature (233)..(233): n is a, c, g, or t
  misc_feature (239)..(239): n is a, c, g, or t
  misc_feature (277)..(277): n is a, c, g, or t
  misc_feature (344)..(344): n is a, c, g, or t
  misc_feature (376)..(376): n is a, c, g, or t
  misc_feature (406)..(406): n is a, c, g, or t
gtcgccttgaagtaccctgagctctgtganagtctgnccccagaggctgtccgtgtgcaccattggaagttggctaccctggtgtcctctctagtcggataaaagtatgggcgagtggtcatgttctncaacattgagaactggaaaagtcaagaaatcaccttggatgagatctngaaggcatattgcttcatcctggagaagctgctggagaatgaggaaactcaaatcantggctnctgcatcattgagaactccaagggctttaccatgcagnaggctgttagtctccggactccagttctcaggaagatggtggacatgctccaggattccttcccagnccggttcaaagccatccacttcatccaccagncatggtcttcaccacgacctacaatgtggncaaggccttcttggaggaggaaagttgtttgagagggttttgggccacggggatgacctccttggttcttcc

SEQ ID NO: 516867 - DNA, 346 bp, Homo sapiens
  misc_feature (332)..(332): n is a, c, g, or t
gtgttaaaatctgtgccttcattaattttcagtgcaaaacaaatccgcttgcggaaacatctgctgttgcctgatagttgctttccttcacctcccttgctttcagaggcagctaagttccacgttgccactgaaggataatccccctgcatactccatgatcgcagtgaataaaaaatgttttctgatagtgtcacggcatgaggccacaaaatgtatgaataactgggcagtctccagttacaaaaaataaaatgatgctaattcttaaatgaagttatgaccagcatgaataaagcccacaagatccaaaaatgtcaatttggtcaggnctactctcacattt

SEQ ID NO: 516868 - DNA, 295 bp, Homo sapiens
  misc_feature (52)..(52): n is a, c, g, or t
ctctagagatcccgtatgtatcccaaactatttaatatactacctacgaatngcttctacatcatcatgccactttagtgtgctttggtttagtctctctttggatgccaaaaaacaatcagatgcctcccctgttctgagccattaaaagccaggaatcaaccccattgggaggagaaaccaccccagcatcattccccttcactgacagctatttccattggctcaataaaaattaattctcccacctctcctcacttctttattggcggtgtgttggcgcgataacatacgc

SEQ ID NO: 516869 - DNA, 790 bp, Homo sapiens
  misc_feature (164)..(164): n is a, c, g, or t
  misc_feature (175)..(175): n is a, c, g, or t
  misc_feature (184)..(184): n is a, c, g, or t
  misc_feature (214)..(214): n is a, c, g, or t
  misc_feature (276)..(276): n is a, c, g, or t
  misc_feature (278)..(278): n is a, c, g, or t
  misc_feature (286)..(286): n is a, c, g, or t
  misc_feature (290)..(290): n is a, c, g, or t
cagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagccggcgnagggcggtggnagcggcggnggcgggggcctcaggaggtctaacagcgcncccctgatccacggcctcaatgacacttcgccggtgttccaggccgaggcgccgagcgccangnggaacagnacancgttcccgagccgccacgtgcactgtctggctgaccgagtcgctccgcctgttcctgcatgtcacagtgaggtcgacttgacaccagcatcaacacagagaatgagggcatggtgcttgatcaaccgagagacggtccacgcaacggtgaggtgctatgacctgcagagtgctacgattaagcctacgtcctgaggaggcacaacgtttcatagcctgggatgacaacagacgtggtagaaatcctgccttcccccataggcgcatctgattacatatccgttgtgtcacctagctacctgtcatcccagctcggggcaattggagaagccagtgtttggcagcacatccgttgctacaagaatcgtaaggtagcaacggattgccttctcaagctcctattccacatgcccgaacgacgcgcgatttaccacgccggatgaatgccagaggccccatcaagttgcattagaccaagtgttcttggaccattgacaagaa

SEQ ID NO: 516870 - DNA, 476 bp, Homo sapiens
  misc_feature (164)..(164): n is a, c, g, or t
  misc_feature (175)..(175): n is a, c, g, or t
  misc_feature (184)..(184): n is a, c, g, or t
  misc_feature (214)..(214): n is a, c, g, or t
  misc_feature (276)..(276): n is a, c, g, or t
  misc_feature (278)..(278): n is a, c, g, or t
  misc_feature (286)..(286): n is a, c, g, or t
  misc_feature (290)..(290): n is a, c, g, or t
  misc_feature (333)..(334): n is a, c, g, or t
  misc_feature (345)..(345): n is a, c, g, or t
  misc_feature (348)..(348): n is a, c, g, or t
  misc_feature (398)..(398): n is a, c, g, or t
  misc_feature (408)..(408): n is a, c, g, or t
  misc_feature (460)..(460): n is a, c, g, or t
cagattctcggtggcggcggcagcggcggcggccctggactgcggggaatgggaatcctaggtccctgactgagcacctcccccgcctccctgcccccgacatggctcaggagaagatggagctagacctggagctgcctccgggtacgggcgggagccggcgnagggcggtggnagcggcggnggcgggggcctcaggaggtctaacagcgcncccctgatccacggcctcaatgacacttcgccggtgttccaggccgaggcgccgagcgccangnggaacagnacancgttcccgagccgccacggcctgctgctgccggcctcccctgnncgcagcacagnagncgcttgcaccaaaacaaacaagaaaagggcaagagaacttgaatacaacngaagaagaanggtccacgaacggagagggtgcagacccgcaaatgcagaaaaagccactccntgggaaggaaaagatt

SEQ ID NO: 516871 - DNA, 289 bp, Homo sapiens
  misc_feature (14)..(14): n is a, c, g, or t
aagtcttgctctgncttgccccaggctgaaagaagcagtggcatgatctcagctcactgcagcccttcacccccccgggttcctagtgatcctcctgtctctgccctcctgagtagctgggactacaagtgtgtgccatcacacctagctaattttgtgtttttagtagagacggagtttcaccgtattggccaggctggtcttgaactcctgacttcaggtgagccacccaccttggcctcacaaagtgctgggattacaggcgtgaatcaccgtgcccaacctctag

SEQ ID NO: 516872 - DNA, 201 bp, Homo sapiens
tccttacctactcacattcacgacggtcatcttgtgtgtggtggctgtagtttctccctttgtgaatgatagcgacgtggcgtggttttttggaccttattaggagaattcacttgctttgctttgattcattaattttggacttgctcattcattattgaagccttttgactcgttgattcattaggccctgtgaccttg

SEQ ID NO: 516873 - DNA, 535 bp, Homo sapiens
tatcttgttttgccttcctggtttactaggtaagaagtgtttcttatgctgcagggtacaaatctcccagttatttataagtcgatactcactgtactctctgacctcacactgagttctgaccatgagctttgaaagaccacctctgggagtacatggcctcatgctgtctgcacattcatgtggctatcctccaaggcagaaaagctgtgacccagtagctcctaaaccacttctttcttacttactggtggaaaagttttaattgtatgccatttttcattgcaaagaagtggggtttcagccaaatttaaggaaaatatgattttttggggccaaactgatttatttgtgctatagctataaattttactttaggccttcagccctgaaaagaatggctttaatttgcctttttagtatctaaatcacttaagagtttcatttgccataatctttagatctacattatatttaccatagatgggactgtagaggaaagggcggccgctgttctagatcgcgagcggccgct

SEQ ID NO: 516874 - DNA, 565 bp, Homo sapiens
gaaaattgcaccatgatttgaacaagcacttccaattacattacccatcttgtatgccataggtgggagtataattgtcacagcctttaggaatgtagttttctgggatttattgaaactttgaaccttttggcctactaagttcattcctaggaaactgcctaatgggaatgatctgacaagtgtacacaagcaaagtcattgcacctttgttctttaatacttaaaactagcccaaatgccctgtcagtaagggactggtttaatagatggtacctttatgcaatttgtttctaagtattcgttaagagagtgaggaatgtctggattattagggcaagatttctaaacttgggtaaaaaaaaaagttgtgcaagcatttttgtggacaacttgatgctctaaaatataagtaacaccacattactaacagtggctttgttaggaagcagaattatggaagaactttcatgggtggctttacatatttctataatgttttaattttctataagcatgtatttcgtaaacttaaataaagaaaaaagaacactaaaaaaaaaaa

SEQ ID NO: 516875 - DNA, 193 bp, Homo sapiens
cccagacatcttttgctttgtactgtgtatggaacagttaggtatgaaaattaactgtagaacagcagtagttagactttaatagcatatctggtcatctctttctctcatcacatcacagtctgagtacaggtagcaaatcctctttggctctgccccgtcaggaacaggggttagcgaattatggccccca

SEQ ID NO: 516876 - DNA, 315 bp, Homo sapiens
  misc_feature (16)..(16): n is a, c, g, or t
  misc_feature (55)..(55): n is a, c, g, or t
  misc_feature (76)..(76): n is a, c, g, or t
  misc_feature (88)..(88): n is a, c, g, or t
  misc_feature (310)..(310): n is a, c, g, or t
  misc_feature (312)..(313): n is a, c, g, or t
taggaagattaagtgnaaaccctggggatcacatggtccagggtgagatacagtnggaatatgaaacccaatgtantgacccttcccncctttaaactttatccctatttgctggtctttatcaatactttcagtttgaatgtggttaaactggaatctacactaaagaatctggtggatggtgagacggctcagaatacaccagcatttggatgttctgcaagtaaaatgagatatgttttatgtcatcattgatgtttttctactagtggtgatttattttgctctcattctgatgataattaatatnannca

SEQ ID NO: 516877 - DNA, 979 bp, Homo sapiens
ctaaatattcttcagaccataatagtatgtccatataaatgccagtagcaagagtagaatcaaccacaactgccttagtaattatttaaagcatgtctgcctataagtaattggcattttatataatcaagaatctttgatataataatctctcaactatttgaaacacggctcacatgtattaattttttaagcaaatatatatataatatcagtgtatatgaaactgaattttggactttagaacagcttcttagaatcctgacttaaatgtctacagtaatagttggcttaaaaaaatttagcacactgtcactatgatgaaaaaaattactataaaatatttaaaaattttttccaccctaacatttagaatattctcacatttgtggttaaaacctattgtgattgttcttagaatttagataaaaaatgtcccagaaagattgaagagaagcactttagtcaatttttagttgttgaagcatgaagaaatggcatttcattgacattttaaaaattattcagattccctctttgaattcaagaatttcaaagatatcttattttaaaataccaaaataggaatagaatatgaaggggtggttatgagtaatatgatacaattttatgagatgatgagattcataacatactctctattgaatagaccggcagtctccctaaataacaggcctgcaatttatagcaaggttccacccagggcactgagctacggtgcaacccctggtgtgacccgggcttttacgaactttctaaacttcacgcttgaaaagttgacactgccgtccccagttagggcggaccacaaaccgctgcaaatgctcaaccgtctccacaccacacggcacaatatcggatcacaagagacaccctcgcacccgctgccacgaacaacgcgacacacaccagccgacagatcgtgcacctgcaagatctattttattcttctctctgt

SEQ ID NO: 516878 - DNA, 326 bp, Homo sapiens
atcaggtctgtaatcccacgcacttttagaggcgaggcgggcggatcacgaggtcaggagttcaaggccagcctggcaacacggggaaaccccgtctctactaaaaagacaaaaattagctgggtgtggtggcaggtgcctgtaatcccagttactcgggaggccgaggcctgcgaatggcttgaacccgggaggcagaggttgcagcgaaccaagatcatgccattgcactccagcctggggaacagagcgagactctgtctccaaaactaaaactaaaactaaaataaaataaaaaaagcttctttagacctgagcaagccagg

SEQ ID NO: 516879 - DNA, 1254 bp, Homo sapiens
  misc_feature (73)..(73): n is a, c, g, or t
  misc_feature (724)..(724): n is a, c, g, or t
  misc_feature (862)..(862): n is a, c, g, or t
  misc_feature (1106)..(1106): n is a, c, g, or t
tgggacagattcagttctccaggacatgagtctaacttcagcagctgttgaacaaattacgccccgccctgantttcagcgggcagcaggctgcagacacacgaattgccgtgacatcaccgcacagatctgcacgaccgcagccgacctgccagctaggcgatgagcagtcaaaaagcagacaaaaacaacaacgactagcaagacaccctaccagctacagacacctaacgctacgtgccgctgcgcctgacgggtacactcgacggcatgatcactgtagatcacacgctcgcccgtctgacaccgcgcgcaccgtcgaagctgactacaccgcgtgaacaagtctgagcagcacgctcggagcgtcggcggtcgtgtgtcggcgtgtttcgcggacgtggtcgtctccgcggtgcgcggcgcgtgcgcgcggccgtcgcggcgctgcgtctcgcgcccgggtgcgcgggcttgctgggcgtggtggggcgtggccagcgccagggacgccgcggcgggtggcgtcgtgctcgtctgtgtccgtcgtgcggctttcatactactcgtcgctccgcgtcgtcgagtctgctctcgtccgttgtggtcggcgcggcggagagtgtcgcgtgcgggcgcggcagctcgctgtcgtcgctcgcggtcgtctctctctctgttcgcgtcgtgagcgctgcgcggacgcacgcgcgtgcgcgtcgantcggtcctgcggccctgccttgtctgtactactgtgccgatggagtgctgatgtcgccgctatccgcttgctcgccgtcggtgtctcggcgtccgccggcacacaggagctacggcactggcgcacgcgactcagtcncgagaggctcagcgctggcactcgacagctgtccgacgacactcgggactctgtctcgcgagcctcgctgctcggagtgtcgcgagtcgatgatgggtggagcacgtagagttcacgctcaagacggtgagcctcggtgttcgagcgtcgacgcgatctgatgcgcgttgcctgttacgcgagtcgtccacaggcgctgttctgtcggtagcgagtgtgggcgcggtcaggcggtctgtccgtncgcagtgtgcgtcgtgactgtgtcgcctgcggcgcgcgtcgtcgatcgctctcggacttgatcgagctcgtcacctcctgctgatcacatgcgatgagcgcttcgctcggtggctcgctgcagtcgcggcctgtctgtcgtcgtctct

SEQ ID NO: 516880 - DNA, 356 bp, Homo sapiens
gaggctgctcttgaggatcccctgttggcgacgtagtcggagtactgcgctggaagcaggagagggagaatgatcgaccaggagcggctgcagaggaagcgcaaggcccactggccagtgtaggcgcgagtgggatgccgagaagaccgatgggatgttcacggatggcccagtccctgcccatgaaccatcccaccgctatgatgaccaggcctgggcccgcgcccccgaagccccccaactttttggggagttcctgtcccagcacaaagctgaggccagcagccggagaaggagaaagagcagtcggccccaggccaaaggcagcgccccggggcctacaggtgaccattgag

SEQ ID NO: 516881 - DNA, 200 bp, Homo sapiens
cagacatgaagtggatctgatagggaggctgcattgctatacagatgcaattgaagaatatttactcatgttccaccgagtggtgtgcgggggaggaagcactcttacttgtggcttataaagaatgtcacaaagctgtgatgaggtgcagaaccagttacatatctagtagcaagacagtagtacaacctgccggtggg

SEQ ID NO: 516882 - DNA, 140 bp, Homo sapiens
gggcagtgaatcaactcggtacccgtcttcatttccatgcggtgcactttatgcggacacttcctacaggtagcgttgaccctaattttggtcgtcgggtacgcaatcgccgccagttaaatagcttgcaaaatacgtgg

SEQ ID NO: 516883 - DNA, 317 bp, Homo sapiens
ccccccccccttgttgggggccccaataaacccccaggggggttttcaagggggggggcccaaatttaaaggaaaaacccccttccgggggaatttccccggggtaaaaaagggggggtttttttggggttgtcccgggattcttttaccccctttccctttcccccccaggtttttggggggggaaacccaattttttgaaaacccttttttgggggttttaaagtttcctttgtttcccccctttaatttggggggccaaattttaaccctttttttaagggtttgttccccttttttttttttttcccccccca

SEQ ID NO: 516884 - DNA, 100 bp, Homo sapiens
ggtagacgagaactggagaggcggagactgtggggcagatggggcggctgcctccctgcctcctgaggtgtgcggccgcgggtagctgtagtcctcgagc

SEQ ID NO: 516885 - DNA, 181 bp, Homo sapiens
ttacaggtctcaggagtgtgaggggagcacagtgggagaaacccaccagcatcaccacccgatgcttatctttagagtcaggatgctgggtccagatcctgattccatcttcattacaagattagaggagctagggtccaggccatggatccatgcttaattctgaactcacggaacgtct

SEQ ID NO: 516886 - DNA, 485 bp, Homo sapiens
agatacgtcagaatggctttatcagacacacacaagctctctgatagacccggattggaagagcagacacagtgtgcacactggtgctgtgtacctctcagcaccatgatgatcccaaagcaacaagtgtgtttagtacgcgtgttagaaagaaaaggctggacctggctgatgatgttgaattgactgctagttctgggtggtgtaaacaattcaagaatcgttattcatcacataatgggaaagtggtgagttggtgagtgctgatgtaaaggcagcggatgaatattgggaagctctagattagctgaatctggaggaaaagtcagttgccatgaacacaatatcgatatggatcaaacctttctattctggaaacagatgcctgataggactttgatccatgaggtagaccagagcaatgccaggcttcaagtcttttacggcctggatgaccgtcttgcttgggggcaagggtgcaggcc

SEQ ID NO: 516887 - DNA, 147 bp, Homo sapiens
acacgctttgcattacctccctaaaggaggaaacacccataaaatttaccttatggaatccaatatggagtgcaaatattaaatgaggagatgttttagaaagcaggaaaaatctacctacctatttcacaatcggggtaccgagct

SEQ ID NO: 516888 - DNA, 815 bp, Homo sapiens
  misc_feature (221)..(221): n is a, c, g, or t
  misc_feature (573)..(573): n is a, c, g, or t
ttgcacgaagcctataattcgcgttgtcattatgggttgccccccgtcgttgttccggaattaccagcgcggtagttgtttggtctgggccacgctctttgttagtctattagtcattagggagagagatattcggacgatgctctgtttcaaagaaaggaccccttctatgtttaggcgagcgacaccagccatcaattcactgaggcacagcctcattntgtggagtggcgtcgccgcaccaaaatttggggagacagagaagagcttgcccaacgcacacacgcacggtgggaatatctcacgtaggtgagaaaagaaggagcaatgtttttctgcggacaccacatgtgaactaagctcgcaggtactggcagttttctaccgcgcgcacaccgtggcaccgcttatgtgtggcgtcgtgcaacacaaatccacgcacgcggggagttatatcttccacggaggtacgcacgtgtgcacagcatctttcgtgtaccggtagatagaacacgttgggcgcgtgcaacacgcgcgtttcccttcgtgagaaaataaacaacacggtgctgntctaagtgccccactgttctagggagcaattaaaacaacttgtttcggggacaccgctcgactagaagatgtgtacgcgcccgggagctatgggcggccacaggaggtcccgctttatgacaagaatagatagaatcttttttaaaactaggggatggggatagcacaagcagataacgcaaaagtagtcaaataatgaccttgcaacaagcgacacccggcagtgtgagacaaatgaaaca

SEQ ID NO: 516889 - DNA, 317 bp, Homo sapiens
  misc_feature (162)..(162): n is a, c, g, or t
  misc_feature (247)..(247): n is a, c, g, or t
ttggcgccagtactcaggccagaagccccttgtgccctgctctcaggtaggcctggaaaagggcaacagtgcctctctgcagcatgaagcccccctgagcaaacagggcctagcaactcctgcccaggtagcggaatgtggcccaagcagaagggggaattngggaggtagcggggatcagcccctgtgctggggacccctagctctttgacacttcgggagcctgcatccccctaagccaagactntgcgcaggcagcacgtgcttaagccagacgagggacagcatgagagttcccctactttttcccccaggga

SEQ ID NO: 516890 - DNA, 163 bp, Homo sapiens
agtacgcaatgctttcttacagtaagcaagagctcctctgtaatccttctcgttgaaggaaatgcaagctttaccaagaagggctggaatattattcggagactgattgagtacaaaatgaaactgtgcgtcagcttgatccattttgtcaccctcaagtagg

SEQ ID NO: 516891 - DNA, 157 bp, Homo sapiens
tgatgttatccccaacacccaccggcacacagagtacaaccctgacacccatcaccaccaccactacggtgaccccaaccccaacacccaccgtgcacacagaccccaacaacgacacccatcagcaccaccaccaccgtgttgggcgataacatca

SEQ ID NO: 516892 - DNA, 886 bp, Homo sapiens
  misc_feature (1)..(1): n is a, c, g, or t
  misc_feature (332)..(332): n is a, c, g, or t
ncaagaacaaagaagaaagaaactagtaatacaagtacttttgtactaactcctttgtcgacgatggttaaggccggttggttctcgcccatacgtgttcatcggtgctcatcagacacttgcttgtgatatttgcgtcacgaggtttgtgaatccggataaactccgaaatgatgttgggataacaccgccggtttcacccggggacattcacttttcgcctagaccccgggaattccgcctggggccaaatttacttggaatgggcaggcataggcactgatgtttggggtttccgctcactaccacgctgatttttgaggcctcccccnaagtttcctcactagcattctcaggctagccctggaaaaactaactgggatatgaaacctcagccaagataaccccttgaggggttcaattcagcatataaatagttacttcagccagtgaacagtcccacgaggttgctctgtaatcctcatcgtagttctattacgaacatcatagacctaggagccgcccctaaagaaccctataaatttggggtctcgaagggaaggacagactgtatgaagccagctaacaatgataatatgagctttcaagtcagaagattttggcatgcccgtagctattttataccgggtggcaaaacctgggcatcccattagatgaatgggaaaatgtgtatagaccatcaaggcaacgaacccagtagaaaggggattatctacaggctaaagtgactccttagctttcctttgtctctgtcgtgtctctcttttatctatacctttaaacttctgggatccatgtacagcacgtgcagctttgttgcatgggtatacatgtatcccagcacttaaagtataatacaaaaaaa

SEQ ID NO: 516893 - DNA, 514 bp, Homo sapiens
  misc_feature (22)..(22): n is a, c, g, or t
  misc_feature (445)..(445): n is a, c, g, or t
  misc_feature (480)..(480): n is a, c, g, or t
  misc_feature (484)..(484): n is a, c, g, or t
  misc_feature (493)..(493): n is a, c, g, or t
tgcgtgcgggtgatcagaggancccctcaacgcttatacttcctcaacgcttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcatttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 516894 - DNA, 295 bp, Homo sapiens
  misc_feature (11)..(11): n is a, c, g, or t
  misc_feature (21)..(21): n is a, c, g, or t
  misc_feature (71)..(71): n is a, c, g, or t
  misc_feature (114)..(114): n is a, c, g, or t
  misc_feature (117)..(117): n is a, c, g, or t
  misc_feature (185)..(185): n is a, c, g, or t
  misc_feature (255)..(256): n is a, c, g, or t
attgtgggagnatgtgtatcnaactgctatacctcctttttaatttcgccttgcctgctcattctactcancctccaatacagaaagccctcccttatttagttctgtttacgncanaaaggaactgggcgggtacggtggctcaccctgtaatcccagcacttagagaggctaaggtgggtggntcacctgaggtcgggagttcgagaccaaactcaggcctggcaacatggagaaccccatctctactaaaanncaaaattagctgggcgtggtggacacacctttaatccca

SEQ ID NO: 516895 - DNA, 285 bp, Homo sapiens
  misc_feature (88)..(88): n is a, c, g, or t
ccccccagggggtgtttccccccccccccccttttaggggggggggccccccccagggggggggggcccccccctttttggttttttnttttttgggggggggaaccccccccccccccccccccggggggggggggggggggggggggcccttttttaccccccccccccccccccccgggggggggcaccgggggggggggggtttttttccccccccccttttttttggggggggggggggtttcccccccccttttttaacctggttttttttttttttta

SEQ ID NO: 516896 - DNA, 565 bp, Homo sapiens
  misc_feature (28)..(29): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttcctcaacgctttatacttctcaacgctttatacttcctcaacgctttatacttcctcaacgctttatacttcctcaacgctttatacttcctcaacgctttatactttctcaacgctttatactttctcaacgctttatacttcctcaacgctttatacttcataccggaaatgaaatgactcaacgcttctcatttcatttcccggtatgaagtataaagcgttgag

SEQ ID NO: 516897 - DNA, 177 bp, Homo sapiens
cgatctcatagacggatccccggtgttcatcggactactctgtttactaggacgttccccgtatgatctcataccaaacgttagccgggtctaactgtcactcagatgataatctgacgacaacctggtatcaacaaatgggtgacgttgtcacagtgatgaataactaccagtatg

SEQ ID NO: 516898 - DNA, 1582 bp, Homo sapiens
  misc_feature (398)..(398): n is a, c, g, or t
  misc_feature (1360)..(1360): n is a, c, g, or t
  misc_feature (1457)..(1457): n is a, c, g, or t
aatggatcgagtgtggcggattctgtgatgtatgctatgcagttttggggggccctatcgatgaccaggaggctcttggtcgcgtctcgagactccagtaggctcgaagatcggcctcagtaatctcagcatgtctatgtctgtgactcgacacgtatctcacagcaagtggatgtgagaagtcgctcgtacactacagatagttgaccgtagacgcatactattcctggacgtcaaggggactgcgatcttctcacatggtatctaagtgagcagagtgcttgctcacgatgcatattagtacttcctggcggtctgactgtacggcatgactcaattagcaatcacttgcacatcatgtccgaatcgagtacataatatactccatgagatgtggnctgactcacgtcaacttacataccatagggtacatctggcgcccctttgcaactatcgtgtagatcaccagaggtaatgtcacaatggggagaatgctctgggaaaagtacacgggcttgggcataggcgtcactgcactattgaggacaacatattaggccttataaatcctctatatgtctagtgagtactcaagacttacttctccacttctaacttaacggcgttgtatggggcctatttttggctacaagcgtcgtggttcgacctactgtatagcgcggtcagtcgtcctggacccgtttgtagcgacgtgtctttaaccttcatgaaacgcgacaagttggaacggtaatttagccttcttaggggcataatctcgccttcagggttcactggccccattagggccttgcaactaaaatacaggcggaaatgactaactcagggaagaattacccgttacccaattggaggcgagtaccgggccatttcttatcctactttaattacctcatatgccattaagtttaccaacgcaggattttcgcctatttagggtcgcacatatggaatgttttggcaagaaggggccatttgagtctcccttaatcagtatatgattattcagcatagcagtgtgtacaacaaatatggctaggagagggaggaaaaaaggcggcggtagtgaatgtcaccacacaggagcacttactatatattgacagaatggaaggaggagtatagccccaacggttatgagaggttatagtagtgaccgcagcggtgtggcacattttgacgggctgttatcagcaaacgaaccgcgttttatcaccacgcggtgatgttagtacccacagcccaccatgttgagcgaggtaaaatacgagggcgaagagtacatccatttaaagataagtaacccatttcgagacagcatgaggtgagtgggttgtanaaaccacactagtatgcaagcacgataggagatatactagtacgtagattagtagtagaaaaaaaaaatacggtgcgagaggtagggaagtagtagngagatgtaagtagtattgattttgttttatatattagtattattagtagtttaatagagagaagaggtaggaagtagagtggaagaagctgagaaaggtaaagagcaagaagaggagaaaaggag

SEQ ID NO: 516899 - DNA, 305 bp, Homo sapiens
  misc_feature (22)..(22): n is a, c, g, or t
  misc_feature (73)..(73): n is a, c, g, or t
tgcgtgcgggtgatcagaggancccctcaacgcttatacttcctcaacgcttatctatacttctcaacgcttnatacttctcaacgctttatacttctcaacgctttatacttctcaacgctttatacttctcaacgctttatacttcctcaacgctttatacttcctcaacgctttatacttcctcaacgctttatacttcctcaacgctttatactttctcaacgctttatactttctcaacgctttatacttccctcaacgcttctcatttcatttcccggtatgaagtataaagcgttgag

SEQ ID NO: 516900 - DNA, 778 bp, Homo sapiens
gcgcgcatgcggtgacttaggcctgtattccacagctctcagggacactagaaggcgggaggatagctggagccctggattccgacgatctggctgggataatatagcgtgaccccgtgctctcgcaaagaggccgagaggcaaaatgtcatcatatgcatttttttgtggcaaactggtcgggaggagcatatgaagaagcacccagagtgctgcaggcaccttctcagagtttctaagacgtgctcagagaggtggaagaccatgtctgctacagagacgggaaatttgacgatatggacaaagcgcggggaaggcccgtggatgttctgagaaatgcaccgaggctaatatccctgcgcaaaggggcgggacaaaaaagaagtgcaagggatcccaagtgcagccaagaggtctccctctcgggctgtgggtggctcttctgctctgagtatcgaccaaaaaatcaaaggagaacatcctggctgtccattgtgatgtgcgaagaaactgggcagagatgtggaataacactgtgcagattgacaagcagcccttatgaaaagaagggtggaagctgaagggaaaactacgaaaaggatatgccgtgcatatcgaggctaaggggaaaagcctgatgcagcaaaaaagggggtggtcagggtgaaaaagcagaaaagaggcaagcgggggagcattggacataacaggttaggggagaggcctgaagattatttaaaagatatgtgtggaaatggttacgcggtttttggttaac

SEQ ID NO: 516901 - DNA, 395 bp, Homo sapiens
  misc_feature (28)..(29): n is a, c, g, or t
  misc_feature (77)..(77): n is a, c, g, or t
  misc_feature (326)..(326): n is a, c, g, or t
  misc_feature (361)..(361): n is a, c, g, or t
  misc_feature (365)..(365): n is a, c, g, or t
  misc_feature (374)..(374): n is a, c, g, or t
tcacgcttcaaccctcaacgctttatannctcaacgcttaactttctcaacgctttatctatacttctcaacgcttnatacttctcaacgctttatacttctcaacgctttatacttacgctttatacttcctcaacgctttatacttctcaacgctttatacttctttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 516902 - DNA, 1202 bp, Homo sapiens
gctcttcaagatctctgagactgcgggtacccggaaagggagcatgagcaatgggcatggcagcccaggggaaaaggcaggcagtgcccgcagttttagccccaagagcccccattgaacttgtgagatgaagcatatcaccacctgcactgtgtggtgacctgtgtggcacggggatccccacggatcttggccaaggtcctggagcactccagaagatcggactgtttggggcacggagggagcaaggagcgacggctaggtctctgactctcgcctcttttcgtcacacccacacgcgttgtcaatgtgggaggggaatgcggaatgattcgcacgttgcaatgtgcgggggaaccttggcgtgggccttaggagccgagggtgccattgggcccacatgcacgaaagcggcttgggagaacctttgggagcggagaagaggcttgaggtaccaccaaggatagacgctcgggtaggcgtatgggcggacgaatggacacgaatggaaagggaaacttaggtgtgacttaaagcaggcccaagtttgggggatataggcagattcaggactgccaacatataaggtttaggattggtgcacaggcaaaggatggtcacacttctcgtttagtaaacaaccgaggcgcgacacagggtcccagctaaataggcccgccgcaccgtacagacagagccgcgcgaccaagcgggaggcacacacttttccgaaccacgcgactggccacaatcgagtgcaacattgcacggagaaacacacgaatagccgacaaacgcagttcaccacctggccaaagtgtggacagccatttccaaacgaccaccgagtaaccaggtattagcgcgcacacaccggctcctacacacccgcgggacaaacaagcgacccacactagcagagaggccgcgagaacaccagcgcgcggccacaacggccagcccgcggctcccccaagcgccgccagaagcagctacaaagcaccagcatagcttccgcaacataaggcgacggcagcacacagagacaaagagccagagtagagcgacacactgttagcaaaccatccaccaacgacaccgctcgcgccacacagccccatacaaggcagactcaccgagcaaggcgcagcaacagcacccacggtggccccacaacaccacgacgcatacacaggggcgcg

SEQ ID NO: 516903 - DNA, 518 bp, Homo sapiens
  misc_feature (28)..(29): n is a, c, g, or t
  misc_feature (449)..(449): n is a, c, g, or t
  misc_feature (484)..(484): n is a, c, g, or t
  misc_feature (488)..(488): n is a, c, g, or t
  misc_feature (497)..(497): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcatttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 516904 - DNA, 746 bp, Homo sapiens
  misc_feature (28)..(29): n is a, c, g, or t
  misc_feature (677)..(677): n is a, c, g, or t
  misc_feature (712)..(712): n is a, c, g, or t
  misc_feature (716)..(716): n is a, c, g, or t
  misc_feature (725)..(725): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttcctcaacgctttatacttctcaacgctttatacttcctcaacgctttatacttcctcaacgctttatacttcctcaacgctttatacttcctcaacgctttatactttctcaacgctttatactttctcaacgctttatacttcctcaacgctttatacttcataccggaaatgaaatgatttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 516905 - DNA, 218 bp, Homo sapiens
  misc_feature (1)..(1): n is a, c, g, or t
ngctaggctggagtgcagtggcaagaacaaggctcactgcagaaaaaagaaaaaaaaaagggctcactggagccaacttccggggctcactccatcctctcacctcagcctcctgagtagccagaactacaggcctgcaacaccacgttggctaactttttttttttttttttttttttttttttttttttttttttttttttttttttttttttttt

SEQ ID NO: 516906 - DNA, 745 bp, Homo sapiens
  misc_feature (28)..(29): n is a, c, g, or t
  misc_feature (676)..(676): n is a, c, g, or t
  misc_feature (711)..(711): n is a, c, g, or t
  misc_feature (715)..(715): n is a, c, g, or t
  misc_feature (724)..(724): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttcctcaacgctttatacttctcaacgctttatacttcctcaacgctttatacttcctcaacgctttatacttcctcaacgctttatacttcctcaacgctttatactttctcaacgctttatactttctcaacgctttatacttccgtattgaattcaagtataatattaagtatgcatgtttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 516907 - DNA, 530 bp, Homo sapiens
  misc_feature (28)..(29): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttcctcaacgctttatacttctcaacgctttatacttcctcaacgctttatacttcctcaacgctttatacttcctcaacgctttatacttcctcaacgctttatactttctcaacgctttatactttctcaacgctttatacttccctcaacgcttctcatttcatttcccggtatgaagtataaagcgttgag

SEQ ID NO: 516908 - DNA, 427 bp, Homo sapiens
  misc_feature (28)..(29): n is a, c, g, or t
  misc_feature (347)..(347): n is a, c, g, or t
  misc_feature (396)..(396): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttcattagctcnagaggtccatgcatacttaatattatactgatcaatacggaagtataangcgtgagggatcctctaatcacccagctcat

SEQ ID NO: 516909 - DNA, 1109 bp, Homo sapiens
gcgttgtcccctcagggttacctttggaatgatataacccctctttaagagattatgaaacgacttgtgaagtttcaagcctcaacatttcctgtcgtctcgttagcgattacactttccgggcagtcatgcaacgcaaattgttgggagcaggccccataggacttcaggaagcacattcgagaacgaactggcgggagacccgttgtgtaggaattctgaaagaaattcggggactacaaaggtacaagcgttggtggaaaggtaaaagaaacatcttgcatacctgacatatgttaaaaacgcggctcggcaatggacaacaaactgctcaccaaccaggataagaccttcacggaagattaccatcccatcgaaacacagatagcaagaaggaagtacaagccatgtattgtgtccagcaaatagaaacaaagacagctcgaagccccccacgacgtaaagcctctaagaaagggacacctcctcggtcaccttgtaatctcgttcaagaaacactttttcacgatccatggaagcttctcatcgctactatagttctcaatcggacctcaggcaaaatggcaagtacctgtgcatttggaagtttcaatggagaagtatccattcagctgaggctagcaagtaactcgactagtactgcgcagaagactgttgtcacgaactgtctctaaacctccattaggtcatatacgatcttcgggcaaaaaccagttgtcaagtttctcagagtgaatacctgacagaagcagtggaagtatccaattgagcttcactgggaattaggtataatactggcaacgactcgtaccgaattttttgtcggctcgaatgagtggaagcacggtgcgaccctgaagaccacagaattaaatacaatatcaatgactggctttgggaaaatctactgatgaaacttaagtactatcggtaaatctccggcagctttcaagctcatctgattatgcatagctttgcacttcagaataaagcttaattaagtacaaccaaccacctttccagccatagagattttaattagcccaactagaagcctagagtgtgtgcattcttaatgtgctgtgcca

SEQ ID NO: 516910 - DNA, 153 bp, Homo sapiens
acactgtctttggacgtgggggtttggacgacagtgtgcacacgccgtaacgaccagtactacatcatatgggaggtcgtaatggacgaagttgttgcgcaacaacttcgtccatcatgacttcaagaagtgtgtggagcttcggcgtgtgca

SEQ ID NO: 516911 - DNA, 567 bp, Homo sapiens
  misc_feature (28)..(29): n is a, c, g, or t
  misc_feature (498)..(498): n is a, c, g, or t
  misc_feature (533)..(533): n is a, c, g, or t
  misc_feature (537)..(537): n is a, c, g, or t
  misc_feature (546)..(546): n is a, c, g, or t
tcacgcttcaaccctcaacgctttatannctcaacgcttaactttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttctcaacgctttatacttcctcaacgctttatacttcctcaacgctttatacttctcaacgctttatacttcctcaacgctttatacttctcaacgctttatacttctttcatttcccggtatgaagtataaagcgttgaggaagtataaagcgttgaggaagtataaagcgttgaggaagtataaagcgttgaggaagtataaagcgttgagaagtataaagcgttgaggaagtataaagcgttgaggaagtataaagcgttgagnaagtataaagcgttgagaagtataaagcgtgagtngtcnagtagccgntgtctccccacagagagtaac

SEQ ID NO: 516912 - DNA, 437 bp, Homo sapiens
ctccattgcagtctgaaattaacacacaggcctattcctataactgtcttattttagtaaaacagaagtgggtggcagacacgatatgtcactgaaacacattaaactgagagacttgaggctactgtaagaacagccaaggcggttgatgctcaagtttccttcactaaaataatggtaacaattcacagagactgagcagtccaactcagctggagtgaatgaaaactacaagaaagtcaactgaactaattctccattaaatttagattaggcagccaggcgaggtggctcacgcctataatcccagcactttgggaggcagagacagtcggatcacgtggtacagaagttcaagaccagcctggccaacatggtgaaaccccatctctgctgaaactataaaaattagccaggcatggtggcacatgcccgta

SEQ ID NO: 516913 - DNA, 1503 bp, Homo sapiens
ttagttcgagacatcatcaatgcgatatgtcccgtcgatcaagcattatatctgcttcaactttgatattgcagattactctgatatactaaggtctaacacatcattggatcttgatcggttaacttgtacagaaaagtattgcgcacgtagtaagctcaactgtgcattttgagaccttttcaggagtgccgtactatttcttctgcgtcaatgcctgtgtataggaattcttttgacgacccttgattcacaagatcttgcttcacctatttcgccagaaataaataaagtcgaaggggagaactcccttattaatacatgcctagtttgccccccactcagtgtatacaatttggtctttggcgaggttatacgtttacgacttaaagaagtcgcctttggacaattacgctatacccaagggatcccttaaagtaggttaaggaaccagttacactaggttacaccccctagtgggagttttggagcccagaaatccatagtacttcgaaaggacgaatcggcgttattggaccctaaaatcgcaccactatagacaaattactttccaattgttgtgccatatgcccaaacgacctatatggtcgcaaacaacgaacaatggggcgaggttcagataggaacacatcgggaggatgcgagaccatgccagtcgaaccagtatgttccgctgcataaacagaagcaacaagcgcaattttcgcactcttgcccttcatacgagaaagggtgcacagtattccaaagagatagacaaagcctaccgcaaagatttcggatactatgtgcacattcagagaaacggacccctatgtaagtcagtgccccctctaacagttacattaaaatacaggggaatcgaagaaacaaccagttagaaaaaagactaatgaacttgttggaaaacgcccaatctattagcccccaagattaaagtaatacattaaggaccacaaaataataaagcgacgcacccaatagtcggcacccaaaacaattggcacaaatgaagaacagcgagcctagcgtttacatgtcacagctagttcacaaaataaaggagttatcgcggtcgcacacaaccattatgtaccagaggagtgggcattcagcgcacacaacattcgagcagaccagcgtgatccccaaagagacagacggtggctatacacagcctaagcgaggacacgaattacatagcacaagacaagtagacgggagtgtataccgacaactattataggaggcagctcacagttatgtgccgttcagaaaagactacaaacacttgtgcacatagagtctacgagcgtctaccataaaacatggagctcttggcacacaatcgtcagagagcaaaatgacaaatagatagtttatcgcgaaaaacgcagctcaacaaatactagggcccgcacataatacaagctaaacacttgtcgcgtagcgaaatcaagtttagtgaagcatactaacaca

SEQ ID NO: 516914 - DNA, 172 bp, Homo sapiens
gggccccccccccatccgggcccttttttgggaaattttttcccccacctttttgtattttcccccccttggggttttgggcctaaaggtggtgggggtaaggggggttttgccctttagctttttttttttttccccaaatgaaaatcccctgcaaggggcggttccccca

SEQ ID NO: 516915 - DNA, 102 bp, Homo sapiens
ctggcgtgtgctgtgctgtgcgtttgtgtgtgtgctgtatgctcgctgtgtgtgctgtgcacgtttgtgtagctcgtgttcatgcgtttgctgtgcggtacc

SEQ ID NO: 516916 - DNA, 348 bp, Homo sapiens
ggattttttttggggttaccggggaaaaaaagaccctttccaaggggttggggttggcccggggcccccctttgggttttaatccccttccccaaaccccgggtttccccccccgggacccccccgttcaaattggaaaatttttggggggggcccctggggttcctggttttaagggtttttttaaagggcccggtttatccccggttttgggttttttgcggtttttttttaaacccgaaggggtgggtcggggttgtttttttttttttatttgggtgggttttgtggttcccaaccccattttttttggggaatgaaaaaaaaaaagggtttattttctgggga

SEQ ID NO: 516917 - DNA, 358 bp, Homo sapiens
gtaggaggaattaatactaggacgataggcatgaaactgtgataatgctccacagatttcagagctattgaccagtagtatacccccggtcgtgtacccgcgatcaaatgtgcttatggtttaaacgtccgagactcgcgatctgtgtataagcctaaggtgttgggacagctcactgactgcaagacgtctctgtgatgtaattcttatacgaatgggggcctacaatcgcggagatcactactctgattgtcaacgtcaagcgagtcgcaaggtcgcccttgcgtactatgaatatactgggggaaagtattgtaagagttcgacacaattcagtcctgcctgttaaatcagagtc

SEQ ID NO: 516918 - DNA, 237 bp, Homo sapiens
caacccattggttgattttgctgctataatttggctcatactttgtctctcctcccatccgcggccgcgcagcagcgacaccaccaccaccaccaccacctcctcttcctccaagtagaagagattgaagcctccaatatcgataatgttgtcctggatgaagatcgttctggggctcgcgcctgcaaaacctctggagggaccagcgagaagaagaactgggcgagtattacatga

SEQ ID NO: 516919 - DNA, 572 bp, Homo sapiens
gtttatcgatgccaccagccaacgggagtagtggagtgtatcgaatgccacgtcacgtctctcttcataaaatgctatgacaatttgtggagatttcacattagcttctttgcaagaaccaggtcaggttcatctgtgtcttgccatttcattaggaacataaaatcaccacaggaatctgttgcgccaatgatctgatctggttcgagttcctgctctcaaagccccgagcgatatcatagctacgctctgctcttctctttagattagatgtgatcggcacggtatggagaagatggattgcctctcgtcacgttctgacttgtacccgggttgattatattcaccctccttcatcttcttatactatatcataaattcagaacttagctcagggcaagccaagttatgctcaggtcccgaagtatagtgctgctcagaaaagccttgccacttcagtagatattccatttgtcccgtaaccaagcgcctgtctagcatcttctccacaacataatcttcctcatcctctgaagaagaactgtcaggtgtccggtcggtttgctttccca

SEQ ID NO: 516920 - DNA, 198 bp, Homo sapiens
aatgcctactgccatcaaggccttgttttgcttttctttttggattgttcagaaaaatgtgtgtggcatgtgtaagaaaagtgtatatactattttatactacctttccaggttgccaaaaagttgcaagaaaaccaaggggcccaccgttttcccttaaaagtttacctttttaaaaaaaaggttggtttaggttca

SEQ ID NO: 516921 - DNA, 902 bp, Homo sapiens
ccaggctggtactggcccggagttaggcatggagcgcgtgcttcgcgtggcggtaggtctacggtggcctccatcctaacgggctgcgggcgtccggacggtggtcccaagcgctgttcacgctgctcttaagtgagccctggacgaggcgcggtgggccctcatagtccgcgccggcgccctcgctccacacacgcggcgtccggccctggtgctcccgaccgatagtccgcgtgggacttttaggggatttagttattaattagtacgttaaccacactagaaacggccccagaatgggctgaaacgtgtgctgctgaagctgccacctaaagctcccgagagaagcgccgttactcctccatggcttctcgccgaacgccctcgctgctggccttccagggcccctcggttgataaaaaggactaaatagtagacggccatttattaaggctaccttaagaaatggctaaatacatttacgaggtgtgaaacccgatgtatcactgcgcgctttaagccccgtcgatgagccggggactgcgcgcgttctggtgcgccccggtagcgtcctttctcgggtccgggatacgcacggtgccggggtacatgaacccttctgctcttctaaagttcatgacccttgtagagtgaacttccctgtgatcttgcactggtatagagcagaaggacgggaagaccgtgagtgtcgtacgcatatcccttgaagcaggggaatgcccgtatgtccaatagaaacgccgaagactggggacccaacgtgttaggaaggacgtcggagggatcctgcgataaagacctgacacaccgtgccttaaccgaggagaagcctataacgacaacccgagattctgagggacggactcaattcacatctgaag

SEQ ID NO: 516922 - DNA, 514 bp, Homo sapiens
ttatctctcctgtttcatcccgactatcctactagagtggaagctccttgagggcaatgagcaggattggagtcctcatctggcacagacgttggcagaataggtatctgaaactgttgactaaaggaaggcaggtatgatcaggccggtgagaggaagacatcagccagacccccacaacacacatcttctgaccctactactggcctgtgcaccaacgggctgagccatctgcttagagacaaagcaagagggtggagggatgccaggcagacgggagcctgctggacagggctctggcccggatatcctagttccagtttagctactacctcactgtgcagccttaggcaattccctctctgggcctcagcttctccatctgtaaaatggacctgagctgtcccttccagttctgaaaaactacaactgaccagccgagagaggtggggatagtctgaggctctaagggctgaccagaggacccactagagagaccatctatactctgact

SEQ ID NO: 516923 - DNA, 97 bp, Homo sapiens
  misc_feature (35)..(35): n is a, c, g, or t
  misc_feature (53)..(53): n is a, c, g, or t
gatcggattgattaaaaaacaaattctctggaatntgtgcgttcatgcttttncgtattctttatggcttttaaataaatatacaatggttaatagt

SEQ ID NO: 516924 - DNA, 1053 bp, Homo sapiens
gcccaacgtgaggaggaattgaattcgctgaagcagaagctggcgtcgtgctcttttggctgagcaggaaccgcagccaagaacggcatggttccggtggtcgccgctagcgccgaagtgctggatcgtgtcccgagatgagattctgcgctatagccggcagctaggtgctggcaccgagctgggtcgctgctcgagacagacagcgcactggggaccgcgtggcgttgctaatcgtggcgctagcggttgagagctcgtgctagtcccactatgcgcagtactttggcatgcggccgggcgtgggcccgccttggggccttttgttgggccctactgccgtgggtaggagatgagcaacctggcccgccaaggtgctgctttggcgagggcactgggcctggggccagggcccaaagggcccgtagtatcggtgcccggccggccattcgcttgtggccagaacttcacacgtccgggcactggggaaattcgcggtgcccagataagcactcaagcgcccgtttacggcctaggcacaattgcccattaagaagctgggttcccggccaggatagtgactcgtgggtcgggcttgaacttaggatccggaacgcaaacggtgccccagatgtcaggattaacactggggttaaactggacggccattggtgttcgccctggccggggctcagggccccttgggtggtcatggcccagctgccattggcggcatatcgaaggggcccaaattccacctgttctaaccaatccctgaacgggtgggccccttgtcgtaaattcggcatggcatttattgccccgtaatgcaaagcccaaagggggaagaccagcgggaaacaaaaactgggggcggaaacggggacgcagcttgctaccgggatgatcggagacaaccgggggcacctagtgggatgtcctgtgagcgccctgggcaaaggtgcgcgaaaaaccggccgggcagacgcaacgatcggcccctcgtatacagggggacacgaccaggaagcgcaacagggagtggcccgtaac

SEQ ID NO: 516925 - DNA, 1581 bp, Homo sapiens
  misc_feature (686)..(686): n is a, c, g, or t
ggggcctgcggcgctgctagcgctgctgtgcgtggcctgcagcgctgtgcgcctgtggcgcgcccaatacgaactgctacagcttcctgcagcttcccactgggactgagctgatgccgctctgatgtctggcctacctggcatcgctgctggacaagtacatgcgagcgagcactggtgccgagagctgtgggctacctggcagatcacgcctgcggctgcaccgcttgctgctgcgacatgcgaggccttctgccacctgcaactgcatgcgcctctgcctgaagccccgagcccggcctgccgggcctcgccaggcatatccacgatgcttgcgccctctttcggcgggcctgcttgctgccctgcgcgcaacttgccttcgatgctgcttgcaatgctagtggcctttgccatggccgtatccggcccaggtcccccaagacccaaagcctgacgaatggtttgccttgagcagaggacatattcacaaggctgacccgctgaagcccccttagcaaaggttcccattggcaagatataccggcattaaacgtgtccaatgtggccgcacattagattctccgcccaagatggaggccccatattccggtctcagtgtttgggcgtaccaagcgagccctaatttcacgtcagctttgggaagcagccattccgcttggatntgacctctgacacagttggactcagcaacacggagtcgcgaagagccatcttgggcccaattacatataattaaagagcgacgcggcctctttgtgcactttcgtgattaggcacgggacggggcaactaacgcacttttcaacaacggacagccccatgtggtgacaacacgccaacatggattccattacgtcttgcaaaaacagggcccctgtgctatcacatatcccggatgtgccacttgtagtgtccggcgctgacccaatttgcaaaaatgtggtgttgtactatgcaaacccgtggggcaaggcaatcacacgttccgatactccaagcaaggaaacaccattgtgcacagaccacatgcgcgcaaccaatatcacgacccggtagaatattctcttccaaaacaaggtcacacaactttatcaacaccagacagggtttagaacactacagtacaagagcccacataggagcacggaagggtagagttaccccccacgcgccgaaagacgacaccacaggggtaacccactctcacaccgagcagcatattgtgtcacacaccacttatccacacaattgcaagcaggcagtccagagtatattgttacacgaaacagttctacttgcgacagtgcgtcaacagtaccacgagctgtagcagaagagaaaccacacccaccaagggtattatcacgaagcagaaaaacccgaagtagaaacgtactatttcgcgcgaccagacgtaagaagcaagaaagctcaaaagacgacgcagtacgataaatcgctcccgacagcaaagcaaagataagaagccactagacttacgaagacagacacattagctcaacagaaaagaagaagagggaactctagtcgtacacc

SEQ ID NO: 516926 - DNA, 814 bp, Homo sapiens
  misc_feature (112)..(112): n is a, c, g, or t
  misc_feature (114)..(114): n is a, c, g, or t
  misc_feature (117)..(117): n is a, c, g, or t
  misc_feature (141)..(141): n is a, c, g, or t
  misc_feature (152)..(152): n is a, c, g, or t
  misc_feature (165)..(165): n is a, c, g, or t
  misc_feature (178)..(178): n is a, c, g, or t
  misc_feature (180)..(180): n is a, c, g, or t
  misc_feature (191)..(191): n is a, c, g, or t
  misc_feature (198)..(198): n is a, c, g, or t
  misc_feature (216)..(216): n is a, c, g, or t
  misc_feature (236)..(236): n is a, c, g, or t
  misc_feature (243)..(243): n is a, c, g, or t
  misc_feature (250)..(250): n is a, c, g, or t
  misc_feature (254)..(254): n is a, c, g, or t
  misc_feature (260)..(260): n is a, c, g, or t
  misc_feature (291)..(291): n is a, c, g, or t
  misc_feature (310)..(310): n is a, c, g, or t
  misc_feature (315)..(316): n is a, c, g, or t
  misc_feature (328)..(329): n is a, c, g, or t
  misc_feature (334)..(334): n is a, c, g, or t
  misc_feature (370)..(370): n is a, c, g, or t
  misc_feature (372)..(372): n is a, c, g, or t
  misc_feature (394)..(394): n is a, c, g, or t
  misc_feature (434)..(434): n is a, c, g, or t
  misc_feature (436)..(436): n is a, c, g, or t
  misc_feature (461)..(461): n is a, c, g, or t
  misc_feature (482)..(482): n is a, c, g, or t
  misc_feature (485)..(485): n is a, c, g, or t
  misc_feature (513)..(513): n is a, c, g, or t
  misc_feature (531)..(531): n is a, c, g, or t
  misc_feature (593)..(594): n is a, c, g, or t
  misc_feature (596)..(596): n is a, c, g, or t
  misc_feature (616)..(616): n is a, c, g, or t
  misc_feature (623)..(623): n is a, c, g, or t
  misc_feature (637)..(637): n is a, c, g, or t
  misc_feature (644)..(644): n is a, c, g, or t
  misc_feature (647)..(647): n is a, c, g, or t
  misc_feature (651)..(654): n is a, c, g, or t
  misc_feature (693)..(693): n is a, c, g, or t
  misc_feature (704)..(704): n is a, c, g, or t
  misc_feature (718)..(718): n is a, c, g, or t
  misc_feature (721)..(722): n is a, c, g, or t
  misc_feature (792)..(792): n is a, c, g, or t
tgagtaaaattcaccaaaattggcaaacattggtaacttttacttcaaagactgtaaataaacagatacatctttcaatgggctttcaagcaattttacaacaaagcatgtncntcntagccacatcactataagtcagcnatgtattcccnttaacgtttaccngttgtaatccccnanaggttttccanaacttcngcacattgtgcttttcanatcaaatttttattaaagancttagcnattttcnaaangaaaancctttttattggattttttccaattacaaangaaatttcattttacatcnaaaannagaaacaacacnnacaangggactgtacaaatttaggtcaaaaaaaaaaaaaangnatcttgtgactccaaaaaacancccttaccaaatttttaaagaaagcagaagtaacagcaananatgtaaaagaaaagaataaatgacnaaaagcaagacaaagcaaaanaantgtgcttcttttgcagactggggacaangaaatgtttagctacaantttcccaaacaaacaagaaacaaaaaccaaaaagaaaaaacacccccacaaaaaactgatgnntnattaacacacaccaagttcnaccaaancaaaaaataaactnaaaattnttnggtnnnnttattcatattttaaattcaacatgcttgctctatttanaaatacctgtngaagctcataatanatnncttctattttcagacatagcagagaaggcatattccattgttaactgtaaaagcaactcttaaatttaanattactgctataccacctatta

SEQ ID NO: 516927 - DNA, 666 bp, Homo sapiens
  misc_feature (46)..(46): n is a, c, g, or t
  misc_feature (51)..(51): n is a, c, g, or t
tgatagtgtctagagtgatccctcaaacgtatagaacatccctgtncagcntccccaggcagggcctgacgtgtcacgctgttcatggttctcccctgtgtgccttgaggctcactcatcttgatgactcagagacttgccagagaccctggactccccgtcccaaattccccgagcctggccccgatgattcttgcaatgttactctgttcatggtgcctctgccccatttccatctgtgccatatcaccaatagttgggggggggtcccccaaacaacagggactaacttgaactttgcaagactcttgaatttcctggctatatttattatctgtatggcactgatttgtactagagctgagcctgcagaagtcagttgaacccatcctctctatattcaggaggactacaggatgtaggaactcaaacgggatgtcgatctgtgggagtttgcaactttgcctagcagcacagacctgcctccttgggagaggcctctggggagggatgctaagccgatggatgtctgtgcagagacaagggactgtccttctcacctgagaggccattctcatcctgcctagtcctgtctgattcacatctgaccccagcttagcccagacagaaacatgtaaagcatgttctatacgttctgaggatcct

SEQ ID NO: 516928 - DNA, 157 bp, Homo sapiens
ccccggagttcacgtcacaggatctactaccgtactccccacaggcagttcgacaacggttcaaggacacggagcatctcaaacagtcttctgaaccctcccctgctgcctgtcttcatactctgttcaaaatcatcgacgaaccgctcaaccgagg

SEQ ID NO: 516929 - DNA, 236 bp, Homo sapiens
caagttcagatagtttgtcatttttttcttctgttttgtgcctactgaatatgacctggttttaagcagactagctgttttttctcgcttctcaactgagtgcgtttgttttgcattgcgtggtgagtttgcacattttagaccattccaatggtccagaagtgaaacctccacccacctggggcaccctagacccactccaatttgcttttaacaccatagtgccctgtcgacgc

SEQ ID NO: 516930 - DNA, 320 bp, Homo sapiens
accgtgggacatatgatcagcatattcttcctcttagtgaacccacagatccaacacaggagggacagggagagggcaggctctcaatacttatgtgtgaagtaatgtcctggacaggtcaccgtgatcaaggtggagtaggaaggcctgaacttaggcacaaaaagaaagaagtttcacagtgcagacttcggggaagcatgggcagtgtaatggaagataggggagtgagcgcagcagctacatagagtggcagggaaccccgagagacaccacatgaggtgaaggcctctcagatccatgcctgggatcccatggga

SEQ ID NO: 516931 - DNA, 828 bp, Homo sapiens
cgtagtcaagcctgtaatcccagtattggggaggccgaggttgcgggatcacaaggtcaagagacaagaccatcgtgccaaatggtgaaccctgtctctataaaatataaaaaattagtgcggcgcatagcgcgttgtatcccacagctcacttggggaggctgagcaggcaaactcgcttgacccttgggaaggcagaggtgtcgcaaataatgccaagggatcacggcatttgacctccaaggtgaaacaagagcaagactcgggcacaaaaaaatttattcatttactacactaaaatcgtggtcgcgccgggtggagagtgacccaccgcctggtaatccaaaggggcagggtaagatcacgacggtcaggaagatcgagacctatcgttgattaagcagggtgaaacccttattttttattaaaaataaaaaaaatatagcggggggtgagtgtggggcacctgtagtccaagctactgggaaggttgcggaggaagattgctatggacccggggagacgaccctggaagtgaagcggacattggcgccattgaattgggtaccttgggccgacccaaagcgaacgcctccgtccccaaacaacaccacacctaccaacaaacaacacctcttctgcgcgccgcccccccccgcaaaaagcctctaccacccaccgcgtggggcgcccgccccccactagacagcccccaccgccacaccccgtcccacagacaccggccgcacacagtgtgggctcccccaaaaaacgcccggcccgcggccgcaacacccgcgtcgtccgccacgcgccccgggccagcga

SEQ ID NO: 516932 - DNA, 281 bp, Homo sapiens
tgctccttcataccccaactctttctcttcaagattcttgcttcctcgaaatattgcgaattcaatccctctcgacttcgcattagagataaaccgctcaaatcctgggatctgaacacaaagcgctttgatggcttcggcaggcgttcgcacggccagtcgaaaagatcgtccgaattgccgaagttgcccatacagtaagatcgtagtcattaggttgatattcgatagcgagtgcggccattgcttttctccagatgtaaaaaagccgcctcttgggc

SEQ ID NO: 516933 - DNA, 116 bp, Homo sapiens
tgagtgaagtattgcttttcgtgtgttctagagtatggtttatttagatgttgacaaaactcctaattaaactaaatcaaattaacttagtttaaaattagtttaactcattgaat

SEQ ID NO: 516934 - DNA, 735 bp, Homo sapiens
caaccggccacaagccacagcctgtgaagcaggacactcccgcaggctcctagagaggggctacaagcacccggtcctcctactacaccctctggcggctggacccaggatgacgaaggcctctagactggccggatgaaccagcacccggctgtgctcgaggaaggggtcctggatccccagtccacccaatggtgccccacgttccgtctccccacggtatatgctggcccccacagaggtcccatggccactgcaggtcccggatgattgcgggggcccaattcggaccattgtggggagggaccccgccaggatgccccctcctgaacccagaaggatctgtatgaaccccactcatgggggccaggtcttgagcatggcccctggcctcacctctgtggaaatccattcccattccgaatggctgcctaccaaccaagccccaaaaagccctggacattctatgatcccagccaggccaccatgagtttgacattcatctccaggaactcgaatgaggaagctccgccccgggaaggagagaatccccccagatggcttcatggccccccaagcctggaaggtcctgaccagattattaccggtcccttcggagaagaactaagacccttggctcccgagtttcttttctgaagatgctctttgattaccctttctattttttatgattagatgctttgtattaaattgcttctccatgaagccttttta

SEQ ID NO: 516935 - DNA, 163 bp, Homo sapiens
gggggatcccccccccggggtttgggtttttttcccccggaaggggttcaagacccctccccaaaaccccccccggcccggggggccaaggcccccggttggattttttaattttggggccggttttccggggggggaaaaaaaaaaaaaccccccgggtcca

SEQ ID NO: 516936 - DNA, 315 bp, Homo sapiens
  misc_feature (155)..(155): n is a, c, g, or t
  misc_feature (167)..(167): n is a, c, g, or t
  misc_feature (310)..(310): n is a, c, g, or t
aggccggattgacgataccggccctggtcatggcgacgaagctggatggcggcaccggctgccattcggcgttctcgcggtcaaagggctcggagacgatgcagcggcccgtgccttcgcgaaacgacgaggtgtagagcgtcggcgccgtcgcntcggtggcgtangcaccgcaaacagcgtctcgccgtcggaaaaagcggcggtgagtttcagcgccgggtcgatgccggcatgccgcgccgccgagaccacccggggcggttcgcgcgtttcgagccccctttgcgggtgcgttcgtccagccctncgttc

SEQ ID NO: 516937 - DNA, 130 bp, Homo sapiens
aattctgcaccacagctgcacacaccacagctaaaccatacacatcacatacctgtacacacaataccatacaccacacatgtgagttcacctcacttttccttagtccacaacagcttctaaaccaaca

SEQ ID NO: 516938 - DNA, 371 bp, Homo sapiens
aggtccgtgggtcctgctgtactttgggaaagaccactctaggtaaaggaaatcactgaagatttgaatgcatgagacaaacatcatctgagccaggcatagtggctcacacccgtaacccagcactttgagaggccgaggcaggtggattgcttgaggccaggagttcaagaccagcctagccaacatggcaaaactccatctctactaaaaatacaaaaattagctgggcgtggtggcatgcgcctgtagtcccaggtactcgggaggctgaggcacaagaatcgattgaaccagagaggcagaggttgcagtgagctgagatggtgccactgtactccagcctgggcaacaaagcaagactctgtctc

SEQ ID NO: 516939 - DNA, 386 bp, Homo sapiens
ccaattgggattggggggcccccctccccggggtgaaaaaaggttttaacccccccccctttgggggggggttccttggcggggataaaaattattggttttgggcccccttggaaaggcccatggtttaactggctccctaaaaaggggcagggcccccccattttcccgggaagggccttttggaaatttccttcccccaaaaagcccttaaagggaccaaacccactttcctaaaagggggggggggggggggggggggttgttttttttttttttttccagaacccaaaaaaacccccccaaaaattcaaagcccctgcaaaattttttaaaaagcccgggtttgggaaattaaatcccaaaaaaccctttttaagggggta

SEQ ID NO: 516940 - DNA, 2073 bp, Homo sapiens
cggtcggcagagcggccgacagtggtgacgtgaaccccgcttggcatcatcctgctaagcaccaacatacaggaaccagctcatgatctcaggatgtatggaaaaataatctttgtattactattgtcagcaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaacaactcccaaacaaacacaacaacaaacaaacaaacgaacaaaacaccaatcatggaagcaacatcagcccatgaaaaacacactcaagacacagctacatggcagacgcgggcccagcaggagaaaagcaacacgagacaaaaccaacgacatcacccaagcgaaaaaaccggagcaaacaagaaacacatgcacgcgagacaacaccacaacacaaacacactccccggcgcgcaaccacgcaaggcgagagaaagaaacacagaaaggaagatcacagagcccacacgcgagacagctcacaagcagggaacacgacgcgccgcgaaatgaaattctcaccgg

SEQ ID NO: 516941 - DNA, 787 bp, Homo sapiens
ggccgtgatcgtatagtggttagtactctgcgttgtttgcactaacttcaggaaccagctcatgatctcaggatgtatggaaaaataatctttgtattactattgtcagcaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataagcaaccaatgttcttgaatgtgctgggtgtacgcaatttcgaatgggggccatcg

SEQ ID NO: 516942 - DNA, 1761 bp, Homo sapiens
caaaatctctgcaaaggggatttcaaccaaaagaaaaaaaattttagaaaaaaatatttttaagctgaagcattttactttttactgtcttaagactagaaaattgtgttattaatattttatggtatttcttcatagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaacaactcccaaacaaacacaacaacaaacaaacaaacgaacaaaacaccaatcatggaagcaacatcagcccatgaaaaacacactcaagacacagctacatggcagacgcgggcccagcaggagaaaagcaacacgagacaaaaccaacgacatcacccaagcgaaaaaaccggagcaaacaagaaacacatgcacgcgagacaacaccacaacacaaacacactccccggcgcgcaaccacgcaaggcgagagaaagaaacacagaaaggaagatcacagagcccacacgcgagacagctcacaagcagggaacacgacgcgccgcgaaatgaaattctcaccgg

SEQ ID NO: 516943 - DNA, 550 bp, Homo sapiens
agccaccaagcccaggaatttcttttttgatcgttgttttatgagatggaatttcgctcttgtcgctcaggccggagtgcaatagcacgatctcggctcacgtgcaacctccgcctcccaggttcaagtaattctcctgcctcagccttccaagtagctgggacagccagtgtgtgccaccatgccttggctattttccttgtatttttagtagagatggggtttcgccatctcgtccacggctggtcttgaagtcctgacgctcaccgtgatccatctgtctcagcctcccaaagtgctgggattacaggtgtgagtcactgtgcccagcctattatttctccaactatcttttcttacacttgacgtcacgtgctctcaaatccaacataaatccactggacactttatcatggaaacatcagctattactctgtgatcgataagcaagtccctgacccgataaccgtgacaaaaacgtagagcaaacctgaagatgcacgacggctagacatctgacagacaccaggagggacaccgcagcacacaa

SEQ ID NO: 516944 - DNA, 291 bp, Homo sapiens
accatctacccaaattagtataggcgatagaacattgaaacctggcgcatacatatgtaccgcaggggaaatgatacaaattataaccatagctagtgatatagcatggactaacccctataccttctgcttcatgaatttactagaacttactttgcataggagagccaatgtctaatagcccccgaaatccagattagctatcctcagatacagcttaaagagcacatctttcgtatttagcataatagtgcgcatatttatcggttgaggctacaaacctaccgtgcc

SEQ ID NO: 516945 - DNA, 162 bp, Homo sapiens
tgtccgtccctaatcccactcgaagcagccctgagaaacatcgcccattatctctccatatcacccgatggcttagcttggactcagaggcctgacattcctgtcttcttatgttaataagaaaaataaaacaaaatagtggtaaagtgttggggtggcgaa

SEQ ID NO: 516946 - DNA, 2052 bp, Homo sapiens
ggccgtgatcgtatagtggttagtactctgcgttgtttgcactaacttcaggaaccagctcatgatctcaggatgtatggaaaaataatctttgtattactattgtcagcaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaacaactcccaaacaaacacaacaacaaacaaacaaacgaacaaaacaccaatcatggaagcaacatcagcccatgaaaaacacactcaagacacagctacatggcagacgcgggcccagcaggagaaaagcaacacgagacaaaaccaacgacatcacccaagcgaaaaaaccggagcaaacaagaaacacatgcacgcgagacaacaccacaacacaaacacactccccggcgcgcaaccacgcaaggcgagagaaagaaacacagaaaggaagatcacagagcccacacgcgagacagctcacaagcagggaacacgacgcgccgcgaaatgaaattctcaccgg

SEQ ID NO: 516947 - DNA, 2031 bp, Homo sapiens
tagtgttgcgcactaccttcggagagcccagatcatgatctcagggagttgtctggacagagaactaatctgtgtattactatgtcagcaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaacaactcccaaacaaacacaacaacaaacaaacaaacgaacaaaacaccaatcatggaagcaacatcagcccatgaaaaacacactcaagacacagctacatggcagacgcgggcccagcaggagaaaagcaacacgagacaaaaccaacgacatcacccaagcgaaaaaaccggagcaaacaagaaacacatgcacgcgagacaacaccacaacacaaacacactccccggcgcgcaaccacgcaaggcgagagaaagaaacacagaaaggaagatcacagagcccacacgcgagacagctcacaagcagggaacacgacgcgccgcgaaatgaaattctcaccgg

SEQ ID NO: 516948 - DNA, 1857 bp, Homo sapiens
ggccgtgatcgtatagtggttagtactctgcgttgtttgcactaacttcaggaaccagctcatgatctcaggatgtatggaaaaataatctttgtattactattgtcaggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaacaactcccaaacaaacacaacaacaaacaaacaaacgaacaaaacaccaatcatggaagcaacatcagcccatgaaaaacacactcaagacacagctacatggcagacgcgggcccagcaggagaaaagcaacacgagacaaaaccaacgacatcacccaagcgaaaaaaccggagcaaacaagaaacacatgcacgcgagacaacaccacaacacaaacacactccccggcgcgcaaccacgcaaggcgagagaaagaaacacagaaaggaagatcacagagcccacacgcgagacagctcacaagcagggaacacgacgcgccgcgaaatgaaattctcaccgg

SEQ ID NO: 516949 - DNA, 127 bp, Homo sapiens
tatactgaggaaagatgtataacggggagtcgtgtaatagtggggatagtgttataagggggagccgtctataactggggaacgtgttataacggggagatcgtctataactggggatggtgttata

SEQ ID NO: 516950 - DNA, 1046 bp, Homo sapiens
gtgaagatcctggtgtcgccatgggccgccgccccgtgcgttgttaccggtattgtaagaacaagccgtatccaaagtctcgcttctgccgaggtgtgcctgtatgccaagattcgtatttttagacctggggcggcacaaacaggcaaaagtggatgagtttccggcatttgtggccacgatggtgtcagatgaattatggagctagctgtcctctgaagcctctgtgagagctggcccgaattgtgtgccaataagtacatggtaacaaagtcgtggcgaacagcatgtgcttctcgagtactcctggtgtgtcggcatccatctcccttccacagtcatctctgcatctacagcacatgatgttgtcctgtgctggcggcatgacagggtccagagtcgatggcatgcgaggtgccttttgtggaagcctccatggtggcactgtggtcctaggggattccgacgatgtgtggcccaagttgatcactagtctccactctcgtcgaccaagtcgttgcagataacaaggtagcatgtgattgacggccctgcgcagggctcgaagttccaagtttcctgggtgcagccgaggaagatccgaacaagtctcaagagaacgtggcgtgcttcaccaatgttcaatgctgatgaatttgaagacatggttggctgaaatagcgggtcatccgcagatgggctgtggggtcaagtagcatccccagatctgtggcctctggacaagtggcgggcctggactcattgatgggcttccaaatgttgcttgtccccccttcttaatgactcgaccaataaattctgacttccgtgtccagaaggagttgactttcctaattccatttgacaactgttcagacgaccggcatatgaatgccgtcccgcgacgcaaaaggaggtggcgatcaaggtagcgcaggaagcttgcactgcctaggggaatgattgctcacgcgaccgacggggcaaaacttgtcacaagctggagtggcccaatgtggacgaggatggtggcagacaggggagat

SEQ ID NO: 516951 - DNA, 1953 bp, Homo sapiens
ggccgtgatcgtatagtggttagtactctgcgttgtttgcactaacttcaggaaccagctcatgatctcaggatgtatggaaaaataatctttgtattactattgtcagatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaagaaaagcccatctgatgtaaaacctctcccctcacctgacacagacgtgcctttaagttctgttgaaatagaaaatccagagacaagtgatcaatgagaatctgttcaccaaaccaaatgtggaaagaacacaaagaagacataagacttcagtcaagtgaaaaattaacatgtggactggacactccaataaattatatacctgcctaagttgtacaatttcagaatgcaattttcattataatgagttccagtgactcaatgatggggaaaaaaatctctgctcattaatatttcaagataaagaacaaatgtttccttgaatgcttgcttttgtgtgttagcataatttttagaattgtttgagaattctgatccaaaactttagttgaattcatctacgtttgtttaatattaacttaacctattctattgtattataatgatgattctgtcaaatgaaaggcttgaaatacctagatgaagtttagattttcttcctattgtaaacttttgagtctggtttcattgttttaaataaattaaggggacactaaagtcctatcattcatttccttcattgctgaacaggcaagatataatattacatgaatgattactatattttgttcacactaataaagcttatgctcagaaatgccatacacacacacaaacacacacatttatcatttaatgcataaatcaacacaaaaggttttcccattaatatgaaatattacatatatataagtgccatatttaaaataatttgtctaacagtagaactatgtcggagcactcactgaagcttgcattccactgaaagagttatttgtgtaagtagagtatccggagaaggaaaagaacttacgacctttctttataacagaaactcaactctaaattcaacaagatgtgcaaaccggacatgcaggtgaatattttaataggttactataaggttctcaattaaattctttaatctgtccagtcccagtttctcttattaataaaactttggaaattgctttaaaccatttaaaggaaatttctagatatagaaactaaggactgtgactatacagctgtcactcatttgtagtaaaacttaaaaagcaaaaacaaaaaacaaaaaagaccttcctgtgatactttatttccgaactaataaaaatctatatgactttttattattgtgtgataaccaagtaaatgttttctattttgcatattttcaggcatggtaacagaaatttaccttttaataaattaaaacaactcccaaacaaacacaacaacaaacaaacaaacgaacaaaacaccaatcatggaagcaacatcagcccatgaaaaacacactcaagacacagctacatggcagacgcgggcccagcaggagaaaagcaacacgagacaaaaccaacgacatcacccaagcgaaaaaaccggagcaaacaagaaacacatgcacgcgagacaacaccacaacacaaacacactccccggcgcgcaaccacgcaaggcgagagaaagaaacacagaaaggaagatcacagagcccacacgcgagacagctcacaagcagggaacacgacgcgccgcgaaatgaaattctcaccgg

SEQ ID NO: 516952 - DNA, 470 bp, Homo sapiens
ggccgtgatcgtatagtggttagtactctgcgttgtttgcactaacttcaggaaccagctcatgatctcaggatgtatggaaaaataatctttgtattactattgtcagcaattgtgagcatatcagcattaagtaccactgaggtggcaatgcacacttcaacctcttcttcagtcacaaagagttacatctcatcacagacaaatgatacgcacaaacgggacacatatgcagccactcctagagctcatgaagtttcagaaatttctgttagaactgtttaccctccagaagaggaaaccggagaaagggtacaacttgcccatcatttctctgaaccagagataacactcattatttttggggtgatggctggtgttattggaacgatcctcttaatttcttacggtattcgccgactgataaaggcatgaggatgtggcctgcatgctgcctgatcttgcctaga

SEQ ID NO: 516953 - DNA, 604 bp, Homo sapiens
  misc_feature (178)..(178): n is a, c, g, or t
acacaaacatctgaagttacaattattactgtagtgatttctgtgcttcaaatgcattggtttttggacttctgtggaacataccactcccctctggtattcgtgggctcagccctgggtaagtcagctgcttagacagtcaaaacttatgcgtacttggctcctcaaagtcacattngggatgatggccatttgtcaagtgcctcactggcagctcagtttggagaagagcactatgtttaggcaagatgtgcctgtgtcaaatgcagttcatgttaatgtagcaaaagtcagtctagtagatttggcaaacttctaagagaataaacatcataacgtcatcaccactgaagttgtgggtcaatcatggaatgacttaaaccatataaattccttatcagcaaaatactttgaaatagtccgtgcttagaaatgagaggtgaggaggatgggaggagggaaaggagcagaaaaggtaactattgggtacttggcctaatacctggatgataaaataatacgtacaacaaacccctgtgacacatgtttacctacataataaacattcacatgtacccccaaacctaaaagtttttttttaaaa

SEQ ID NO: 516954 - DNA, 891 bp, Homo sapiens
  misc_feature (28)..(28): n is a, c, g, or t
  misc_feature (127)..(127): n is a, c, g, or t
  misc_feature (133)..(133): n is a, c, g, or t
  misc_feature (142)..(142): n is a, c, g, or t
  misc_feature (149)..(149): n is a, c, g, or t
  misc_feature (163)..(163): n is a, c, g, or t
  misc_feature (222)..(222): n is a, c, g, or t
  misc_feature (227)..(228): n is a, c, g, or t
  misc_feature (257)..(257): n is a, c, g, or t
  misc_feature (264)..(264): n is a, c, g, or t
  misc_feature (268)..(268): n is a, c, g, or t
  misc_feature (275)..(275): n is a, c, g, or t
  misc_feature (285)..(285): n is a, c, g, or t
  misc_feature (292)..(292): n is a, c, g, or t
  misc_feature (297)..(297): n is a, c, g, or t
  misc_feature (304)..(304): n is a, c, g, or t
  misc_feature (311)..(311): n is a, c, g, or t
  misc_feature (313)..(315): n is a, c, g, or t
  misc_feature (322)..(322): n is a, c, g, or t
  misc_feature (331)..(331): n is a, c, g, or t
  misc_feature (338)..(338): n is a, c, g, or t
  misc_feature (346)..(348): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (361)..(362): n is a, c, g, or t
  misc_feature (384)..(384): n is a, c, g, or t
  misc_feature (392)..(392): n is a, c, g, or t
  misc_feature (395)..(395): n is a, c, g, or t
  misc_feature (409)..(409): n is a, c, g, or t
  misc_feature (413)..(413): n is a, c, g, or t
  misc_feature (415)..(415): n is a, c, g, or t
  misc_feature (436)..(436): n is a, c, g, or t
  misc_feature (451)..(451): n is a, c, g, or t
  misc_feature (455)..(458): n is a, c, g, or t
  misc_feature (463)..(463): n is a, c, g, or t
  misc_feature (472)..(473): n is a, c, g, or t
  misc_feature (486)..(486): n is a, c, g, or t
  misc_feature (497)..(497): n is a, c, g, or t
  misc_feature (507)..(507): n is a, c, g, or t
  misc_feature (509)..(509): n is a, c, g, or t
  misc_feature (528)..(528): n is a, c, g, or t
  misc_feature (534)..(534): n is a, c, g, or t
  misc_feature (538)..(539): n is a, c, g, or t
  misc_feature (543)..(543): n is a, c, g, or t
  misc_feature (556)..(557): n is a, c, g, or t
  misc_feature (565)..(565): n is a, c, g, or t
  misc_feature (567)..(568): n is a, c, g, or t
  misc_feature (574)..(575): n is a, c, g, or t
  misc_feature (583)..(584): n is a, c, g, or t
  misc_feature (589)..(589): n is a, c, g, or t
  misc_feature (593)..(593): n is a, c, g, or t
  misc_feature (596)..(596): n is a, c, g, or t
  misc_feature (604)..(605): n is a, c, g, or t
  misc_feature (609)..(609): n is a, c, g, or t
  misc_feature (615)..(615): n is a, c, g, or t
  misc_feature (633)..(633): n is a, c, g, or t
  misc_feature (635)..(635): n is a, c, g, or t
  misc_feature (646)..(646): n is a, c, g, or t
  misc_feature (693)..(693): n is a, c, g, or t
  misc_feature (705)..(705): n is a, c, g, or t
  misc_feature (725)..(725): n is a, c, g, or t
  misc_feature (802)..(802): n is a, c, g, or t
  misc_feature (813)..(813): n is a, c, g, or t
  misc_feature (816)..(816): n is a, c, g, or t
  misc_feature (829)..(829): n is a, c, g, or t
  misc_feature (882)..(882): n is a, c, g, or t
tgtaaatatttcttctaaaaatagagcnctctgcttgtctgaaacttcttagcgttcactgggaggatgaaaggggaaataaaggctgaccgaaaaattctggggtgacgttgacagtttcatagtnataganaaacttctnaagggcnccatggatgctcanagcaaggatgagttcaatttcaaaatccatggtactgaagaagcatgaaaaagcgtttnaaggnnccatctgtgcctggtgtggactcctgaangcattantgancaaaggnaatcaatcanagctcanagggnaccaganagcagcngnnnccttccnaggaggtanaggaganaggatgannntgnananatttannagaagaaaaaagggtgctctcntgaaaagntgnttaagaaagtgtanagananaagatgtaggaatgcagggcngaagatgttaaactnttgnnnngggcnaatgcaganntggatttaatatnatggaaattgntgggattttntnaaaataaagattaagagtnagaatntccnncgcncccgaggaagagnntggttagntnntgaatnnaaagatgnnattgntgtntanagtggggnnaatnttggtnttatgttaaaaattgtantnaaggggtgggnaagaaaaatggttgagggaaaggtaaaagaaaaaaggattgaagggnatgggatggaanatgtgtggggagtgaaaaangttggattgattggtgaaaagggaagggtaaaggaagaatgtataaaaaagttaaaaaagaggatttttgtaattgnattgggggggnggnggtatatgtttgntgagagtagtttgaataaaggatggatgaggaatgaagggggaaattatatgnaagaaattg

SEQ ID NO: 516955 - DNA, 415 bp, Homo sapiens
  misc_feature (194)..(194): n is a, c, g, or t
aggaaggaggggggccccccgccccctccacccgtgggggggggggcaaagcaaaagagggggggcccccccccccctgtggaaagggaaaaacccggtttttgggggtttttggggtttttccccccctcgccccccggttttttggttggccccctcatttaaaacggggtcccatttttccgggggttccngccctttttttggggccaaagggcccgccgcccccccttttggggcccccctcccttccccccccctggccccggggggggagggggggccaccccccccccaggggcccccccccttttttcccctttggggaattaggggccaaaaacccccccccttgggggcctttttttttttttttgggggggggggaaccgggcccctcccccttttttttcca

SEQ ID NO: 516956 - DNA, 1261 bp, Homo sapiens
  misc_feature (221)..(221): n is a, c, g, or t
  misc_feature (277)..(277): n is a, c, g, or t
  misc_feature (337)..(337): n is a, c, g, or t
  misc_feature (371)..(371): n is a, c, g, or t
  misc_feature (594)..(594): n is a, c, g, or t
  misc_feature (663)..(663): n is a, c, g, or t
  misc_feature (947)..(947): n is a, c, g, or t
ctattatcatcctcattctatttacattatacccctatccgtttagccgtggagtagcctggtgaattgtaagccacggagtcaaatggtggactgggattttcaggagaccatttatagagcaagatcttaccaacatccatttagatcatgggcactcatattaccgttcgacacatacatcatatgagttagactcacgtcgctgtacagagtcgcanagcacacctatatagcacctcgcgtaacgatgagatatataagcaattatgcgatngactgctccactagcaactttatcgcgcccgcatagctttaatcacctgcactcacgttncatagcgcgatagtatatattgtcgtttattatnatcacactaaagcttatgttgtcatatgctcgacatatcgtacatctacgtatcgtagctcgtggcttgtatattactattcgactacctgtacatcccagcgacactgcacgtatacattgttgcttcagtccaatatatagaaaatatataccactaatattatctatgtatgaacggatcatacatattgatctaactcattctgcgcgttgatacaganttacatacaattgatgtattattcacacttccatattaatccgaaatacactatatatgttaactatgnaataggctgtgctcactatctgtgtctagtgcgactcgagacctatcaacttcatattcacaccctccattctcattcattataagcgcgccgctgattactacttcatattaccttaacctattcatctccacactatatacactctcactattatattacatgactatctcatctagattcctgagacagtactatctctcgcataattagaacacatagtaggacatacactattatcgtatatcaccctcaccgtctacgtctccgcataatttctagtntttcatcgctatgagactactccatcttaatatatcatctcctctttattatctctacccaattacctattatgaactggatctcaagcatataccatctatacgacctacatacattctatcatgatctcatgttcaccgaagctagtcacaacatatctagatactttacatagttttatatgcacgtatatatatgtaccacacaacgctctatcctattatgattcatacttatctgctccccggctaccctcacacttttacattatttcgcatatcatattaattagtcgctcatctcccatgttgcg

SEQ ID NO: 516957 - DNA, 233 bp, Homo sapiens
ccatctcagcctcctgagtagctgggactgcgggcatgcaccaccacacctggctaatttttaaattttttatacagacagggtttcgccatgttgcccaggctggtctcgaactcctggactcaaactgatcctcctttctcggcctcccaaagtgctgggattacaggcatgagccactgcacccagcccagttctttcttaaaacagctgagagttttgtttttcttagc

SEQ ID NO: 516958 - DNA, 756 bp, Homo sapiens
tgggctagagactgggtaattagataaagaaaaaggtttgtttggctcacaattttagctggctagaagagttgaggcactccggatgaacagcctacaggcatgcttaccattccactagccacacagggccagcccagtgtgtcgcagaacatccaacatgcacagcagcaggaagtgcagagcagcagcaggtgtccggggaggtgccaggctctttattaacaagcagttcttcaggaactaagagtgagtcactcccatgagaacagcaccaagccattcatgggggaatctgacccacatgagccagacccctcccgtaaaggcttcacctccaacactgaggatcaacatttccacatgcagatcaaggacggcaggtccacaccaaacctaaacatgatacacagctgttacataaaacacgattatgcctgaaatcagagttgctaataagccaccacacgcgatctcagcctcctaaatctcctgcacaaaggacccaacctcaagaaaacccaccataggcaatccatacctaccaacatagccacacacagaactaacttcctacacactcgcatcctccccttaacaccacaactccttcactaactaggccccaggacacctccaacgcacaaaaatcaagacagcaaatagaactcctggccacaagagataccccaaaccgagcacacaacacataatcagtctataacctggcaccgagccgatgcaatctgtcaaaaa

SEQ ID NO: 516959 - DNA, 124 bp, Homo sapiens
taacagtccattccaagcatgtcgtgagcacaggcagcagatgcagcagtgtgaacagcatgcatggaagtcatggcacgagagcagttcgaacttgtcatgatgcacgatgacgaaagcacaa

SEQ ID NO: 516960 - DNA, 338 bp, Homo sapiens
tttcgggaggcggccagaggccagccccacccggcgcaacgacctgtgtcctattcgtctactgctgtcacgcggtgtcgactgttcagcggcagaccatcacacaacggcggtcacgggaggggagccgtgagccgcacgcggcgtggggtgccaccggcagcctgacgtgcgcgggcgctttgcctgactcagtccgcctgcttgcgcaggaatgccggaatgtcgtacgtgtcgacgcccttttcctgcagtgctgccacgtgagccgacgccgactcacgcgagctgcgccacacggcgggggtgtagaagttgctgtagtccggcgcggccgc

SEQ ID NO: 516961 - DNA, 565 bp, Homo sapiens
aaatccgaatccaaggttcccaaatcgcccgcacatccactctcgtacgttgggggttacgcgacttccggaacgaccgccgttttgcctatcgatagtggaaagcccatagtggtgttaactgtaaattttatttttctgggaagtccttttaaagggaccgtcctctccgatattaaagtagtggggaagtaaaggatcaagatcgacttaggcttgccggtcgagaggcgtatgaaaattagataagaaaaggagtcctctccggaaggttaagagaggctttctgctcgcgttgcatctggctgaccgagaagtaaacgctaaagctatgtgcttatggaattccttcgggacctaggttatatagatcgatagtacgactgctttctgagtagactgccgatttggtggtgaagcttgaccccgagttcctctccctttttaacccttagcgtaaagcgcgagtcccttgatgagtattcgtacctaacccgtataaacgaccaaatggatctttccgatacgactaatcgattaatctcgcccggagattacgtcgctt

SEQ ID NO: 516962 - DNA, 1174 bp, Homo sapiens
gcaacaacccgtttgccaagggcttccgggacaccgtggaacggcctggcgggagaaaaggaagcatgcatgacgctgcctgtctcatacgcttgtactgagtgatgcacgtgctaaaccctgatgcgcgatggcgcggagtcagactgcctcgtcgtgcgaccctccccccgacgcgggaaccacccacctccccgggcgcagcgcccatgtccgcatgcgcctgcaccgggcccgagctgaggacgaagtcgtgcgcctgcggacagctgacccggagcctgagcggttgagcgaggagcgtgcggggtgcgccgcataggcacgagaccaggctccatgacagcgcacagacaccacatcgcttgaccagaacccgatgcagcgcccgggagcggcagatagtcccgagaggggcaaggagccggccgagagctggcggggacggaccgattcggcctgaggagcctggacgacaggagcgcgccagaagctcggaggaaggacgaggggcgcaaggaggcggccgagggcacaggcagcagggacatgagaagccactagagtgaggatgcagacaacaacaagagcagatacacacatggagacagaccagaaacactgaaccaaaaaaaggccaatcaccagacacatcgcaacggagaaagaagaaacatagcagccacgaatagaacaagcaccaggacacacgaacagatcataaccagtagaaacccatgaggacagattaacgcaaatggagccacaagaagcccttatacacgagccaatgacacaatgagacaccagaacgtgggacgctcagtaagaaagcagaagaaaaccaagaacaaagaaggcaacgacatcagaaccgcagagacgctgaaccagacagcagacgatagaaagaccagaagcaaggcgagaaaagaacacgccgaccctaaccggacgagccacacaaaagatgcggaataaagaggacacaaagcaccagtcagaaggaaatacccaccaaacaatacagagaaacgagagacaaaggtagaccaaaagaaaaagaaagggagagaagcacaacgacggcactgaaagacgccacgagaccacgaccggaacacgaaaacaccaccggagacgcagcaagaaagccaaccggacaaacagagaa

SEQ ID NO: 516963 - DNA, 343 bp, Homo sapiens
cttttttttttagatggagtcttgctctgtcacccaggctggagggcagaggcacgatctcagctcactgcaacctccgcctcccgggttcaagcgattctcctgcctcggcctcccgagtagctgggatcacaggcgcatgttgccacacctggctaattttttgtatttaagtagagatggggtttcaccgtgttgcccaggctggtctagaactcccgagctcaagcaatccacctgcctcggcctcccaaagtgcactagtagaatttttataaggcttttgcctgagggtacttaccagcccatctcctcgacgcgcccgcgaatttagtagtagtag

SEQ ID NO: 516964 - DNA, 146 bp, Homo sapiens
aagaaagtcaggataaaaattttaaaaagcaggccactgtcagcaaagcctggagaagtggggccggacgtccgccccatcatgtgcctgccaccaattccaagtcatccattactctacagtagcaaataagaccatgtctatgg

SEQ ID NO: 516965 - DNA, 270 bp, Homo sapiens
  misc_feature (165)..(165): n is a, c, g, or t
  misc_feature (178)..(178): n is a, c, g, or t
  misc_feature (195)..(195): n is a, c, g, or t
attcctccgtctgctggaaggacctgcgctttgggaagatcttaagacccaggaaggtctctgggtgggataatgccaagatggaactccccctacgtctggctcttctatttggggcagtttctgctcttcatctaaggtctgagacttccacctttgagaccntttgggtgctaancgctgcctgaggatgangagacaccagagcagagatggagagacctcaggtacgcagaagagagagagattcataactcagtaatcacactc

SEQ ID NO: 516966 - DNA, 536 bp, Homo sapiens
gagaggaaggcgactcgagggcctgaagttgacatcaagggccccaaagtggacattgatgtcgcagctgtggacgttcaaggcccagactggcacttaaaaatgcccaaagtgaacatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacttcaagggccccaaagtggacatcgatgcccctgatgtagatgttcatggcccagactgtgaacctgctggccgagtggctcattcagacaggtgttgagccagtgcaggttcaggaaa

SEQ ID NO: 516967 - DNA, 226 bp, Homo sapiens
agccccaaaaaaggtttgtgggatggctattaaggattccaatgcaaaactgtttgattgtaaggccagtgggattgtaagcccccttcaaataacccctgcaataccccacccagggtttcctgcccaaggacagtggccagctccagtggccaaacagcccgattttaaaaacccccgccccccgtccttgggtaaggaaaaataaaagggctcccggacccca

SEQ ID NO: 516968 - DNA, 543 bp, Homo sapiens
gtgcggtcatctagaggatccctaaaggcgagtcgggttaggggccaggctgctgtggcaccaccgaagagcacattcaggttggaagcgagggtcggacccacggacgggaccccagaatcccaagctggagctcaggccccgtgatacgaggcgcatcagtctacgttacagaagaaggaaggagggcccagcgcggaacggagcggcagccatcgaagctgaggacagggcggaagaaaagggggaggaagagaaagaggccccgaggggagagagaagaggccaagccgctctggaggaagagtaagggcgggcgggcggcggctgcagggcttctgtctgtccctgtgcctagggcacatatcggccggtacggtgcttcttccatgacatcctgtacagcaagtaccgtgcagccaccgacgtctatgccctcatgttcctggctgatgtggtcgagttcatcatcatcatttcgggcttgtgggcctttgggaagcactcggcgggcagagacatcacgtcctccctatcagatga

SEQ ID NO: 516969 - DNA, 518 bp, Homo sapiens
aaagtatatacttgtgagttcaaatttatgaatttctagcattttgcttcaaaataactccagaagggtagggaaaaatgtaataaaagagatgaaggtcagcctccctagttagctgggaccacaggcgcaggccatgatgcctggctaatttttggtattgtttagtagagataggggttttcaccatgtttgcccaggctgatctcgaactccgtgaccttcacgttgacccaccttgcctcagcctcccaaagtgttgggattacaggcctgttataagtttgtgatgtttgaaagcacaaattaagttcttggtgcttagagagaactggttctctacaaaaacaagaaaaaaaaattcagccaggcacagcagcattgtgccccttagttgccagctactgaggaggctgaggcaggaagatcaccggagcccaggagttttgaggttacagtgagctgtgatcactgcactccagccgtgggttaacagagcaagacccttttctcaaaaa

SEQ ID NO: 516970 - DNA, 258 bp, Homo sapiens
tgaccgatagcggactagtaccgtgagggaaaggtgaaaagcaccccgggaggggagtgaaatagtacctgaaaccgtgtgcctacaagccgtgggagctcctacgtgagtgaccgcgtgccttttgaagaatgagcctgcgagtttgcggtgtgtggcgaggttaacccgtgtggggaagccgtagcgaaagcgagtccgaacagggcgatctctagtcgcacgcccaagacccgaagccgagtgatctacccatgg

SEQ ID NO: 516971 - DNA, 179 bp, Homo sapiens
  misc_feature (17)..(18): n is a, c, g, or t
  misc_feature (62)..(62): n is a, c, g, or t
agtacctgggccgtatnncggctgagcggtctgattatcattcttaaaatgcttaccctgcnctgccttgccttccccacggaaaactcaagaaagcctctggactgtgctctctcctcactccttaggcctcccaaccaaacctggggctgccccatgtagcccagcatgatatggtt

SEQ ID NO: 516972 - DNA, 123 bp, Homo sapiens
tgagctgcatactggtgtcacccatgccgcaggtgctgacagaggccttccgggagaaggacacagctgtacaaggcaacatccggctcagcttcgaggacttcgtcaccatgatcagctcag

SEQ ID NO: 516973 - DNA, 153 bp, Homo sapiens
  misc_feature (46)..(46): n is a, c, g, or t
ccccggcgcacatttacagatggcaatcagctaaccaaggcatctnactaccactaagactagggggcacttcactccagaagctttccaaccatgctggatttctgtcactcactggatacaaaccccccaggttggagggaaccacaaaaa

SEQ ID NO: 516974 - DNA, 979 bp, Homo sapiens
  misc_feature (30)..(30): n is a, c, g, or t
  misc_feature (105)..(105): n is a, c, g, or t
  misc_feature (139)..(139): n is a, c, g, or t
  misc_feature (144)..(145): n is a, c, g, or t
  misc_feature (157)..(157): n is a, c, g, or t
  misc_feature (177)..(177): n is a, c, g, or t
  misc_feature (204)..(204): n is a, c, g, or t
  misc_feature (217)..(217): n is a, c, g, or t
  misc_feature (229)..(229): n is a, c, g, or t
  misc_feature (239)..(239): n is a, c, g, or t
  misc_feature (242)..(242): n is a, c, g, or t
  misc_feature (248)..(248): n is a, c, g, or t
  misc_feature (258)..(258): n is a, c, g, or t
  misc_feature (269)..(269): n is a, c, g, or t
  misc_feature (276)..(277): n is a, c, g, or t
  misc_feature (324)..(324): n is a, c, g, or t
  misc_feature (352)..(352): n is a, c, g, or t
  misc_feature (356)..(356): n is a, c, g, or t
  misc_feature (371)..(372): n is a, c, g, or t
  misc_feature (378)..(380): n is a, c, g, or t
  misc_feature (383)..(384): n is a, c, g, or t
  misc_feature (388)..(388): n is a, c, g, or t
  misc_feature (390)..(390): n is a, c, g, or t
  misc_feature (423)..(424): n is a, c, g, or t
  misc_feature (436)..(436): n is a, c, g, or t
  misc_feature (443)..(443): n is a, c, g, or t
  misc_feature (469)..(469): n is a, c, g, or t
  misc_feature (493)..(493): n is a, c, g, or t
  misc_feature (495)..(495): n is a, c, g, or t
  misc_feature (624)..(624): n is a, c, g, or t
  misc_feature (689)..(689): n is a, c, g, or t
  misc_feature (880)..(880): n is a, c, g, or t
  misc_feature (904)..(905): n is a, c, g, or t
  misc_feature (911)..(911): n is a, c, g, or t
  misc_feature (937)..(937): n is a, c, g, or t
taaagttgtgtttagggtatgaatatttangttggggagtagttgatgttgatttatttggagaaatagaggttagggatgtggttaggtggttagggatcaagnggtgggaaattagaaaataggggattaagaatgnaaatnnttaaggtgaggnagatagttggtagtggtttngcttatgtttaagcatttaaagttggnaaaagatgttatnaatgtattatgnaagagtttanatnttttgnataagtggtngattgggttgnacctacnncttgaggaaagaaaaagaaaagatgagtgggaggatagtggagagtnggtgtatggtaggttataagattgtganaggnaagaatgtataaggnngggggnnntgnngttnangtttggggttagaggaggaaaaaaagatagtgnnatagtgcatttnacatgtnttaaaaatagttttaggaggttaaanctttttagttataaaagttattanantagggtttactttgaaatatagtttacaaggaaatgaagtataagatacatacactgggactttaggagaaggggaaagtttaaaaacaagttattttggacgtttaaaattagggcatattataaaanacagtccacggtcttacattcagcaaattcatactaaaatactccatttttgtaagataaaggcnaagaaaactttacatatgctacaagtttattacagatatttacatggctctttctcccctaggtacttaaaattttcacattatccaactccccaaagcaagctttgcaggaatgatgaggccagagcactattagaatagcttgtgcagtgctgtaatacaaaaatgtattttgaaagctattgagtgancattaaatactgtttctataaaanntggttntggtgtatttgttggcagacacttantccactacatttaataaacaagggccattggggtgtctatgt

SEQ ID NO: 516975 - DNA, 181 bp, Homo sapiens
tagtgctacttgaggatcccctcacatgactgcgcaggatggctggtggggtcttgtgggacacgggtctcccttctccgggctcgcgggggactggtccaggagggggatgccgtgccggatgggcaggcgcgacgggcgcggccctcatagcaccttgcagcagtttgatgcagccgtt

SEQ ID NO: 516976 - DNA, 117 bp, Homo sapiens
cgtgccaggcttgtatctatcccattcagtgatagtaatgtcaccgcttgttccctgggctgttctagaggtgccgtcaggtagctagcgattagagtcgagagacttagagcacca

SEQ ID NO: 516977 - DNA, 511 bp, Homo sapiens
  misc_feature (62)..(62): n is a, c, g, or t
  misc_feature (104)..(104): n is a, c, g, or t
  misc_feature (464)..(464): n is a, c, g, or t
  misc_feature (509)..(509): n is a, c, g, or t
cacctcttggaggagctaggaagtgggagttcccttagcacgtgatcccatatcttcccctncccagcctaccgtgccctgtcttgtagcatgacgatgtatantctcacccttagtagtcccccttagcctgtaaagctctttagggcaggatcctacatcctgccgtaacctttcagggccccccagtgctgagaactgtgcctcacaggtccctaaatgtttactgaaaggaagaacacacaggggtgggaggatcacttgaaccccaggagtttgagaccaacctgggcaaccaagcaagatgcagtcaccacacacacacacacacacacacacactagctggttgttgtggtgcgcacccacctgtagtcccagctactcaggaggctgaggtgggaggatgacttgagtctgggaggttgaggctgcagtgagcttgatggcaccactgcagtccancctgggctacaaagtaagaccctgtaacaacaaaacaacaaaaanaa

SEQ ID NO: 516978 - DNA, 209 bp, Homo sapiens
ttttgtttttttcaaaagccccccccccccttgccctgggaatcccctgtttttccttaaaaaacaaaggggtaattattattttgggggggggtttttaaccccttttgggggccccccaattttgggctttgggaaccccggccttgttttttggaccaacccttttttaattttaatttgggggaaaaaaagtttttaatttttta

SEQ ID NO: 516979 - DNA, 230 bp, Homo sapiens
tattgatcttttatggcgttcgtggagggcgtcaagaactctgggggcaggtctgtgcaacgcacattgaaggagctggggctcgacgggtctggattcgcacttgaccactcatgatacagaaaaccccagtttcctcacctataaaatatggaaacaaacaaggctgtcggatgaatggggtgaaggtaacacacaactacggagcctgctgcaaagagacgctcagt

SEQ ID NO: 516980 - DNA, 418 bp, Homo sapiens
  misc_feature (132)..(132): n is a, c, g, or t
gcggcctccttgcagagcgcagaactcgatcttgttgttgatgtcaaactttaatacaagaacatccgattaagaggctgggcgcagatagtcaccaagtttcatctctgtacaggtcttgaccaaagcagncacacagattgtaacatttttcccatgttcatctagaactacttctgcaggtttgctgacagagctgagaagggaggtaggtgacatagcagcttatgacccctgattgtaagagccccgagtgtggctgtcgattttggacccagggtgagatggctaccaatgatataagcaggcacaggcctccatttactcccagcagaattttgttttccatgcagctgtctttctgtgtataaaacactgccatcaaaaccaagcctccagtggcaatggaatacatgat

SEQ ID NO: 516981 - DNA, 523 bp, Homo sapiens
  misc_feature (509)..(509): n is a, c, g, or t
gcagctcgggccaccgcccgcgtacccctgcgcgccggcattcggggacaagttctcgctggaagaggcgtacccgcgcaacagcagcatcgccgctctgcgcctgaaggccaaagagcacatccaggccatcggaaagccctggcaagccctctagaggcgctgcggagttgctgcgagccctgtgtgcacccagcccagcctggtggccgaacttttctttgctagccctgctgcaagccgccagccagccttgggcgggacactcgcgcctactcttcgaaagaggccaaacggaaattcagcctcgctgtcagagggacaaactgcgggtcccgctgtccacaccgctcctagctgctcccataagcatcagcgcctatcatcgggaaggaccaaggatcttgacctgggatgttccggacggcaggaatggggagtgagaaaaataggttgaagaaactttgtaaagttagtttaaagtatttcggaggaacaattaaagattngtttgttgcccggc

SEQ ID NO: 516982 - DNA, 227 bp, Homo sapiens
ggccccggatagttgaatggcaacacaatctcagcttactgcaacctctgcctctcaggcactagctgtcttcccacctcagcctctcgagtagctgggactacaggcgctcagtaccacgcctggctaatttttgtagtttttgtagagatggggttttgccatgttgcctaggctgatctcaaactcctgtgctaaagcaatcctcccgcctccgggccattcaa

SEQ ID NO: 516983 - DNA, 104 bp, Homo sapiens
agggtcatggcctcctcctggtcgtgggtcaccacgatgaaggtgactcccagatgctcctggatgttgatcagctcgaactgggtatgctcgcgcagcttgcg

SEQ ID NO: 516984 - DNA, 103 bp, Homo sapiens
cgacttctagagtatcccctggggacccctatcaacgagattcagaataaacaacatatagcctggaatatcacaggagagtagaacatctagcgacttgatc

SEQ ID NO: 516985 - DNA, 356 bp, Homo sapiens
tgggcgtatagtgataggaggcgcgcctggagcatcgaagactattgtcgtgcgcaaggaattgcaatgatgggcgtgggccttacggtgctgccaatgatgtactgcgaagaagaactggctcagcggccggctggtgcaattgctaccgcagtggtcattgccaggcggctggctgcaggcggtctaacccgcaccggcgcgaagtgctgccggccaatccgggcctggatcgttttatctggaatgaaggcttcaaaaggctgtggagatcggctgttatgagcatagacggaagaccaagtcggcacgattctgacctgaagacctgccaggcgcaccgggaagactataaa

SEQ ID NO: 516986 - DNA, 157 bp, Homo sapiens
ccaacagcgtgctacgggggggtacaggaaacaaccaggggtgccgagaccatcgcaagaggagtacgcccaccacagaggcgagtctgaagacgggccaaaccgaacccgagccacgaacaccggggaggcacccgggtaagcaagaagacaccag

SEQ ID NO: 516987 - DNA, 356 bp, Homo sapiens
gaggcatcacaaactgagcagcatgtaatcttggatggaatggtcttgagaagcatggaaggcactgcttccatgagatagagaagccatgaccgagacagccacagttccactattaagctgtccatgtgctagtcagtagtagtcccgactcataccccttactctggacaactcatactctattcacccgaccgtggccaccgaggaccatatcgacgggtcacaatgactttgccacctcttgcccacagttgggctggccacagcaggtgggccaatccaagctccaagctaaggactggttagggagtagcaaattccactattggtctaccagcaaccttccatttttt

SEQ ID NO: 516988 - DNA, 337 bp, Homo sapiens
tgagtttcaaattccatggtttcatgaccgcttctggcaacaatataataaaggttttggtggcatggatggaacacaacagcacatttttaaaatgttaccagaggtactaggaggaatcaatagtgttaaagccttggttcttacgccttattaccacaacgttcattatgagtgtatgttggataaaagaaaaaaacctcttcgcggtggaagccataatataacggtgggggccactaccaaaaattgccttgggattcaaaactggaattggttggatcagggctgccaccaggggctgaaaggattgctttggaatctttggattcaaacg

SEQ ID NO: 516989 - DNA, 162 bp, Homo sapiens
  misc_feature (82)..(82): n is a, c, g, or t
gctagtttagaagttcaatagcagctgtcatcggaaggccgaaattcttcagcagaagagctgaggagaagattaagagtgntgggggggcctgtgtccctggtggcttgaagccacatggagggagtttcattaaatgctattgaaacttctaaaactagg

SEQ ID NO: 516990 - DNA, 381 bp, Homo sapiens
  misc_feature (167)..(167): n is a, c, g, or t
aaccggcgcagtgtactaggactacggctaacggaagcacactgaacaggactagctaacggctagggcaggcgcgcccaaccctactataaacacaatactaggaacaaagtacatacccctacgcatagagaaaggctactaagaacactatgtacagcagctanagatactaagacataactatagcacaaaatactaccacacagaccataaaataataaagacaaaaacatacactactaggctagcatactaaacatacatttaagacataaaaaaagcactttactagctataaatctaaaactaccataaaagtagatacgataggcagaacattcctactaatacataactatgggtatgcacaaagtgccc

SEQ ID NO: 516991 - DNA, 153 bp, Homo sapiens
taccgggtgatgcgctgtagcctcctaacgcggggtactcaagcgctaggtgcacccaaagacatttttacagagcttctgttcacccagaatgaatggtgacatttcccagcctctgctgctgcaggtgtggccagtatgctccagattcag

SEQ ID NO: 516992 - DNA, 754 bp, Homo sapiens
ggctcgcgcgtgcgaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggttagaaaggcagtggacgctctcttgacgcattgcaagtccaggaaaaacaattatgggtgtgcttttgaatgagaatgaaagtttatttcaactggtggtattatggaaaattccaagtaaaagaactgagggtcagattgaccttggctcatagtattcgatcagattcagaagatatctgttatttacgaaggatgaacccaattcaactcctgaaaagacagaacagttttatagaaagcttttaaacaagcatggaaattaaaaccgtttctcagattatctccctccaaattctaaagaaggaatataaatcctatgaagcaaagctccgccttctgagcagtttggattcttccttactgatgccagaataggcggtcttaccctcactcatgtgggagacatttcttatcaaagacagaagttccagtatcttgtaaacctctgtccaagaattattcaagagagatcatgactgtataggtggaacgggccttaaacatttctaaacgtggttacttggcagtgtatacggttattggtccgtgggaattggaaatatgagcccactaatg

SEQ ID NO: 516993 - DNA, 770 bp, Homo sapiens
gcctaggtaagggtgactcaagatgatacaccgagagaaaaatgcaaccatatatttggttctcatttctgtagctgtcgtttcctttttaaagacgatttatcagctgctgtcgcattgtggaactgttcctataagaaactaaaaatgatctattgtcagtgttcctttgccgcctttcctctgtctttcgtgaataaagtggtttcagtaacccatgctgttctctccctattctacggtctttgcctccctatgttgaaaaaagattcccacagtttctgatgtgtgtgttatatagtcttcaatgtatgttaaccatgttaggaactgagtatcttaagagatgtcttagaatgctttagttggtacataagttatgtacctttatgtatttttcattgtattcgctgttttgacatggaagtaatttagaacgttggtgcaggaaaggactctttactgttgcacatattggttggtctgatatgtaataaattcatggcttggcagctgacatgattgtctcccagagagaaggagatgtacttcctcgcagggtcctaggaccaagacagaagccatttacatgcatgttctccccagtgttccatctatccgccttgatgaacgctgccctgccaaggcctaacactgtgtactaagccgtactccatattatagtgcacataaaatactgtgctctgaatttcgaaccaaccacagcacaccggcaccacgcccacaccgcccgcacagccacccaccaa

SEQ ID NO: 516994 - DNA, 1796 bp, Homo sapiens
taaaaaaggagtccccccttgtggcccccaggggggaggggggggggggggcccccccccactgtgacaacacctctcgcgctcctccccgagtgttataagagtgagaatctctctcgctgtggaatactcctcaagctccacatgtgaaaacctctccgctctctccggggactctcaaaggagatatctctctcgctgtgccttcaaccctctccaaagattatggtgggaatatacggggcgccacacaccacacacacccgcggctctctctctctccctataatatattctgtgtggttctctctcacaagagttaacggtgtcgcccacaatatatatatttaagagggtgtgctcacacaaaacacaacagaaagagagagaaattttctatctatactacacacacatatgtgtgcgtcacagcgtgtgctgtcacatctctccgtgtgtgcgacccaccatatattgtgagagaggaggtataaaggagagtgagatgaacaaccccccctctctgtgtgtggctagtatccccgcctgtgagaaatatcaacaacaatacaaacacagagtggtaaaacacacctctcgcgggaggcccccctaccaaatatcacacctctctctatgtcgatacacacgagtgagagagggccaaaatagagtgtatcacacgagggggcgtatgtatatacaagaagagagagacgaggggcgctggatatcctgctgatgctgcgtatcacgagagataagaggccacagttgcctccccctttgttgtcccacaaagaggggatgttctcctacaacgaggactacagtagggatcaaacacgcaggatgatgagagaccgccatttaataaaccagcgagtggtgggtgtgatattgttactacacacccataatatgtatatccgccggcacccaaaagtatggtgaggaataccaatataactatgagacgtagacttttgaacctacctttgttcttacctatatatatcaggcctagctatcacctccactcgataggagggagccccatctgtgtgtgaccctcatccaatatcgttagccacccaactgctaagataaggaggcgatgtagtaggtggaggaataagtaagaagaaatgattgggagggacaagccgccacacaaaacactccccgtgttaggtgtggaagcgcgtgccacactaacttttctccttgaatgatgacacacaaccaacgcaccgcacaacagaaagtgtgcttgattcataacgtgcttctctacaagacacagactcatctatgtatgaaacagactacgctagcgtgacgtacctaatcctagtaggttaggacaaaagcgaaggggccgactctcactataactactacctctccagcaccatgaattctattactatcaaggagcgaggaaagcagacgaacccacatcaccagaggagcagttgttatgatggaaaccatgatagagttaaggtcagacgatcgttgatcatcagaacaactcaagtacagagtcaaacatatattgtgatctgtcccaagtacagacagcctagctgtagctgagtgtggataaatcacacaacacagatatctcggtgtcagattacacatcatccatgctgcctctcagtatggtcactccccaacaacaagacaatgagtgtccttactgatgcactaaccccatacgtccaacctagatacagagaataagtaccaacgccgaggctgatagtatgagcacgatctcatataca

SEQ ID NO: 516995 - DNA, 428 bp, Homo sapiens
gagctcggccctgggttcgaaattagtataaaaagtccaggtgatgaaactatattaccaactggcatgaagtacaataaactactaacaaacatactaacttgctacatctactaactaaaatcacttagaatgtcaagttaataccactacccaaaataccagagatccaatatgtgcccatccataatgaagagttcttcaatcgtacagctccataccttcccactaggcacaaatatccaaaggtcattccggcaaagccgcccagcatcagtatcacattagtgcaaacaggcagatttatccagcatcacattcttagcaactcctgagggcttcaattaagtaacttaaaaatatgaacttacccaactatgtagtactccaatcaaagaaatgtatcaaagccaatccagtagcttctc

SEQ ID NO: 516996 - DNA, 735 bp, Homo sapiens
  misc_feature (276)..(277): n is a, c, g, or t
  misc_feature (301)..(301): n is a, c, g, or t
tataaaaataaaaagaaaaaaaaaaaaaaaaaaacccccccccccccccccccccccggggggggttgtaaaaaaaaaaaaaaaaaattttttggggtttttttttacaccccccccccccctgggcgcgttggggtttgtttttttttaaaataaaataaaaaaacaccccacacccgccccccccccaaatatattttgttatttttcttccccccccccccccccccaaaaatgtttcttcctcttccctccacaccaaaaaaaggaaatttnnggtccccccctttttccccccccncccccccaaaaaaaaaaggggggggggggcggccccttttttttttttttttttttttttgggagaaaaaaaaaacaacttctttcttggtggggggagggagaaaagaaaaaaactccccctcttttccttttgttggtgggaacaaaacaaaaaaaaaaaaaaaagaaccccccccccccggtggggggagaaaaaaaaaaaaaaaaaaacaccccccccggttctttttttataacaaaaattttttttttttttttttttttttggggcgggggggggcgcccaataaatttataaacaaggggggggggcggccccccacaaaaaaaaaattccctttttttaaggacgccttttttttaaaaaaccccggaaatttcccccccggggggtttttataaaccccaataaaaagcgccttttttttatta

SEQ ID NO: 516997 - DNA, 183 bp, Homo sapiens
gatctagaggatctccggctcctgggtaggaagatgctgataatgatggtgtgggggccagtgtgatgatgatgctgatggggatgggatcaagaatgttgaggcatccccaatggattggacaattgccctaaagtccccaaaccaattaacaagacagacagggatgaggacggggtggga

SEQ ID NO: 516998 - DNA, 181 bp, Homo sapiens
  misc_feature (8)..(8): n is a, c, g, or t
atgcccangacgaagacctgatcgatctggaggaaacagatgacaactaaccgcgccttcagctacaagcccctctggaaactcctcatcgaccgcgacatgaacaaaatccaacttcaagaacgtgcaggcatcagtccagccaccctgtccaaactcggacgcggcggcaacgtcacca

SEQ ID NO: 516999 - DNA, 250 bp, Homo sapiens
tttccaaaacccctccaaacccaagaaccgcagcccctcccccttacccccaccaatcttattctaccctctccccccctctccccccccccatctttttcgaaacccaaaacatcctctttacacaggttttgcaaccaatctaccccctaactacaacaccatctctcctaaatccaaacccgaaacaaacacttcaaaccacaccccacctggaccccgcgaccactcttttcatcactccgtggtc

SEQ ID NO: 517000 - DNA, 597 bp, Homo sapiens
agatggagtcctgctcttgttgcccaggctggagtgcagtggtgtgatctcagctcactgcaacctccccctcccagattcaagcacctctcttgcctcagcctcctgagcagccgggactacaggcacccgccaccatgcctggccaatttttatatttttagtagagacagggcttcgcatgttggccaggctggttttgaactcctgacctcaagtgatctgcccgccttggcctcccgaaatatagggattacaggtgtgagtcactgcgcctggcctaagtttcagatccttatagctaagagactatttggatatctcacaggtattccaaactcaacacatccaaaacaaaacccaccatctctcccaaacctgctcttcttcccatgtttcctatcacagtgaatgtaaccaccatccaatcagatgtccaggctagaaaacttgaagttcactgatttctgacattatactttccattacctctaaaatccattcaattaccttgccctgctgaatttaccttaaaaacaacaacaacaacaacaacaacaacaacacccatctgtccacttctctttctaagagaca

SEQ ID NO: 517001 - DNA, 625 bp, Homo sapiens
  misc_feature (208)..(208): n is a, c, g, or t
  misc_feature (211)..(211): n is a, c, g, or t
  misc_feature (229)..(229): n is a, c, g, or t
  misc_feature (236)..(236): n is a, c, g, or t
  misc_feature (238)..(238): n is a, c, g, or t
  misc_feature (242)..(242): n is a, c, g, or t
  misc_feature (252)..(252): n is a, c, g, or t
  misc_feature (267)..(267): n is a, c, g, or t
  misc_feature (313)..(313): n is a, c, g, or t
  misc_feature (316)..(316): n is a, c, g, or t
  misc_feature (319)..(320): n is a, c, g, or t
  misc_feature (335)..(335): n is a, c, g, or t
  misc_feature (341)..(341): n is a, c, g, or t
  misc_feature (348)..(348): n is a, c, g, or t
  misc_feature (360)..(360): n is a, c, g, or t
  misc_feature (535)..(535): n is a, c, g, or t
  misc_feature (568)..(568): n is a, c, g, or t
  misc_feature (570)..(570): n is a, c, g, or t
tgcggactcgatcaccttcaggctctttttggtgtcttggcctagaattttatagagctgcttcttgagcttcatgatcccctctgcctggctggcaaatttctgtggctttggccccgggcgcctcctgagggctggtgaatcatgatacgggatttgggaaccaaatggccattcctggggtcccgccgccaaaaccagggaaccnatnttggcggcttggcccacncaccagntncaanacggttgagnatgtactgcatcgtntcgtaaatgccaggcccgcggtcaccacaccaccagggctttgatntanatnnggatgggcttcttgntgctcncggattncaggaagagganctgtgcgataacaaggctggcaacgctgtcatcgatcgggcccatgacgcacacgatgccgtcccgcagcagccgcgagtagatgtcataggcggctcgccgcgacccgtctgctccaccacgatgggaatgagcgggagagcccgggtgccgtcgcgtgcaggcaccgctgcanggccaggccgttctggagtgtcgctgcggctgngnctgcgctggaaagtgagcggcgagcgaggccccagcgcggggtacctgcatgacg

SEQ ID NO: 517002 - DNA, 432 bp, Homo sapiens
  misc_feature (303)..(303): n is a, c, g, or t
taacttgccccaaggtcacccaattgtaaatggtgaaacacagaacaggtaaacctcaaagagctatgcctccttgacccactgccttgccacagtgtggtagacagaaaaaatggcttctcaaaaacatccctaggctggacacagtggctcatgcctgtaatccccaggactttgggaggccgaggtgggcagatcacttgagtttaggagttcaagaccagcctgggcaatatggcaaaaccctgtctctactaaaaatataaaaattagccaggtgtggtagcacatgcctgtagtcancactacgcaggaggctgaggtgggaggatcacctgaacccaggaggcaaaggctgcattgagccatgatcatgccactatactccagcctgggcgacagaatgaaaccctgtctcaaaaagaaaaaaaa

SEQ ID NO: 517003 - DNA, 192 bp, Homo sapiens
ccagaccgggacctcctttgcatgctaaataaatgcagtctataccttaggaagcagaatactagtgttctaagggataaaagagagaagtaataaattggtactaacagggagtaagcgatttctatgctatagacatgctatactaaaatgtagcagtcagtgcaatcgtatggccaactttcaggagag

SEQ ID NO: 517004 - DNA, 394 bp, Homo sapiens
  misc_feature (4)..(4): n is a, c, g, or t
  misc_feature (163)..(163): n is a, c, g, or t
  misc_feature (222)..(222): n is a, c, g, or t
  misc_feature (230)..(230): n is a, c, g, or t
  misc_feature (235)..(235): n is a, c, g, or t
  misc_feature (281)..(281): n is a, c, g, or t
  misc_feature (289)..(289): n is a, c, g, or t
  misc_feature (302)..(302): n is a, c, g, or t
  misc_feature (312)..(312): n is a, c, g, or t
  misc_feature (320)..(320): n is a, c, g, or t
  misc_feature (333)..(333): n is a, c, g, or t
  misc_feature (387)..(387): n is a, c, g, or t
attnattattgcgtccatcttattatatttttccaaaaggagacagttttggaggttctgcttacttttgaacttccttttggaatgtattgaagaaggcaggtaaaggaatctttaggcagactgccatccagggacttctattcttttcacttacattcanctgttaacatcttttctttcttcctcttctgtcttctgcatgcaggcccggaagctgancgttagtnaatangtacaggaagggaaaagagaagagggcaaggcccatcccccaaganaggaaggnctcttattcaganggagcagganccgatgtngagacggccactncctctctcaccctcttttccatccctcttctcaagaaaaccaggcttaacaganttggaca

SEQ ID NO: 517005 - DNA, 768 bp, Homo sapiens
  misc_feature (14)..(14): n is a, c, g, or t
  misc_feature (20)..(20): n is a, c, g, or t
  misc_feature (23)..(23): n is a, c, g, or t
  misc_feature (25)..(25): n is a, c, g, or t
  misc_feature (27)..(27): n is a, c, g, or t
  misc_feature (30)..(30): n is a, c, g, or t
  misc_feature (52)..(52): n is a, c, g, or t
  misc_feature (67)..(68): n is a, c, g, or t
  misc_feature (72)..(72): n is a, c, g, or t
  misc_feature (74)..(74): n is a, c, g, or t
  misc_feature (91)..(91): n is a, c, g, or t
  misc_feature (93)..(93): n is a, c, g, or t
  misc_feature (103)..(104): n is a, c, g, or t
  misc_feature (109)..(109): n is a, c, g, or t
  misc_feature (123)..(124): n is a, c, g, or t
  misc_feature (134)..(135): n is a, c, g, or t
  misc_feature (138)..(138): n is a, c, g, or t
  misc_feature (144)..(144): n is a, c, g, or t
  misc_feature (150)..(150): n is a, c, g, or t
  misc_feature (160)..(160): n is a, c, g, or t
  misc_feature (193)..(193): n is a, c, g, or t
  misc_feature (198)..(198): n is a, c, g, or t
  misc_feature (206)..(206): n is a, c, g, or t
  misc_feature (213)..(213): n is a, c, g, or t
  misc_feature (216)..(217): n is a, c, g, or t
  misc_feature (228)..(229): n is a, c, g, or t
  misc_feature (234)..(234): n is a, c, g, or t
  misc_feature (241)..(241): n is a, c, g, or t
  misc_feature (243)..(243): n is a, c, g, or t
  misc_feature (251)..(251): n is a, c, g, or t
  misc_feature (254)..(254): n is a, c, g, or t
  misc_feature (258)..(258): n is a, c, g, or t
  misc_feature (263)..(263): n is a, c, g, or t
  misc_feature (277)..(277): n is a, c, g, or t
  misc_feature (279)..(279): n is a, c, g, or t
  misc_feature (284)..(284): n is a, c, g, or t
  misc_feature (286)..(286): n is a, c, g, or t
  misc_feature (298)..(298): n is a, c, g, or t
  misc_feature (323)..(325): n is a, c, g, or t
  misc_feature (333)..(333): n is a, c, g, or t
  misc_feature (339)..(339): n is a, c, g, or t
  misc_feature (342)..(342): n is a, c, g, or t
  misc_feature (345)..(345): n is a, c, g, or t
  misc_feature (350)..(350): n is a, c, g, or t
  misc_feature (366)..(366): n is a, c, g, or t
  misc_feature (369)..(369): n is a, c, g, or t
  misc_feature (374)..(374): n is a, c, g, or t
  misc_feature (378)..(378): n is a, c, g, or t
  misc_feature (406)..(406): n is a, c, g, or t
  misc_feature (416)..(416): n is a, c, g, or t
  misc_feature (429)..(429): n is a, c, g, or t
  misc_feature (432)..(432): n is a, c, g, or t
  misc_feature (438)..(438): n is a, c, g, or t
  misc_feature (448)..(448): n is a, c, g, or t
  misc_feature (477)..(477): n is a, c, g, or t
  misc_feature (480)..(480): n is a, c, g, or t
  misc_feature (484)..(484): n is a, c, g, or t
  misc_feature (488)..(488): n is a, c, g, or t
  misc_feature (504)..(504): n is a, c, g, or t
  misc_feature (508)..(509): n is a, c, g, or t
  misc_feature (528)..(528): n is a, c, g, or t
  misc_feature (531)..(531): n is a, c, g, or t
  misc_feature (566)..(566): n is a, c, g, or t
  misc_feature (605)..(605): n is a, c, g, or t
  misc_feature (612)..(612): n is a, c, g, or t
  misc_feature (623)..(623): n is a, c, g, or t
  misc_feature (626)..(628): n is a, c, g, or t
  misc_feature (687)..(687): n is a, c, g, or t
  misc_feature (701)..(701): n is a, c, g, or t
  misc_feature (703)..(703): n is a, c, g, or t
  misc_feature (707)..(707): n is a, c, g, or t
  misc_feature (710)..(710): n is a, c, g, or t
  misc_feature (715)..(715): n is a, c, g, or t
catctcgccccttncctttnatntnanagnagatacctccctcccagttcanctcatttagtaaaannaaantntgggtagaaaccccaantntccaaaatcnnttttntggtgggtgacccnntttatccaannganacagcngttgcncgaacctttnttttaagctttacgcgcacacggacaaaattcncaaantggagctnttttttnaanncggtttttggnntttgnttatttncncttacagntgnattnttttntttacatattttantnagaantnatttataacaantttttgaaatggtgctttggatttnnnatttcttnttattnttnttnatttntacaatttattggaanttnatttnacanttttacaacataagatagtatggagatntgaataattntttgttatataantgntttatnactgcttttnttcctagctaggctgctattattactatnatntgtnattnataaagccttcatcantccnncatttttcttacggtcggngcntcagaacaagcgtttagactccttgggtccgtganttcctagagcttggctgggtctaggctgttctgtgcctncaaggantgtatggcaangannngtattggccaccaactgtagatgtatatatggtgcccttctgatgctaagactccagancttttgtttttgcntngcanttnctgantttataccaactgtgtggactaagattcattaaaataaacatcagagtaactc

SEQ ID NO: 517006 - DNA, 284 bp, Homo sapiens
tgtcccggaggctagtggtaccagatggccaggacataccaggttattgagaagttctgcatagtttgaatcgatttgcataatcgagaaagccagacaatgttaacagagagatagctatctgtaacacattagaaaacaaaagagaacaaagcagagcacaaactctccagttcaccttgctcattagagagatggaatagggggtgaaagtgaaaaaaacacataagcacaatttatatcgaagggaagaaattgaagtggagttaagaaccatactcctt

SEQ ID NO: 517007 - DNA, 266 bp, Homo sapiens
  misc_feature (89)..(89): n is a, c, g, or t
  misc_feature (113)..(113): n is a, c, g, or t
  misc_feature (199)..(199): n is a, c, g, or t
  misc_feature (208)..(208): n is a, c, g, or t
  misc_feature (215)..(215): n is a, c, g, or t
  misc_feature (229)..(229): n is a, c, g, or t
  misc_feature (242)..(242): n is a, c, g, or t
  misc_feature (256)..(256): n is a, c, g, or t
attcggcacaggcaccagcagaccctgctctgcccggggcttctgagccatggcagtgtcccttcactgcatccctctccattgggggngtgtctaaggaccctttccccttnggcatggccagtccaggggtctctttcaagtccctggtgtcgtcttatgagacccgagtggttgggatggctccggggctgccccnaaaaagggntgtgctnttccccttgctctncccgggtagcatnccccatccgagggncatctggggc

SEQ ID NO: 517008 - DNA, 937 bp, Homo sapiens
  misc_feature (663)..(663): n is a, c, g, or t
  misc_feature (925)..(925): n is a, c, g, or t
ggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataactgtggggaaagattggagaaggctggctcgtcagctcaaagtctcagacaccaagatcgacaggcatcgaggacagaataccccccgcaaacctgacagagcgtgttgcggggagtccactgagaaatctggaagaaacacagagaacggagaacgcaaacagtgngcccaccctggtggggggctctcagggtccttgccagaatagaacctggtggctgacctggttacaagacggttcagaaggcccgtgacctccagaacaggagtggggccatgtccccgatgtcatggaactcagacgcatctacctccgaagcgtcctgatgggccactgctttgcgctggtggaacacaggcatctacacagcctggactttggttctctccaggaaggtagcccagcactgtgaagacccagcaggaanccaggctgagtg

SEQ ID NO: 517009 - DNA, 336 bp, Homo sapiens
  misc_feature (4)..(4): n is a, c, g, or t
  misc_feature (136)..(136): n is a, c, g, or t
  misc_feature (298)..(298): n is a, c, g, or t
gaanatggagtttcccctccttgttgcccccggctggagtgccaatggtctgatccgcagcctcagtgcaaccctcctgcctgccccaggttcaggtgattctccctgcctcggcctcccaagtagttgggattanaagcatgcgcccaccatgccctggctaattttgtatttttagtagagaatgttggtccatgttggtcgggctggtctcgaactcctgacctcaggtgatctgcccgccccagcactttgtgaggctgaggcacgtggatcacttgaggtcaggagtttgagnccagtcagggcagcatagagagaccccatctctacaaa

SEQ ID NO: 517010 - DNA, 1014 bp, Homo sapiens
  misc_feature (482)..(482): n is a, c, g, or t
  misc_feature (487)..(487): n is a, c, g, or t
  misc_feature (496)..(496): n is a, c, g, or t
  misc_feature (507)..(507): n is a, c, g, or t
  misc_feature (513)..(513): n is a, c, g, or t
  misc_feature (530)..(530): n is a, c, g, or t
  misc_feature (540)..(540): n is a, c, g, or t
  misc_feature (546)..(546): n is a, c, g, or t
  misc_feature (549)..(549): n is a, c, g, or t
  misc_feature (552)..(553): n is a, c, g, or t
  misc_feature (557)..(557): n is a, c, g, or t
  misc_feature (573)..(573): n is a, c, g, or t
  misc_feature (582)..(582): n is a, c, g, or t
  misc_feature (585)..(585): n is a, c, g, or t
  misc_feature (594)..(594): n is a, c, g, or t
  misc_feature (606)..(606): n is a, c, g, or t
  misc_feature (615)..(616): n is a, c, g, or t
  misc_feature (619)..(619): n is a, c, g, or t
  misc_feature (621)..(621): n is a, c, g, or t
  misc_feature (624)..(624): n is a, c, g, or t
  misc_feature (636)..(636): n is a, c, g, or t
  misc_feature (641)..(641): n is a, c, g, or t
  misc_feature (649)..(649): n is a, c, g, or t
  misc_feature (654)..(654): n is a, c, g, or t
  misc_feature (683)..(683): n is a, c, g, or t
  misc_feature (694)..(694): n is a, c, g, or t
  misc_feature (705)..(705): n is a, c, g, or t
  misc_feature (710)..(710): n is a, c, g, or t
  misc_feature (713)..(713): n is a, c, g, or t
  misc_feature (716)..(718): n is a, c, g, or t
  misc_feature (721)..(722): n is a, c, g, or t
  misc_feature (729)..(729): n is a, c, g, or t
  misc_feature (736)..(736): n is a, c, g, or t
  misc_feature (741)..(741): n is a, c, g, or t
  misc_feature (748)..(748): n is a, c, g, or t
  misc_feature (752)..(752): n is a, c, g, or t
  misc_feature (757)..(757): n is a, c, g, or t
  misc_feature (764)..(764): n is a, c, g, or t
  misc_feature (769)..(769): n is a, c, g, or t
  misc_feature (771)..(771): n is a, c, g, or t
  misc_feature (774)..(774): n is a, c, g, or t
  misc_feature (776)..(776): n is a, c, g, or t
  misc_feature (779)..(779): n is a, c, g, or t
  misc_feature (787)..(787): n is a, c, g, or t
  misc_feature (793)..(793): n is a, c, g, or t
  misc_feature (816)..(817): n is a, c, g, or t
  misc_feature (820)..(820): n is a, c, g, or t
  misc_feature (827)..(828): n is a, c, g, or t
  misc_feature (834)..(834): n is a, c, g, or t
  misc_feature (836)..(837): n is a, c, g, or t
  misc_feature (841)..(841): n is a, c, g, or t
  misc_feature (849)..(849): n is a, c, g, or t
  misc_feature (851)..(851): n is a, c, g, or t
  misc_feature (858)..(858): n is a, c, g, or t
  misc_feature (868)..(868): n is a, c, g, or t
  misc_feature (872)..(874): n is a, c, g, or t
  misc_feature (892)..(892): n is a, c, g, or t
  misc_feature (897)..(897): n is a, c, g, or t
  misc_feature (905)..(905): n is a, c, g, or t
  misc_feature (909)..(909): n is a, c, g, or t
  misc_feature (917)..(917): n is a, c, g, or t
  misc_feature (922)..(922): n is a, c, g, or t
  misc_feature (926)..(926): n is a, c, g, or t
  misc_feature (938)..(938): n is a, c, g, or t
  misc_feature (941)..(941): n is a, c, g, or t
  misc_feature (943)..(943): n is a, c, g, or t
  misc_feature (949)..(949): n is a, c, g, or t
  misc_feature (1007)..(1007): n is a, c, g, or t
ggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcgcggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctatgataccgcctttcncatcntcttatctncttttgagccntctttncgccaagtttataatgntgtcccttgngctcgnagnctnngacncagctacagcgctctnggggatgcnggntcgctctgntttgggggcgtncgtgcaccnntgncngcngcgcgcgccggngccgngccgcatnggggnggtggtggggggtgagcggtggtgggcgnagccggtggtnggtgcggtagncaccnccngtnnngcnnggggtgnggtggcnccgcngctattnaggnatatngggctgntcttngngtncncgngcatgtcngttgancagagtgatgctgggggagtggnntgngtggatnncgcgcngnntgangcgcaggntncgttttnatgtgtggcngacnnncagggcaacgtagttccncgggnagctggcnggcnggtgcgtnaagancccngcggttgttatncgntncagatnggttcttcatggtgtgggagcgccgggaggggtttgggggtgcgcccacattggtttnttgttca

SEQ ID NO: 517011 - DNA, 1331 bp, Homo sapiens
ctccgtccgtttcgtctttctcgttgctttgtctttttttcgtgcgtccgtcaccgcgctcctggagtgtctcgctctcgtcccgtctttgcgcctgctgcccgctgtttctgctccctggtcgtgttgcggtcggcgtgctctggtcgtctgtgtctgcttcgctgctgtttggctgtgtttgcttcgcgcccccccgcggcttgtggtggcgtgctgtggtttgttctcggcggtgccgttcgcgtcatgtttgtcgtgcgcttctcgttgtctgtcgggcttgtgtgtcgtctctcctcccgcccggttcggctcggccgctgctgtcgactgcccccgcgcggctgtcctgccttggcctgtcgtctgtctgctttctcgctgtcgccggcgtcgtgctcgctcttttctgctggtcttgctttgcctttcttttccagggttccctttctctgcttcggttctccgtgtctttgcttgtcgtgtctcttcgcgctggtcgcgtgtgctgtggtctctccgtgggggggggctataatatttaacgcacagaggcttctctttatggtgggaaccgccgtccaagcgtctccccctctggggggacttcccaattccccaccgccgtggtgtgttggagccccctccccacctattgtgaagacacccccggggcgccgagttccccaggccttccctcggggctttttttgcgctatgggccccccggggacccggattttccccaattttctcaccacccaaggagtaccagccctattggccccctttatggccctatattttatggtgaccccacgtagtatggcaccaagtgttgtacacacaaaaaccccaaggcctggtacaccggtctcccggagatttctccccgcggaatattctcgtctgacacccacagcggtctccgcgcccccgccggaggaccccaaagattggccttgccgaagaattctcggccccctttctcctccagggatgccctggggacacaggaggccccgtgctggtccgtgtcccttctgtctgtcgggggccctccgcctgtaattcttgccccccattgaggcgcccctacttctcagtatctcccgtccttgagtccacccaggcccaccgccctatcaactatcccacgtgcccgctccgctgatgatgggaaacactgcccgaacgtgcccacgccaccccccacggagccctcacgggccccacgcctggaagtggctgaaagaaaactgtgaagcaccctccacctgaacagaggcggcccctcccccggctccccattaaaatgtggaaaccca

SEQ ID NO: 517012 - DNA, 853 bp, Homo sapiens
gtatccttaatcatttgtatgccacaactaacctcctcggactcctgcctcactcatgtacaccaaccagccaactatctataaacctagccatgggcatccccttatgagcgggctccacgtgattatagtggcttgctgctctaagattaaaaatgccctaagcccatttcttagccacaagggcacacctagcaccccttatcccgcagtactaagttattatgcgaaacgcagtcaggcctactcagttcaatcggcaatagccctgggcgtaggcctaacgcggtaacattactggaggccacctactcatgcacctaattggaagcgccagcctagcaatatcaaccattaagccttccctctacagcttatcatcttcacaattctaagttctactgactatcctagaaagtcgctgtcgccgttaatccaagcctacgtggttgcacacttctagtaagcctctacctggagcgagcaacgcatcaaataaaagaggcatctggaaacaaaaagatggttggggggcagctcggggaatccaagaagcctcaaaagcaagatcttgcgtcgcggaggaccctcctgctgggaatccgaagaatgaggggtactttcgagaatcggctcgagacatgaggccggatgtcgccactacgaaaccggcgggaccccgcgggtctgaaccacccaaggggcacgagggctaccgggtccacacaggggccggagtgaatgtacccgcgcaggggtcacaggacaccgcggtaccgcgcggcatggcgtctcgagcacgctaacggcccattcgcgcccagacaccatcacccaggaaagcccgcggacc

SEQ ID NO: 517013 - DNA, 1523 bp, Homo sapiens
  misc_feature (835)..(835): n is a, c, g, or t
ggagagggtgtttgtgtctttggtccctgctccttttgtggttctttgtttctcttccccgggggtgttcttctggttcgttcgcacttgctgtctggtggtggagggactctctggacgttttgtccactggccattggactcctggttgtgaactgcggcccctctgcgtgctattgatgatgggtttgatgttgtttcgtcccacgcgtgtttgcaggatgcagcccctgttcccccggggtcttcccaagtggtcgaccatggggttcccagttcctcctgggtagtgtgttgccggtgtgcacgcgcaccttgtgtcgtgtgtagcgctcatgtcccagtgcgcctgtatgtctccctctcccctaaagggaaggggggttttcgttctcccggattgttttagacccgagtttttttgtgatgcttgcctaggcctttggtgtgtgtacacaatgacgccgcggaggggtaaaatttggggaaaaaggaatgtgtagaccccagcctgttgtttatgaaatacaatagggtgttgaagagtaaatgttggtttgtccttttttgcctgtacaaattgtttggccgttggtagtactccccggccccccgtgtgtatcgtgctatgtatctgttgtgcgcccactatatgagttgtatgtcgggcgttcccccatgtcgcggccattgtggccaccccacagacctttgggggggccctcttctcggatagaggtggtttttcccccggcccgctcttgttggtggcccacgtcttgtgccccccttgtggaggcgttttttccagcgccacgcccacttgggtgttgtnatgtcttctcggaggccgcacacgggtggttgtctcgggtggtgtgcccccacaggtggatttgtctgtagggcccccccggtgtaggccctcactcccgcgggggcccccgcgagccgcgcgtgttgtctgggggaagaccccccagaacggggatcaccgcagttgttggggggccccgcgtatagagttgtgtatagcctcgtttttgtccctggtgggaacctcgtgtgtgggagatgtggccactctctggttctgtcctggtgcgccccctcttctggcttcaaccaaggtgtccaccagcggccaagacgtccctggccagaacatttgggtgtttgcttctttttgggtggggtttcttataaggtcgccctgtattgttgcccacaccgacagttctttgtgttgtccctgtccgagacaccttgtgtaatggcctagaagaagagagcctccaggttaactagaagatcccgggttgcgttggtgttactgggtttataagaaaagttggtgaagccaccgtcgtgaccagtgtccctgtgatgtgacgtccacctgctccaggtttaaagaatgttctttttttgtaaaggtccagaccctgtgacctgtcaaaaaatgttgcgcccttttgcgggacccgatttttaagataaaataaatagtttttaccgtctgt

SEQ ID NO: 517014 - DNA, 348 bp, Homo sapiens
aactctcctatagatcagtaaaaaaaaaatggtattattaaaaattaaaaaagtgttggccgctgccgggcgtggtggctcacacccataatcccagcactttgtggaggccgatggccggcggatcacctgagtgttgggagttcgagacaagcctggccaacatggtgaaactccatctctactaaaaatacaaaaattagctaggcatggtggtgcatgcctgtagtcccagctacttgggaggctgaggcaggagaatcacttgaccccagggggcggaggttgcagtgagccaagatcgcgctactgcactccagcatgggtggcaaagcaagaccccatctc

SEQ ID NO: 517015 - DNA, 318 bp, Homo sapiens
  misc_feature (24)..(24): n is a, c, g, or t
  misc_feature (84)..(84): n is a, c, g, or t
  misc_feature (92)..(92): n is a, c, g, or t
  misc_feature (121)..(121): n is a, c, g, or t
  misc_feature (151)..(151): n is a, c, g, or t
  misc_feature (167)..(167): n is a, c, g, or t
  misc_feature (188)..(188): n is a, c, g, or t
  misc_feature (202)..(202): n is a, c, g, or t
  misc_feature (227)..(227): n is a, c, g, or t
  misc_feature (234)..(234): n is a, c, g, or t
  misc_feature (296)..(296): n is a, c, g, or t
ggccagggggcaaggcggcccacnaaactatggaggaaaaacgcaggctgcttcagaacaagcggaaggagcccccggaaaatntggcccancgggctgcccggctcaaaacatttccttncaaaaggtttaaggagggcccctgtcaacncgggggccagtgttgntactcccccagccccccgacncccagggtttttgntgatgctgcccctgactgtccaaanacctccnaccagaccccccctgggcctggggctgccgctgggccaggcatagactgaaccaataaaaanatgtcccgtccccttttcccga

SEQ ID NO: 517016 - DNA, 221 bp, Homo sapiens
  misc_feature (16)..(16): n is a, c, g, or t
  misc_feature (39)..(39): n is a, c, g, or t
  misc_feature (91)..(91): n is a, c, g, or t
  misc_feature (112)..(112): n is a, c, g, or t
tcactggccaagaganttctccctacattaaggagcaantttttgttgtttacttttaccctttcctagtgttgacttaaacaatgaatgntcaatgtaggtgagttcaaantctagtttgtttatattgatcacttttagttactcaataactttaaaggttggttgcaaaactattttgttttttgcagtctctgaaaagaggattctgagatgttaaa

SEQ ID NO: 517017 - DNA, 865 bp, Homo sapiens
  misc_feature (44)..(44): n is a, c, g, or t
  misc_feature (68)..(68): n is a, c, g, or t
  misc_feature (77)..(78): n is a, c, g, or t
  misc_feature (92)..(92): n is a, c, g, or t
  misc_feature (96)..(96): n is a, c, g, or t
  misc_feature (114)..(114): n is a, c, g, or t
  misc_feature (116)..(116): n is a, c, g, or t
  misc_feature (150)..(150): n is a, c, g, or t
  misc_feature (197)..(197): n is a, c, g, or t
  misc_feature (224)..(224): n is a, c, g, or t
  misc_feature (227)..(227): n is a, c, g, or t
  misc_feature (232)..(232): n is a, c, g, or t
  misc_feature (239)..(239): n is a, c, g, or t
  misc_feature (246)..(246): n is a, c, g, or t
  misc_feature (250)..(250): n is a, c, g, or t
  misc_feature (312)..(312): n is a, c, g, or t
  misc_feature (317)..(317): n is a, c, g, or t
  misc_feature (341)..(341): n is a, c, g, or t
  misc_feature (354)..(354): n is a, c, g, or t
  misc_feature (358)..(358): n is a, c, g, or t
  misc_feature (360)..(360): n is a, c, g, or t
  misc_feature (369)..(369): n is a, c, g, or t
  misc_feature (376)..(377): n is a, c, g, or t
  misc_feature (379)..(379): n is a, c, g, or t
  misc_feature (387)..(387): n is a, c, g, or t
  misc_feature (393)..(393): n is a, c, g, or t
  misc_feature (397)..(397): n is a, c, g, or t
  misc_feature (400)..(400): n is a, c, g, or t
  misc_feature (405)..(405): n is a, c, g, or t
  misc_feature (409)..(409): n is a, c, g, or t
  misc_feature (435)..(435): n is a, c, g, or t
  misc_feature (470)..(470): n is a, c, g, or t
  misc_feature (490)..(490): n is a, c, g, or t
  misc_feature (541)..(541): n is a, c, g, or t
  misc_feature (543)..(543): n is a, c, g, or t
  misc_feature (549)..(550): n is a, c, g, or t
  misc_feature (552)..(552): n is a, c, g, or t
  misc_feature (554)..(554): n is a, c, g, or t
  misc_feature (560)..(562): n is a, c, g, or t
  misc_feature (567)..(567): n is a, c, g, or t
  misc_feature (569)..(569): n is a, c, g, or t
  misc_feature (574)..(575): n is a, c, g, or t
  misc_feature (580)..(580): n is a, c, g, or t
  misc_feature (586)..(588): n is a, c, g, or t
  misc_feature (592)..(592): n is a, c, g, or t
  misc_feature (597)..(597): n is a, c, g, or t
  misc_feature (602)..(602): n is a, c, g, or t
  misc_feature (605)..(605): n is a, c, g, or t
  misc_feature (618)..(618): n is a, c, g, or t
  misc_feature (620)..(621): n is a, c, g, or t
  misc_feature (624)..(624): n is a, c, g, or t
  misc_feature (636)..(636): n is a, c, g, or t
  misc_feature (638)..(638): n is a, c, g, or t
  misc_feature (640)..(641): n is a, c, g, or t
  misc_feature (644)..(646): n is a, c, g, or t
  misc_feature (665)..(665): n is a, c, g, or t
  misc_feature (671)..(671): n is a, c, g, or t
  misc_feature (681)..(682): n is a, c, g, or t
  misc_feature (686)..(686): n is a, c, g, or t
  misc_feature (689)..(689): n is a, c, g, or t
  misc_feature (697)..(697): n is a, c, g, or t
  misc_feature (699)..(699): n is a, c, g, or t
  misc_feature (701)..(701): n is a, c, g, or t
  misc_feature (704)..(704): n is a, c, g, or t
  misc_feature (706)..(707): n is a, c, g, or t
  misc_feature (711)..(711): n is a, c, g, or t
  misc_feature (713)..(713): n is a, c, g, or t
  misc_feature (720)..(720): n is a, c, g, or t
  misc_feature (724)..(726): n is a, c, g, or t
  misc_feature (731)..(731): n is a, c, g, or t
  misc_feature (734)..(734): n is a, c, g, or t
  misc_feature (740)..(740): n is a, c, g, or t
  misc_feature (742)..(742): n is a, c, g, or t
  misc_feature (762)..(763): n is a, c, g, or t
  misc_feature (766)..(766): n is a, c, g, or t
  misc_feature (783)..(785): n is a, c, g, or t
  misc_feature (787)..(787): n is a, c, g, or t
  misc_feature (789)..(789): n is a, c, g, or t
  misc_feature (794)..(794): n is a, c, g, or t
  misc_feature (798)..(798): n is a, c, g, or t
  misc_feature (802)..(802): n is a, c, g, or t
  misc_feature (859)..(859): n is a, c, g, or t
ccacatctatttacacagaatcattgtacaggatttacagcaanatgctacacatagcatctattctngataagcgnnaaaggtgtaagaanagantggggaataaagctctgnantcaaagtgtaagcagaaatctgaaggtaggtgtncaaggaaggataagggccaaatgatgagcgaggttggtgaggtaganataagggaggttgaggaaacatccaanaanttgtngtgcagngatatangggnagagtccactggcacatagtcttaaaaattatgtttggagtttgaaggaggtaaaatcttcnataanccacctctgtgagaaaaaagaagncagttatgaaccntacngncctaaaccntagtccnncnctatcaanaagtanttcntcngattnattncctggataggagaatgagaatgtttnaaaaagaaagagagagatgcatagacacagaaccntaaacagagttaagagacanaaagtaaatatattcaagagagacacatagaaagaggaaaagaacatgaancncatgcnnancnagaaannngagananccgannaactncacgannnatcnttccntaccncancttccccaaagcncnnccnccaccccgaaancncnnaannncgaactttaaccaaagagnagaatncgaatgaggnnggcncangggggacnancnaanannccancncaccaantcannnccccnccntatccngnaccggaaggcagggcttganntgnagccagggatatattannntnanaatanacangatngaggacacgagggcacaaagccccacaatcccagggccacagcgccatacgcctatntttgtc

SEQ ID NO: 517018 - DNA, 110 bp, Homo sapiens
cggattcttgcgggagcagggattggggcacagtttaggcactgtgttgactcacacagtggaggggaacagcttccattgaccctcgctggcttttgtgtgttattaca

SEQ ID NO: 517019 - DNA, 1478 bp, Homo sapiens
agcgggctcacagcctgctctcagaagctccgatccagacaacatacaagcactgtcctttcagcacacacaagctcgggctgaggagggaggactcctggaccgtacatccatctacaaactcaggctctgaactcatgcatcgtgaccaccccacgagatgcgagccacaagactgggcaagacacaggcgtacaggatggtcgacacgactgcaacagctaaccaccagacagcgaacgaggaaccaacaccagcacattcagacctgagcgcatgggcctataccacgacacgaacaccgtctcactcaccatcacccttgcgcaagcgcataacacgtcacaatgacccacgcctgcccctgacatccccagcacacaacggatgactatgctggacaagcaccaaatgataacaggcaagtacatcacagcacacggagaaaaccagaccagcaccacaacacagggcgaaaacgaattccacaggcgcaactgcacccagaaacaaacacgtcaggacaatgcaacaagtgtagcaacagcagaatacacagcaccaatccccatactgcatcgctcaagcaccattgagacacgacacagtcacgaccattataacaccacacaattgaaccagactagaccaccttaccgaaaagaataagcaacctaggcagacatcggcggaacacagataccaaaacaacacggcaccgcatacatcgaggccacactctaatatagcaaagctccaacaccacacggacatcattgcgcacaccacaaaggccacgcagcaggaaacatcaacagcaatccagctaacctaacagagcacaacaacccacaacagccaggccaccagtactaacttaccaacgacagaccccacattacaccacactgcaaggaaactgcaccatgcagtacccataacacaaatcacacataccacaccaacgtaggaacaaccacacagaccacaacgaaccaccacgacaaacaccgacgcccggccacataccaccaacacgacacccaacgaccccaaatcacgacaaacacaccagcatacacaaacgcaccacattggcgcaccaccacaaacgacaacaaaacaaaaaacaatacactggaaacaaaagcagaaaaaccccacaatcacagcgactgacaacccagaacagcgacaaccagtcgacatccctagcaagcacatagaacacagagcatcatggacaatcaacactgtggcaacctgcatcaagatcgacacaccaacacacatacaggaaccccacaccaaaacaaaaacaccaccacgccaccagaggcacacacgcaacaccatgaaaacacacagagacccacccctgagcccacacacacgaaagaccactaacagacacacacactagagcggccggaccgaacagcataagaacacacagatcgaccaaggacacgcacacc

SEQ ID NO: 517020 - DNA, 101 bp, Homo sapiens
agttgaactgggcagtcggtgacaccattcccactgtgggtactacgtggagacggtgacttacacaaaatgtcaagttcaacgtattgggatgtgggcgg

SEQ ID NO: 517021 - DNA, 169 bp, Homo sapiens
tgtaagaagtgtgtcctagttgttacacaacagcatatgagtcatgtcaccatcattattgccatcacccatctttatagtaacaagaaggtagttccttcacactctaacctaagagctttttcttcatcttcacctggcttatggttcttttgctacagaccccatg

SEQ ID NO: 517022 - DNA, 390 bp, Homo sapiens
catcgctttatcgcgtcagcactgtgcgaggattcgaagctgggtgtgaagtgctgggcgtctcggtaggactctcagttacaccacctggcttggatcaacaccccccggaaagagggaggcttgggaccgctgaacatccccctgcttgctgaacgtgaccagacgcttgtctgaggattacggcgtgctagaaaacagatgagggcattgcctacaggggcctctttatcatcgatggcacgggtgtccttcgctagatcactgttaatgattagcctgtgagacgctccgtgaatgaggctctgagactgttccagtgcttccagtacacagacgagcatggggaacgtttgtcccgctggctatcatcgtgtcactgccaggctt

SEQ ID NO: 517023 - DNA, 311 bp, Homo sapiens
  misc_feature (25)..(25): n is a, c, g, or t
  misc_feature (46)..(46): n is a, c, g, or t
  misc_feature (226)..(226): n is a, c, g, or t
  misc_feature (229)..(229): n is a, c, g, or t
  misc_feature (248)..(248): n is a, c, g, or t
  misc_feature (260)..(260): n is a, c, g, or t
ctggcacatagtaagtgctatacantcttcatttgtttgtttgaanacagggtatcagcactttgggaggccaaggtgggcagatcacctaaagccaggagaccgagaccagcctggccaacatggcaaaaccaactctactaaaaatacaaaaattagctgggcatggtggtgcatgcctgtaatcccagccacttgggtggttgagacacaagaatcatttganccntggaaggaagaggttgcangtgagccgaganctgtatcactgtactccagccttcagcaaagagagcgagacttctatctca

SEQ ID NO: 517024 - DNA, 284 bp, Homo sapiens
  misc_feature (1)..(1): n is a, c, g, or t
naggcaagctatccggttcactggtatgtatcattcctttaatgggatctgaaatggccctgcctcatgcccaaattccagtcaataattaattacacttattaaagtgtcagagtatatccccctcttaaaaatgcaaaaataagttttttagaggacaacattagctattagcatatgcgctattttctgatttcttatggatcacatttttttctgtaccatatacataaaaaatgtacataaatttgaaatccatctgatacattgaaccggatagcttg

SEQ ID NO: 517025 - DNA, 136 bp, Homo sapiens
tcatcagctggtccggtgttcctttgtctcctaagtcttttattcttcttcttgagacagagtctcgctctgttgcccagtgctggagtgcaatggctcaatctcagctcactgcatactccacctcccaggttca

SEQ ID NO: 517026 - DNA, 202 bp, Homo sapiens
tatttgcagcagctcacctcaggaagggctctggcatgtaaagctgcacagaagtcaaatcagataaagcctgagagggatccatgggatttcttggcaaaggggattgtatggtgataccacggaagcgcagcttcatgtggctcatggggcagagaagccagattacaggagatcagcaaccgagagagtgagtggcgag

SEQ ID NO: 517027 - DNA, 281 bp, Homo sapiens
  misc_feature (61)..(61): n is a, c, g, or t
ggctgaggcaggagaatggcgtgaacccggaaggcggagcttgcagttagccgagatcatngccactgcactccagcctacatgacaatgtgacactccattctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagaatgagatcctgtcaaa

SEQ ID NO: 517028 - DNA, 200 bp, Homo sapiens
ggaatattaaacacatggcggggaggtcaattcccgtttctgctcttaaaaggattactccctatggaaaaaaagattactcctaagcacacatgactacatgtggtaggtacatactctaaagtagtgtatctacatactatggtatttaacctttaacgtttcccctattaaagagattggtcatcctgcaaatgtgg

SEQ ID NO: 517029 - DNA, 387 bp, Homo sapiens
tagaggatacagcgggtactctcagtcacttatcagcagggtaaatacgagctcaaattaaggcatttttgtggcttgttcctctggaatggcattctaccatatgaaactgccacttgagaatgtgaagtgagaaagccaggcgctttggaaaccaatgctctaccataaacaccctttccccacacatagaaggacagatggtgagggaaggacaagaggaaaaaaccgggaactctcaagttacttatcagcaggggtcaatacgagctcaaattaaggcatttttgtggcttgtcctctggaatggcattctaccctcccagcccgagcagccctaaccttaaagcatgatgctctgactgccatgtgagttccctagtttcc

SEQ ID NO: 517030 - DNA, 425 bp, Homo sapiens
  misc_feature (289)..(289): n is a, c, g, or t
  misc_feature (323)..(323): n is a, c, g, or t
  misc_feature (339)..(339): n is a, c, g, or t
  misc_feature (367)..(367): n is a, c, g, or t
  misc_feature (405)..(405): n is a, c, g, or t
agagatctgtattcaaatcatactgcgttccctggagaactagggtccagctgcggcccattctgtcccctgcaagtcccccatccccaacaatctctacactccctagtctccacagtggaaagctgttcaaggtgtaagccatgaacggtgacagtcgtttcgcttattatgtctggttcctttccagcgtatgaacttcttgacacaggggccctggcttcgcacttctatcccccagcactccagcacctagcccctgtcagggcactgtccgtcttcccaccgnccaagtcctcactaaccaacctgcttcactcagnctaaacgcactgctgngcaaaatcttcaattcccttttcccctnttgttattttgaggggatacagcattcttcacaggggntaaggcattaaccctgggcg

SEQ ID NO: 517031 - DNA, 1363 bp, Homo sapiens
  misc_feature (321)..(321): n is a, c, g, or t
cgctgcaggtggtgcgcgcccgtaagcagatcgtaattggggtgaactatttcttggaacgtgtgagcttgtggtcgataccacggatgtaccaacgtacaccagcccaatctttgtgcagcaaacctgcccgctatccagtgagcacagccatcactcatgaacaaggaacatgacatttcgtgtctctttgccacgatctagcgctggttgctctttgcgttagggctacaaacataggaccttgtgccgtaaatcctacctagtatcagtgacgcctaatgggtgtctggtaaccagggctaggcctgttgccaaatnctacctgctttgattgctacgagcttcatcgatcactccaatgttggttctctcaatcaccgtgtgtaccatcggtggtgcacgctgcacctagtgagtgatatggctagttcacgcgaatgttgcactggtcagcaccagcgcaggacgcgaataatgtatcacacggtccacgcatgagccggtaacattcgagttctggcttactagccacaagcgcgggctgcttcgagacacgtcaattcttcacgtcgtcgcatctttcctgtgctctttactttcataaagcgccacacggcgatagttatgcggaggatagtcgattacttagcctcgccaagtcgtctcctgggcaagccccataaagtgaatttaagatcttctggtgctttattcaacaccggtacaggaggttgcgccccattggaacctgggcacattcaggtattatacggcgagagacagccttcaattccaacataaagaaagcaattcccggtaacgtagagagaccggaacaaccggtaacattaacggtataggcaaagaccgtccaacttttcccgaactaatagtccgtactcaacattaagggaaagcgctagttgatttattaggaccaaagttccactaaggagaagggggttgacaattttcctctgttatgaaataatcgccgcgttaatgaacttcgaggaggctaaacgagcccgcttaaaggaagcgaaagaaccttataggggccgagaaagaatccccactttttcacacctaattcgaggttaagttcaaatacgtgagctgttacagaagttacataaccattttctctttaccccgaagaaataaacagtgttgtcctacgggaggagtaaatcacgggaacaaattgtccgccgagcaagggatatcattacggcgagttaacaccacagaacatggagaaaataccctcacagtgggaacaatgtccacaacttcatctcgtgaaaaggcgccagacattcaatattctccgaaaacacgctcatgtcactagggg

SEQ ID NO: 517032 - DNA, 664 bp, Homo sapiens
cggaagagagtggtggttaaaaacagttaattctttctgcgtggttgttaaaagaagaggcctcggggaaataaaccaaattgctcgaggtggtggtgtttaacatggagtcttaaatgtagagacttataagattaagcgaaggactgtcaatctgagcgttgatcaaatattctatgtgttaaggcttaaaacttctgtgtaataggataagaacaaatagcactggaactctagcgcgcgattcctctaaatactagtcttagccttgggttaatgagaagtgaacttctagtctagacactgatgcttagtctagggtctgaagcttactctttatatcaggctctaaactgtgttctgagtctggacagtatgtgtaaagttacagttaagaagttattatggaacctgtgctctaaaagttgcgtctagtgctgccccttggttctgatttctgcctgtcatatccagactaatatgtactttctccataaagatgtgagaacatggcttgggtattgtcctcagtttggggctattctttaggattaagattgtctatctctggttggctggtcttggatgtatttccaaggtttaccaagtctctatgctgtggctggagatctctcctcctgggctcccgtgaggggctcttgtc

SEQ ID NO: 517033 - DNA, 321 bp, Homo sapiens
  misc_feature (92)..(92): n is a, c, g, or t
tagataaattgcccctatatacaaattaaagaccttcagtgcatcaaaggatacagtcaacagagtgaaaagcaatcctatggaataggagnaaatatttgcaaataacgggttaatcttcacaatatataaagaactcctgcaactcaacaacaaaaaaaaaccccagtttcaaactgatcaaagaacttgaataaacatttcttcaaaaaagatgatataaatgtccaataggcaaatgaaaagatgcttaacattactaatcattaggaagatgcaaatcaaaaccacaatgagatagcacctcagcacctcacacca

SEQ ID NO: 517034 - DNA, 451 bp, Homo sapiens
aacccttatcaacatctcatttcttagctttattgtctttgaatgaaagttaagtttagtctttttttattatttataaaatggagtctcgccctgtcacccaggttgaagtgcagtggaataaatctcggttacactgcaaggctccgcctcctgggtacatgccatactcctgcctcagcctcccaagtagctggaactacaggcgccaccacgcccggctaaattttggtattttaagtaagagtatggtttccactgtttgttagccaggtatggtctcgatctcctgaccctgtgatccgcccacctcaagcctcccaaatgtgctgggtttccaggctgtgacccaccatgcccgggccaccttcttccttttaaattctctccctttactttctctaactctaacttaatctagataagtgtagagaaatgagatttaggacgg

SEQ ID NO: 517035 - DNA, 920 bp, Homo sapiens
tatcctataaatcatattttgattcgccacaactaacctccttcggactcctgcctcactcatttacaccaacccatccaactatctataaacctagccatggccatcccctttatgagcgggcgcagtgattataggctttcgtttctaagattacaagtgcgccttagcgccagctatcgtatacgcatcaaaggccacagcgctatcaccccgttagtccgccgaatactaggtatacttagtcgacatagccagtcagacgctatcgtcattcaaccaagtagcccctggtcgctacgcctaatccgtctatacattatctgcaggccatccgtaacttcaatgactaacctaatttaggaaacgtcgacctatcccctttaggctaaatcaatcaatcccaatctaacatccattctcgcgtccttatcagctataatcactacgtttccgacaagtttcgtaaatctcgtaacctggagcgtcatccgtagaacacatcgccgtgctcagcgctatgacactctaaaacgacgcctacggtattatccaacgacttttcatacgtaaacggccctcgtagccatgacaaccggagcaaaagccgatcataacaatacagacaagaaagaaaacaagagagatactgcctgagcgcccacttcttccatgttccgattgcttggcgcagagaaatgccgtgatgcctgatgagtgcgcgcacgcgtggggctcgacgaacgcacgttatgcctttgaaccccaacacatctacttgcggtgactccagacggcacgatcccccgaccgatggccccctgattgaatgaggacaagtcttacccccaataaggggccgttgttacccgcataggccacacacggcacacccccccaaaaaccactcaccacccaac

SEQ ID NO: 517036 - DNA, 1226 bp, Homo sapiens
gatcaggaagagcccaatggagccttctgaagtacctagtcagattagcacaagataatgttcttacgaagttcctaactttatctgactctcttggtgaagatgaggaagttacctttccaaccctggtgtctcccctcaagccaagtagagcgaggttctgattctatctgaaagacatatagcctggactacgcccatcgttcaggctactgagaacgacgttgtcatttggctgacttccttgtggattcaagtcttgtggtctgttaacagaattggattgctgggaattgaccgagtgctgtcaaccactatttgagcttagggacggagcatttctccatcacagagagaatatgtgtctagctcccagctgttggagcttgccttcttgcagaaagcaagatcttatgcaacgaagtccaaatacagaacagcaatgactggagtcaactgagtctcttctagggtctacaagtatcaagggtatcattcgagtgtcgaagtgttcctaggagaagtcagtaatactgctagagaatgtcttgtagatgactggcagacacagttactgacatgttagccagaactatgttgcctagttcgtggtgcatggtgaacactgaccaattctccttcaaagatcggcttggctgcgtcccctttattcacacgcacgatggcagctaaaaggtagacgcttcgggtactacgttactgaagcactcaggtggatacgatacaggaccacataactatggcgacaagattgtatccttccataggcacacacgcaaggacaataggccgagccgtgtgacaaccatgtcactaaggtccctaccacggcacacgaacacacaggcggcctcacggggaacacccgggtgccgcaaacagtcacccccatgcctccgcaagaacacaaacctggaggcaaccccagatagaacgcgatacccatgatcccacaacaaagggtgtccaggagcggacgaccaaagacacggagtggaccgccccgaacgccaagccaacacgccgcacagaccccaagctcaacactcatcgagcagccgccaatgtgcaccacacgacctgcctcagcctaggagagcacaaacgaacaccccaattcgcgagcagacccgccgcagtacgacatgccgacggtcaacacagactgagaagaaaaggataatagagcagactgaatcacaccg

SEQ ID NO: 517037 - DNA, 127 bp, Homo sapiens
cttttgaatcgtaaagacaaaaccacttttgagaaactcgactacctgatgtccaaagaagacaactacaagcggactcgggactacatccgaagtctgaagatggtacccagtattccctatctag

SEQ ID NO: 517038 - DNA, 231 bp, Homo sapiens
gacatgtggtttgcgggaagccaggaatggaattatataatttgatatttgtctcctcccaaatttcatgttgaaatgtaatccccaatgtcggagatggggcctggtggaaggttactggatcacgtgggtggatttctcatgaatggtttaagcaccatcctctgggtgctgtgcttgcagtagtgagtgagttcttgcaagatctggttgtttaaaagtgtgtatcag

SEQ ID NO: 517039 - DNA, 559 bp, Homo sapiens
  misc_feature (92)..(92): n is a, c, g, or t
  misc_feature (152)..(152): n is a, c, g, or t
  misc_feature (167)..(167): n is a, c, g, or t
  misc_feature (171)..(171): n is a, c, g, or t
  misc_feature (444)..(444): n is a, c, g, or t
aggaaaagcttttggttttgacaatgaaggcgattctaaccccggcaggcaaacaccaaaaacaacaagcaacgaaccgaagaagacatctnttgatcaggattcagatgtggacatcttcccctcagacttccctactgagccaccttttntgccacgacccggtngggntacgaaagaagcccaatatcttccagagtctgatgaagaagaagatgatgttgattttgcaatgtttaattaagtgcccaaagagcacaaacatttttcaacaaatatcttgtgttgtccttttgtcttctctgtctcagactttcgtacatctcgcttattttaatgcgatgatgtaattgacggttttttattattgtggtaggccttttaacattttgttcttacacatacagttttatgctctcttttcccccttcacacgccacgcantgtttgctcgcgttctagaattgttatccactgccgcgcattagcacagattttaattgtcatggttacaaactacagacctgctttttgaaatgaaatttaaacattaaaaatg

SEQ ID NO: 517040 - DNA, 151 bp, Homo sapiens
aagatcatcgttgggctttgcgaatcagtgttattagacatatgcagtagagctggcctgtgtgaatgtgtacttcataacaagttgggatgtgatctgcagtgggtttgagtatcactgtattttccaaaatttgccgaggagtgtttta

SEQ ID NO: 517041 - DNA, 206 bp, Homo sapiens
  misc_feature (15)..(15): n is a, c, g, or t
  misc_feature (51)..(51): n is a, c, g, or t
  misc_feature (53)..(53): n is a, c, g, or t
  misc_feature (56)..(56): n is a, c, g, or t
gttcggcacagcagnttgtgatcggtgcgctgactccgcgactccgagccntntcncgtccccttcccgccgccgccatgaagtggatgttcaaggaggaccactcgctggaacacagatgcgtggagtccgcgaagattcgagcgaaatatcccgacagttccggtgattgtggaaaaggtctcaggctctcagattgttgacat

SEQ ID NO: 517042 - DNA, 472 bp, Homo sapiens
ctcaggattaggggacgctttcagctctcggcgcacggcccagcttccttcaaaactgtctactggttcacggggatcctgtgcaagctaagcttggagggtgatcactttacaccctccagagcatatgggtttgtcaaagcctatactaactttgatgctgaccgggatgctttgaacattgaaacagccatcaagaccaaaggtgtggatgaggtcaccattgtaaacattttgaccaaccgcaccaatgcacagagacaggattttgtcttcgcctaccaaagaaggaccaaggaacttgcatcaccactgtagtgagtcttatctggccacctggagacggtgattttcggcctattgaagacacctgctcagtatgacccttctgacctcctttcatgaacggtctgggtaccgacaaggactcttttattgggatcatgtgctccagaaccccgcgcctttcctt

SEQ ID NO: 517043 - DNA, 1021 bp, Homo sapiens
  misc_feature (369)..(369): n is a, c, g, or t
  misc_feature (440)..(440): n is a, c, g, or t
  misc_feature (534)..(534): n is a, c, g, or t
  misc_feature (620)..(620): n is a, c, g, or t
  misc_feature (626)..(626): n is a, c, g, or t
ccccacgtttcagcacagcgctggccgcagtctgacaggaaagggacggagccaagatggcggcggccgacgggcgacgactcgctgtaccccatcgcggtgctcatagacgaactccgcaatgaggacgttcagcttcgcctcaacagcatcaagaagctgtccaccatcgccttggcccttggggtttgaaatggacccgaagtgagcttctgcctttccttacagataccatctatgatgaagatgaggtcctcctggccctggcatgaacagctgggaaccttcactaccctggtgggacggcccatgagtacgtgcactgcctgctgccaccgctggagtcgctggccacagtggaggagacangtggtgcgggacaaggcagtggagtccttacgggccatctcacactgagcactcgccctctgagctggagngcgcactttgtgccgctagtgacacgcggctgtggcgcgcggactacgtggttcacctgccgctacctcgggctgcggcctcttctccgtctgntaacccccgagtgtccagtgctgtgaaggcggaacttcgacagtacttccggaacctgtgctcagatgacacccccatggtgcggngggcgnagctccaagctgggggagtttgccaaggtgctggagctggacaacgtcaagagtgagatcatccccaattttctaccaaccttgggctctgacggagcaggactcggttgcggctgctgccggttggaaggcgtgcgtgaaacatctgccagcttctgccccaggaggatctggcagccctggtgatgccacctctgcgccaggccgctgagacaagtctggcagcgtcggtacatgtggctgaagttcggacccagaaggtgggccggatccagagactgtcctgctcgaccttgaaatcgacgcctgtagcggcccccacgcaaggtgaaacccggacgggaaggcaaccatgcgcacaggagcaggccagagctgcgcaacagggtcccgga

SEQ ID NO: 517044 - DNA, 302 bp, Homo sapiens
ggcagcagttgtatgtttggggatccactcgtccatggtgtaagtgattattgacgacaggttggagtgcacgggtgctatctcggctcactgtaacctccgcttcccagtgttcaagctgattctcctgcctcagtctcctgagtagccgggattacaggcgcccgccacgacacccagggatttccgagatgagccaggcatgatgtgggacacagagcacgtgggcagagtcctcgttcagcacatagaaatgactggcatcactctgagtttccatcgatacgcgcaggtaggcagga

SEQ ID NO: 517045 - DNA, 226 bp, Homo sapiens
cggactcacttctataggggcacgacacgaaaataaacagtctaattctcgaagctgctggtaccgtgtgatgaccagatagctatagatttacagaatacaggacctgcgagatcaggcgatgcctctctgaagatgtggccatctgcgttgggacctgaatgatgaagtagcgacgtacgttgggatctacagtgctcggtttgttggcccgggcagatcttcc

SEQ ID NO: 517046 - DNA, 137 bp, Homo sapiens
acaggaaacggctttgagcatcagtcctgctgcctctaatacatctgatccgaagcacatgctcagctcccaaactggctatcatgagtcgtgtgacaggtccaggtggggcatccagccccttagtgaggtctggc

SEQ ID NO: 517047 - DNA, 433 bp, Homo sapiens
gaatagcatgggaaagaccagcccccatgattcaattacctccccctggtccctcccacaatgcatgggaattctgggagatacaattgaagttgagatttgaatggagacacagccaaaccatatcatcctgtaatctcatgtgtctaccataagccccaacccagaatcacctttacttattttcttggcagcctggggaggtcctcaggctcatcaaggttccctgatgtctcagagtcccccaaattggtatgtagacctttagttattgtctaggctcccctctccttctcatttggctattttgaaagaactacatttttggttgaaagcaaagtgggcagatacttaggcacatgttttagaaaatatggtagtctttcatgcttacccaagtaatctacaaaaatgttcattgcattactgtttt

SEQ ID NO: 517048 - DNA, 343 bp, Homo sapiens
tgactagaggatccagaggtgggtagccattcctcggttaggaggtacacctagtacagttcctattcaaactagagtcattagtatgttcgggggatgatggagaacctcagttaaaggaatccaaacctaacagaggaagttaacacggaggactcgcaatccaaagggtattagcaacagcgtgcacattatccagaagcaaaaggaaatcaaccctttagcgtcaacagtactactgacgtcctatcactagccctgtcacagcacactgtatgtctgacaccaaatgagcgaccaattgaatcaccccacagaaccccctcctaaacccgtttaccta

SEQ ID NO: 517049 - DNA, 413 bp, Homo sapiens
  misc_feature (47)..(47): n is a, c, g, or t
gcggagtcgggcgctctataagttgtcgataggcgggcactccgccntagtttctaaggatcatgtctgcgagccaggattcccggtaagaaaggcatttgcaagagattgtggctgcttattttgccgcccccttccgacgggcccgccgggggtagctgagaggcccaccagggttgcgggagaaaccgaaccgggtggggggagggtccgacttggaggggcgagggggaagacccacggccgacgcggccaccaggtcgaggcggagggtagggacagcccggctagggtcaggcgtgcgaggtctgttacgaggcctcgacccgaggcggtgccatgcgcgaagccccggcgctgagtggcgagacggggtcgcgacctggcgtgggaaagaaaggtggaggcggccg

SEQ ID NO: 517050 - DNA, 169 bp, Homo sapiens
aggcccatggtacacccctactttgccctatattcctttgagatttcagttcagtgtcaagtgaaaaaattatgtttgaatgcttgctgggcttcatcccatgttatgttctattctttgcatggatggcatgacgttgaatctagactccccattattagctactgaa

SEQ ID NO: 517051 - DNA, 315 bp, Homo sapiens
ggatccctgggtctgctaggagtatgactgaatatgcaagtctgtttccacactcccggcgaccttcctcatcagtcataggtttcttttccaaatgagctgaggactaggacctattggttagaagttcgcaccattttcttccccttgagattaaggattgtggttttcaccatgcacaaaataagcctctctaataagtatcaaccaacccagctggaagcacaatgttagaataataatgtcttacattagcaagatatttcttcctattttctaaatgtccctctccatcagtagcacctggacccacac

SEQ ID NO: 517052 - DNA, 82 bp, Homo sapiens
  misc_feature (54)..(54): n is a, c, g, or t
agtctcagcgtgggagccgaccagtatcttctccctaaggactaccacaataanatcagtcatcattatcggggctggtcca

SEQ ID NO: 517053 - DNA, 349 bp, Homo sapiens
gatttgtttttggttttggttttgagaaggagtcttgctcagtcatccaggctggagtgcagtggcacgatatctgttccctgcaacctctgcctcctgggttcaagtgattctcagactgctccactgtactccagcctgggcgacagagtgagactggtctcaagtatttctttataacagtgtgagaatggccgaaaacgacacccagatgcaaacattacccatgccaccgggtggtgactctcttaccaagcaagagcgggcccctggcttacgcggagccaatggatcggacattcccccgaagggcaagctgaacatccttttctctatgcacccaccgagg

SEQ ID NO: 517054 - DNA, 342 bp, Homo sapiens
gaagtcgagctcggattcctgaatgctgcctgctgaggtgggaggactgcttgagcccaggagttcgagaccagtctgggcaacatggtgaaaccttgtctctactaaaaatacaaaaattagccaggcgtggtggtgcgggtctgtaatcctagctactcaggaggccgaggcaggagaatcgcttaaacccaagaggcagaggttgcagtgagccgagatcgcgccattgcaccccagcctaggcaacagagacagactccgtctcagaaaaaaaaaaggaagaaggaaggaaagaatttgaatgatcccacattcagcctcatagacctcacctaattc

SEQ ID NO: 517055 - DNA, 1837 bp, Homo sapiens
ggtgttccacaatcacgtagatatagacattgttgtaggttagcatcccaccgagtagttgtgtccagcgggtggtctgtcttctcctcatcaatgatgggtgtctaaccaaccagggagggttcgttggtgatatgcacagtactctgttttgtttgcgctatgtgatgtgtatatattacgtaagtgggggattattgtgtgctcgcctccgcttgtgtggtccgtggcatcgatcagtaatatgattcatagtgtgggggcaattatgttcctccacaccaatgatgacaatagtggtgggtgggacagaaaagatatgttgtataggggatcgtttgcttgtttcgtttgttgattgatttgctgttgtgtcgcggtcgtgtcaacctattgattctctagtgtatgtggtgttggcacgacgccttggtggtaggggtgtaccctccccggttttgttgtttttctattctagatcaatgaccttgttgtgtgtctcgtggggttcagcctctgtgtgtgttgtgggccgtccctcggttgtgcctcacacttctctcggtgattgtaagtcttgttatgatgtggtaggctctccctctgttagtattcatcatcttgcctccgtgggtggtgggccacgcctgtgcacaacatatctgggcgcccaacaaaagaaggggggtgtgaggaccaccacaaaaatagggagtagaggagtaagatacacagcatttgctggtggtctgacccttcgaagtggtggagtggatgatagtagaggggtgtgttgtataatacagatggcttgtcttgtgttgttgtataacaccccacacacacccacaatagtagttctccaacactattactgcctccgttgataagagggggggagtatcatagtggtggtctcctcaccaaaggcatatggaggattacactacacgcgactagtagtatagtggaaaaggaggggttgtcgtgtggatggagaagtacccacaacataggatggggcacactccaacatcacaggttgtgaaggagttcttgttgttctcatagcattatataataggggagtatgccgttgaatgattagtatacccgtccctacgctctctgcgttcacatagtgggggttagtaacaaccgcgggggtggcacaacagtgtgtgtaccgcggtgtccacacactgtgtgtatatagagagatcctcgtcccgcgcgggctcgtgacgcgggcgcgtttatagatagaggtgtggtcgcgtgtatatatatatccacagcgagagatcgtctgatcgtgtagatacacccgtctcatcccatcagacactcgtgtgtcccacgagaggatcttagttctttcacactctaggaaggtcccgccgcctagtctcagtagtgccacgcgtgccgccaacgacgggtgtgtcacaccaactgtgttccatggccactgtgtcccgctcagcccacgcggtgtgaaagagggggtgtgtgtccatgagagcgtagggaaagagagttgtatcccgcgaacacgtataagtcgagagggaactgtgtatatgtgtgttgtgaaacttgtttgtgtggtccaccgtcgggtgagtgggtgtataccacctcccacacctgtgtgcgtggtgtccactattcactgtttcgtctccctgtaaatattagagtcccctaatagtgtgtgtgatcacgtatatatataaataatagtaataaaattaaattaatacgatcgtaaggcctaagtcgatcagtcgttcgagggctacccgagtagtatagtagggttagtaaggcagcc

SEQ ID NO: 517056 - DNA, 215 bp, Homo sapiens
aataggcgacatataacctgggcacagagcatacctgatgaacctgtatcaaaaaaaaaaagaaaaaataatcagttaatatatattgaacacgggccggggcacggtggttcaacgcctataatagccagcacttggggaggccaaggcgggtggatcacccgaaggtacgcagtaaagacgaccagcctagggcaacataggcacaaactctg

SEQ ID NO: 517057 - DNA, 103 bp, Homo sapiens
ggatttgctggtgcagtacaactaggcttaatagggacatgagtgctttctcaatcaccagcaactatgcagtaaatggtgctagaccaaatgattaccaaaa

SEQ ID NO: 517058 - DNA, 108 bp, Homo sapiens
tttgagatcagcctgtgcaacacagtgagaccctgtctctacaaaaaataaattacttggatgtggtggcgtgtgcctgtagtcctcctaatcaggcaggtgaggtgg

SEQ ID NO: 517059 - DNA, 1619 bp, Homo sapiens
cacgcgtcgggaaaaagtctggcttgatcacacggaagatgatacaaaatacatgaagagtctgcagaaaacagcaaaaatcatggtacactctcctacaaaaccagcccagttcctccagtcaaagtggacgcatcagcacagcaacacaagcagctgttagcaacacagggctggctcaacatttggccgacagcatggcaccaacacatttcaacagctaattggcaagccgccactggttttacaagtgcacagcagttcatgcaagcacagatcattttcacaacacatacaggtccaacatgcaggtctggcatcacacagcaaacaccaaatccagcaagaccggcccatcaatcttccacagttcacccacatgcacagcataaagggcaccaaaaggccatggaacaccatccacagtttcacaggggcacgtgctgcatcccgaacttgcaatgctgtaaaacacttgcaacacgttcatctcgcatgcatgcaagcacagtcagcacatccacaagcatgcaggtggcacgcagtcggtctctcctcaaaaaccaccgccccaggcacagcaatacctcagccagtcgcatctcttatgtaacagcaatattaccgcaaatcagtacacaatgccattgaaacacccacatccaaacggcagcacatctcccatctggctctcctcgcaccagcccgagcaccacgctaacataccatacaacctcacaacgctcttccccccacgggaggacagcgtccttgcagaaccacatggacaccaaacgcgccacgcactcgacaacaccacactactacaacagactccccagccacccaatctcacccacatcgatgacacactgcagcgaacaacccacaaacgaccacaaggagcagcacaccaacaacacactccacccgtgccacacccacacacacgaaccccaacgcacaacccttcaaacacggccaccatcggacacgctccaaccaccactcagcccacaaacaaacccactcgaacggcaacacggcgcaaacgacccacacctaacaagcccccgcgcgaataggctacacacccaagacgcccagcgtgccaaacatcgagaacaaccacccatcgcacacgcaccacacgaacacaggacgcagaacacaagcaagaccacacgcagccagcacacaacccacagtgaagccaaccacgacctccagaccgctccgcaactcgacaacacgaccgcacggaagacatagatccagaccacaagaaagaaagaccagaagcaacaatgaagagaacaacaaataacacaagcaagcgtcgcagcgaaacaccactctacatggctacaggaactcaccaagactacaaaaacaacaaaaaggcaaaaccaagaacgacaccaagcaccaccaccaacagaaacaccagacgcacacccaccaacccacaccacagacaacaccacgaagcagagcaataacgccaataacagacggacacatgtaaaaagacgagaagaaccaaccagcagaagcacaacggaacgaagcatgccaggaccgcacacacacacccacatccggaacaacgaccgacg

SEQ ID NO: 517060 - DNA, 1602 bp, Homo sapiens
  misc_feature (1403)..(1403): n is a, c, g, or t
gagcgcgttcagatgctccgaggaggaagagtggagaatcttgcgcgaatccgcagaccacgtggccatggcagaaactgcagtccgagctggtcgatgacatgacagtctcgtcggtactgcgctatgaaagaaagagcggtactgcgtcaatctagcagagatggtctggcactgtaacgcggctggaggtgcaccgcacaatggtgcacgggctctgagtgttgcgatccggagaatcagtgtgcgatgaggcagacagagagacagacaaggattatccgccagtgacagacgcaggtactggtctctgacccaccactgggggcgctcgattgccgacaccatggctttaatcatcgaacgttactagggggcgtgtccacatagcccatggttttaaccaccggagctcgaaagggggacgtagacttgggagatgcagagacgtaaaatggacagaaaacataccttcgcaggataataccggatcgcgggttgtagccaaattctgcgtgggggcacattgacttattgagtcctttgcagggcgggttgcatctaaaccctgtaggttgatatgacttacaggtttagagattacaagagcagagtagcacgtaaaacgcggatgaattgttgcacatgtgtgggggcattaggcatttaagcaatttactttgaacgaagtcgtccttccggctccggcggcatggaagtgcacccgcgcgaaataagagcgcagacggtgaagccttagtacaaatccttggcacaaatactcgtacctcttccaaaattcgtgcctacctttacagaggcacaagagagggcgattgtcaccccgcccaaaagggttaagtgcctatggatatggggaacatacgccgtggttgtacatagataaccagcaggaacgagttcaaaggcacaaaagacattaaaggaaacccattaaagaatatccgtcgtatggaacttacaccgaccgatcggtagtggttggccctcctcgaaagtgttggtacgcattgtgaaagagtatcaaggaatgtggacgtattgggtaggctatgctatcctggatttggaccacaatgagccccggttgcccataagataaaacccattaataggacaaccagggtgtaggatgcaaagtgactggcaataataacctatattcggctggggtcagtgaccatggacaccgggcagcggtttaacaggcgtacagaaaaggtcaagtccgagcggtacattcaatatcctttggtagaaaaggaaatgcacgggcaggcaatttatgttttcccctccaacggtgatgtcatggctaagaggtacggtgtcggaaaaagatcagtggaacatttcgagagcccatggacaacacatttatngaacattagtatggacgggagtatatacaagacacaaccgattttatgcaattcatgtcaccattactgcgcgaacaacacaacaatgaacaaaaaacgaaaaaaagatatcgaaaaggagtatataacagagaccacatgtatagggtcggggaggtatacaagcgagtataacaaggaggagaagtgtgcacacacg

SEQ ID NO: 517061 - DNA, 331 bp, Homo sapiens
cccctagctactacaggtgttctggacttgagcaatccacccgcctcggcctcccaaagtgctgggattacaggtgtgagccaccgcgcccagcctgctctatattattttgtatattagaacacttaaacatttgctgatgagatattagacatactcagaagaggttatttcacttacgcttgtgaaagaagccaggagtcctttcctggggatttgtgaccagtgtctctgagcatctccccagtaagcggttcgtccttgttttataggtacagagtcatgccactgatggggctcccctccttgctctggctgcatgacccccttt

SEQ ID NO: 517062 - DNA, 315 bp, Homo sapiens
  misc_feature (54)..(54): n is a, c, g, or t
  misc_feature (68)..(68): n is a, c, g, or t
  misc_feature (238)..(238): n is a, c, g, or t
cccatctcaaaaaaaattttaatttaatttaatttttaaaaacccataatccgnccaggcgcggtggntcacgcttgtaatcccagcactttgggaggccgaggcaggcggatcacgagatcgggagatcgagaccacggtgaaaccccgtctctactgaaaatacaaaaaattagccgggcatggtggagggtgcctgtagtcccagctactcggagaggctgaggcaggagaatgncgtgaacgcgggaggcggagcttgcagtgagccaagatcgcgccactgcactccagcctggagcgagactctgtctc

SEQ ID NO: 517063 - DNA, 159 bp, Homo sapiens
  misc_feature (2)..(2): n is a, c, g, or t
  misc_feature (117)..(117): n is a, c, g, or t
  misc_feature (129)..(129): n is a, c, g, or t
  misc_feature (153)..(153): n is a, c, g, or t
tnccagagggacaaggaggaagttctctttgtgacttggttgaggaggcggcggaaggtggctaatgaattcagtgcagagaaaagcctggggatgagagtggagggctgcacaggngttatgcatggnaggcgggtgcttggaggccgagcnctggga

SEQ ID NO: 517064 - DNA, 882 bp, Homo sapiens
  misc_feature (181)..(181): n is a, c, g, or t
  misc_feature (196)..(197): n is a, c, g, or t
  misc_feature (223)..(223): n is a, c, g, or t
  misc_feature (245)..(245): n is a, c, g, or t
  misc_feature (255)..(256): n is a, c, g, or t
  misc_feature (363)..(363): n is a, c, g, or t
acgagaagcatgagtgtgagcttggtcgtctgtggcacacagcagaggtaggaagactatgatcgagtgcggtctctctcctacccggtagcactgagttgtgccatcctcatgtgtcttctccatcgacagccctgacaggcctggagaaagattcctgagaagtggaccccaggtgaancacttctgccccaanntgcccatcatcctggtggggaataanaaggacctgagggcaagacgangcacaccagnnagagagctggccaagatgaagcaggagcccgttcggtctgaggaaggccgggacatggcgaaccggatcagtgcctttggctaccttgagtgctcagccaagaccanggagggagtgcgggaggtgtttgagatggccactcgggctggcctccagggtccgcatagaacaagcgtcggagtgggctgtcccgattctctgagtatccccaaggagcgttaacctacatgccctcgcatcccgttcacaaggggtacagaaattatccgccgtacaaacccaggctcctgtagggctccatgctgaaggctcccattttcagttccctcctgcccaggactgcgttgttgtctagccccgacgtggtgggcacggggccatccactcccagtagctcgtgtgagccacgcctatgccctgtccttcctcaaggcccctggggatcttggcccccattttgacattcccaaaggatggtcacacgaccagcactttatacacttctggtcacaggaaagtgtctgcagtaggggaccagagtccaggcctgggagttgtttcggcaggggctgtctctcatgcattggtcgggggctgataaaggtaagggtccaaaaaaaaaaaca

SEQ ID NO: 517065 - DNA, 145 bp, Homo sapiens
  misc_feature (20)..(20): n is a, c, g, or t
  misc_feature (32)..(32): n is a, c, g, or t
  misc_feature (43)..(43): n is a, c, g, or t
  misc_feature (142)..(142): n is a, c, g, or t
tggacagcagctcattctcngaatcaatcaanttttctagttnttcttcaaagggaaagcctcctgaagctgatggtgtggatagatccattggcgagaaacgctatgaacccatccaggccactccccctcctcctccatngcc

SEQ ID NO: 517066 - DNA, 258 bp, Homo sapiens
gaaaggagggtaggtccatgcatagtttcactagtctgtcttctctacagcagcttcttcttggcacaatcctagaactgggcagaacgtccttcccaaactcgaggaagacaaatggctcctagtgacaccctgaagcttacgtaactatacaaaccgatgcttctctggacaactctattctgtaagaatttactctaccaataatagactgctatctaggcgcattgattgaacgtgtatagcagtgtacatcca

SEQ ID NO: 517067 - DNA, 964 bp, Homo sapiens
  misc_feature (263)..(263): n is a, c, g, or t
  misc_feature (278)..(279): n is a, c, g, or t
  misc_feature (305)..(305): n is a, c, g, or t
  misc_feature (327)..(327): n is a, c, g, or t
  misc_feature (337)..(338): n is a, c, g, or t
  misc_feature (445)..(445): n is a, c, g, or t
tcgaaagagctggtgatcgttggggatggtgcctgtgggaagactgcctcctcatcgtcttcacaaggatcagtttccggaggtctacgtcctacgtcttgaaactattgcggacatgaggtggacggcaagcaggtggagctggctctgtgggacacagcaggcaggaatatgatcgtggctcttctaccacactgatgtttcatgtgcttccatcgacagcctgacagcgaacattcctgagaagtggaccccaggtgaancacttctgccccaanntgcccatcatcctggtggggaataanaaggacctgagggcaagacgangcacaccagnnagagagctggccaagatgaagcaggagcccgttcggtctgaggaaggccgggacatggcgaaccggatcagtgcctttggctaccttgagtgctcagccaagaccanggagggagtgcgggaggtgtttgagatggccactcgggctggcctccagggtccgcatagaacaagcgtcggagtgggctgtcccgattctctgagtatccccaaggagcgttaacctacatgccctcgcatcccgttcacaaggggtacagaaattatccgccgtacaaacccaggctcctgtagggctccatgctgaaggctcccattttcagttccctcctgcccaggactgcgttgttgtctagccccgacgtggtgggcacggggccatccactcccagtagctcgtgtgagccacgcctatgccctgtccttcctcaaggcccctggggatcttggcccccattttgacattcccaaaggatggtcacacgaccagcactttatacacttctggtcacaggaaagtgtctgcagtaggggaccagagtccaggcctgggagttgtttcggcaggggctgtctctcatgcattggtcgggggctgataaaggtaagggtccaaaaaaaaaaaca

SEQ ID NO: 517068 - DNA, 115 bp, Homo sapiens
tacgtgaggtacagctacgggcgaggtacacctttttattaggatattggcagcatgagggtctaagccttatccaattgacctgatttattatatttctcttttgcaaagacca

SEQ ID NO: 517069 - DNA, 133 bp, Homo sapiens
ttggaccccaaaacaaaacaacaacaaaaaacacccatttgtaggtttttatatgtacataagttttcaactcctttgggtaaatgccaaggagtgctattgctaattcatatgtgtattgtgtaaactgatt

SEQ ID NO: 517070 - DNA, 132 bp, Homo sapiens
cccggtgggggtgtggctaggctaagcgtgtggagctgcatggctgcgtgcttgatgctggtccctttggatcggtggtgattaagcagggtgaactcactgggacgggggatgctggccaatcaacatagg

SEQ ID NO: 517071 - DNA, 589 bp, Homo sapiens
ggagatactggcacatatttgcatactgataggaataatccagtagtgagggagaaattcgtgatgcagaagagcagagtataaatcacaggagtgggtaagcaggaatatattctagagcacaaagggagagtagcgtacaagggacagaaggccaagagttttggggcagtgtcaattgccctgtacttttttttttaacatagctgtaatttctggcttttctcctaaagcatactagctgacaaagctacacatttatttcagaaagaagcccagattttatatccctttttagcctcagtgatctgtgttctatgaaacccctagctacatagatccccactataagtgccatctcaaaacagcatcatatcatgtaatcctcacagtaaatcatggatgcaggtgctattaaagacattttataaaccaggaaattgaaaatgtggtaatattaatgaaatacaaccagttctatcgaggaacccttaatagagggaggagatacatatttgaattaaattgctatgtaagaatacaacattttgactcaagcagaactcatgtttttctttatatttttcca

SEQ ID NO: 517072 - DNA, 214 bp, Homo sapiens
ggggtcccagaaaaattaaaaatcccagggctctctagatttgttgataaaccttttatgctggcctttaaccctgaaagggatgggccgaatgggcccatccgtttaatccgaaatgggagggtttataatggaaaggccctgttttgctggagcaataaaatggcccagggcaatggcttggtttaataaaatcatttttttaaagttgcca

SEQ ID NO: 517073 - DNA, 202 bp, Homo sapiens
gaattggtgcggcctgggagcgactctccctcctttacattttctcttctccctcgctcctccttcttctatcactgtgcctccacccgaggggcaggggctcttgtagagagatccctggcccaggacaggagatgccaaatcttatttatctcactgagggcctttgaggaaacacgcttactgggccatcgtgacgggt

SEQ ID NO: 517074 - DNA, 549 bp, Homo sapiens
tatccagcagagaaggcgcgggtgtgttgctcatcacgcagcctacaggcagtcaggtactgtccactccagtgtcaacaggtaggacccaagctctggtcaaggttgtgctgctgctggccctgtgctgagtcttaaccctgctgctgtggactgctgtggctggagggcagggcttcttgggtggggggcaaggttgccctcagcccagcccagagctgggccaggacgacgtgacgctggacaacctgttcagggtccacgagcacacaggagaagttggtgttgtgcagggcaggagtcagctgctccagcaccaaggccttgcaaagctgcgtacctgtgctccccacgttcccggctggtgctcccctcccacagtcggcctgggaggtgctcaatgaaggaaccattgcccagccagtagaggatgctgaagtaggggaaagcggatgcaggccacacaggataagctcagcgttccattcagtggaacttccacctctggccaggtcacttctctgatggataacttgggttccgagctcg

SEQ ID NO: 517075 - DNA, 261 bp, Homo sapiens
  misc_feature (136)..(136): n is a, c, g, or t
atcaaatgccctttgattatgaaaaaatcagaataaaaatttttagggacataagccttccaatggtatacaacattcccatggcaatattagacagttaagcccccaatacccatagttggcaaaatgtcccccnggcccagcattcttttaaatacatcctttgtataagggggggaaaaaaagccagggtcagctttccaagggttgtcaaaaaaggattttcatggtctggggttttaaaaaccaccccccactcca

SEQ ID NO: 517076 - DNA, 306 bp, Homo sapiens
  misc_feature (150)..(150): n is a, c, g, or t
ctggtcttgaactcctgggctcaagcaatcctctggtctcagcttcccaaagtgctgggattacaggcatgagtcaccacgtttggcctcactttcaagtaggaaccttttcctgaggaaagcagtgaaaaggtggagaaagtgattgtnccattgtggaggaagttgggctggtattgagtctgaagtatctaatattggtctccaccttgatcatcttcacttctcttgtccagggcacttgtccctgccactgtcctctgtgtaagatgctgccttgctgggttttgggggacaaacttctac

SEQ ID NO: 517077 - DNA, 300 bp, Homo sapiens
agttatagctcagatcctttcctcaatggcagggcatatatacgagggggcagagacaatgacagtggcctggggaaagaggtgctacagtgtcaccagaactccaggaggatatcctacagcaatgagaatgagatggatacaggacaaaaacgcaggacaaacaaccatgaacatcaatccccaacagacaccgtttcccagaatttccttagaatgtactatccagagaacaaacgtatgactataaggaacatattggcaatcatgaaagaaacatgatcccacctctacaactag

SEQ ID NO: 517078 - DNA, 157 bp, Homo sapiens
ttgagtatcccagtgttctgatactgaccagaacaggaactgtcagaagagggcactctcaaactaggaaccctattcgcaaaatgaacaggaatagaaaaaagcagatcacatctatataaagaactactgctaaaagaacgctgaaagatgcaat

SEQ ID NO: 517079 - DNA, 951 bp, Homo sapiens
taaagaagaagagaaacttggtcgaaagaacgctaataggactaaaagaattcttagaggactatgatgatgatagagatgacccccgaagatattactgaggaatgtgcatcctttcacaaacacggttgcgtgatagaggaaaagggatctgtgaatgcatattgatacgagagtaggaacgacgagagaacgggaggagcttgagggaattcaggcagcgccttctggcctagatcgggcatccaggatccattgatgcagagcgtcctgagggaattgtgagactatcccagcgactcgagagagttgcaggtgtagtctgcaataataaaagcaggtagccataaatcacgaatgaggtaagggaaagaacctgaaataggactctgatgaaatggaaagaaataaagcctggatgatagaaacctctatggggaatcgcagcgcactgatgggaggccaggagtacaacaatgacctgtcgtggaaaaagacgtaacgtctgagagcccattcagcttctagttactcatgcgtgatagcttttctgtacaggtgccatttgaaacatcgtaatgatgtccctgggggagtagagctcgcccctggtggtaatttaattgatctccctccgatgaaaatctcacccagaattcaatcaggcacatctgggatggcagccttggtcgactgaaattaggaatctcattggtcttaaaattttgtgtagccttccaaaaacaattcgcgagtcgtcctaattcttgtgacggggaaagaggctacctggaaggagtaggtgccttaagcaagcgtcgacgtttgatgcctgtgttgacgtaccccgaataagggaaatgttccgatggctatggtgaccattgcaaatgtgccccaggcactgatcccctgtttcagcatcaccctcgaagtgatgcaaacatagca

SEQ ID NO: 517080 - DNA, 392 bp, Homo sapiens
  misc_feature (102)..(102): n is a, c, g, or t
  misc_feature (120)..(121): n is a, c, g, or t
  misc_feature (138)..(138): n is a, c, g, or t
  misc_feature (157)..(157): n is a, c, g, or t
  misc_feature (183)..(183): n is a, c, g, or t
  misc_feature (194)..(194): n is a, c, g, or t
  misc_feature (330)..(330): n is a, c, g, or t
  misc_feature (359)..(359): n is a, c, g, or t
  misc_feature (369)..(369): n is a, c, g, or t
cgagccctgatattgtttaaaccaccggtatcagagccaattcccatacacaggaagtctccccttccaagatctaggaagccggctacaaatgatgaagcnagccccctgagtgtgtcnngcccagaggtactggtncctggctgcattataccantggtgtgtactgggcgtcgaagacgnattcaggggancaaatcacttcttcccctgtctcccccaaatcattggctttcacatccagtatttttggctcatgggcaacaggttgtatctggaaaatggctaattacctggaggaacaccaaggaactcttggtgggaacaggnaggcaggaatccttacttgttaggggttnttcacttgtntcggggcctgttttaggcaactt

SEQ ID NO: 517081 - DNA, 104 bp, Homo sapiens
gtggagagcactccatagctgtggaggaagatgcagagtcagaagatgcagaggaggaggatagtgaaactcttcaagtattatctggaacagcggtcttgccc

SEQ ID NO: 517082 - DNA, 324 bp, Homo sapiens
ggagatgaccgtgggagtggaattgtgaatcaaatcgaaggtgaagccaccccagttaatctcacagagcctgccaagctggactttaagttgtcctggtttatgccatcggtcccgtactggatcctgtgacaccgattatgagaagtatgccctcgtgtattcctgtacctgcatcatccagctttttgacgtggatttggcttggatctgggcaagaaaccctaatctccctccagaaccagtggactctctaaaaaatatcctgatttctaataacattgagtgtcagacaatgacggtcacagacaaggtaaagccgag

SEQ ID NO: 517083 - DNA, 403 bp, Homo sapiens
gggctccccggataaccacgggtgtgctagcttaatccgagctcaatcaacaaatagtatggaggatgatgacttaaaacagcagttcggaactgatgttttcgtgggggcttgaatctcatcgtagtgtattaggattggaaagtagaaagacacaaacccgtgaagggcagggtaccggtatatactcacctttttatccttccgtaccttaacgtgtacctaccatgaaagacaagagacacactccaatgttcaccaggtgaattagctttagggtattaggttaatacggtggatacagtgtcattaacagaatagaagaccaggtgaaatctacaccgtaactatccttgaaaatgtctgaaaatgccaatctctaataactacactagccaaactt

SEQ ID NO: 517084 - DNA, 436 bp, Homo sapiens
  misc_feature (257)..(257): n is a, c, g, or t
  misc_feature (292)..(292): n is a, c, g, or t
  misc_feature (305)..(305): n is a, c, g, or t
  misc_feature (307)..(307): n is a, c, g, or t
  misc_feature (311)..(311): n is a, c, g, or t
  misc_feature (321)..(321): n is a, c, g, or t
  misc_feature (335)..(335): n is a, c, g, or t
  misc_feature (337)..(338): n is a, c, g, or t
  misc_feature (342)..(342): n is a, c, g, or t
  misc_feature (346)..(346): n is a, c, g, or t
  misc_feature (348)..(348): n is a, c, g, or t
  misc_feature (361)..(361): n is a, c, g, or t
  misc_feature (366)..(366): n is a, c, g, or t
  misc_feature (368)..(368): n is a, c, g, or t
  misc_feature (393)..(393): n is a, c, g, or t
  misc_feature (409)..(409): n is a, c, g, or t
  misc_feature (413)..(413): n is a, c, g, or t
  misc_feature (420)..(420): n is a, c, g, or t
  misc_feature (430)..(430): n is a, c, g, or t
agctttgggtttcggggggggcaggcacatcagtaacattctggttggggcagctccagtggagcatcagggaaaggtggccttaagccggccaccagtggagaacggcagtccagttcttctcccctttgacccgtagaaggggagttgtagccccatgaactagtttcttgtttgggtcaggaacaagggccggctggggcctggggagcagctggtgtcagggtattctgtttgctgatgggcagggacacccntgcagggtctcgggctttgagcccaggacattccntgccccttgctcncnttgnctgtgggctntgaacattccgggncnntggncatntnatctaggtccgtncagcncnagggtcagccctcttgactgtcacntgctgcccccacccancctnaaataangagctccctnctgtga

SEQ ID NO: 517085 - DNA, 882 bp, Homo sapiens
tccacccttggcgactcagtgctacggtctgccattgtttggaaagacgaccttgttacttgcctgcctgttgaaatgacttctgtacttggaccacggaactacatgtctcgtgaggtagggagaagacgctgactgtacggaagcctctaccgacttccgcattgacgcgacctgtattaggtgcttctgttttccgcacacatgccttattttctcgaagaggcttctgtgcttcataatggaagggccagcccacaccaagctgactgtaacaccaggtttatggacaatgtcaggccgttcaccgcacaaactcacggtctaacagctgtcgcgccccactagcgttagctgcgcttactcaacgaggcctagcgcggcagtctcacttgctgcgtccatcgaattctttgccgccaatagacagatccagcatttaaccaacctaagggcccaaaggccttaggatcaactagcatgcgatgctgcactcttaggagaagcgaggggaaccacgatgttagatcagagggagcgggagacaggagtgtccctcaccgtcagtgcactacccacctgtgaggcagccttctgatggcctggcccaccttgccccagaaccaggggaggccatgaggcttcagttattactctgctgcaaaattgaatggctgggcactagcaagccagactacacctacggaggctgttgaggacaatttcattccattaaattaaaaaatactgactgcgctggcaggacaggtgccatgtctgggaacagggaacgggggagcttcacctttagtgtcttggctattcctttgggctgtggggggcatccatttccagggtcggttacacctaccgaatgcattg

SEQ ID NO: 517086 - DNA, 232 bp, Homo sapiens
gcacagtctccaaatgcatgcagaattcatggtcatctatatgtcaataaagtagcagggaatttcacataacagtgggcaaagggatttccaccatcctcgtagtcatgcacattttggagcacttgtcaaaccgtgacatcttacaattttactcatcgaatagatcatttgactaatggagagtttgtaccagcaaattattaatcctatagatggaactgaaaaaaat

SEQ ID NO: 517087 - DNA, 276 bp, Homo sapiens
  misc_feature (255)..(255): n is a, c, g, or t
acggagtataccagctgcccaacacatattgcgtagtattgttagtggagaccttgaataggttacattaacttcctaatccctgtgtggaatattgtccctcttttacctcaagaggcctgttaaaggaatagctagtcttagaggagttggttggaatagtgattatcaatgggaggtgttggccccgactgtaaaagcccttgctgcccgtttctggttgtggtggatctctctagtagctcgaccttgcanggctatgcaacgtcttggcac

SEQ ID NO: 517088 - DNA, 615 bp, Homo sapiens
cttgtttccgaagctggaaattccgtaatccgggatgcgtttcctgtaagttacattccggttcttggggttaaggaccgttgcccagtccgaaccgttgcaattaagggactgagtttctgtgattggggttataagggaagggaatgttagccaatgcccaaccaaaccgtgccagttgagcaagggacggacttacagtgccaatgtaacgttaaccggcattattaagtttaaaagcagaaagtccgtgttgcatggaatcctgatggccgtccaagtgcctttaccgattcctgaccctgttggttgtaagagtggaattaacggcctaatccaaaaggccaggacctatacctacctggttaaactaccagggaaaagggaatatccttctttaaaactggaggtggcggggaaacttcgggatgactaaaaccaagggcttttttgctgggaaatcccggtccggatgggctctaacctttaagggcctaatggaagtccgtgcatatggccggagactgtggagattcttggcaccttcagtttggtggtttcaccaccagtgactggttctccatgttatccgggattcgtgggagtcgctctggc

SEQ ID NO: 517089 - DNA, 146 bp, Homo sapiens
tgaggtgatctagaggatccctgctgcttctcctcctcggcgcatgcataacgaatgaagcctcttgtggcagcacgatgtgcagattgcacagcattaataccggttatgataaatttctgcctggcgtctgcgtcaactgtatt

SEQ ID NO: 517090 - DNA, 154 bp, Homo sapiens
tgcctgttagtctttagtcgtaggttcttgctcggttagaggtttgtttgtactatggccttgtgtcggtggccactttagtcgttattacctttttcgttgtcgttggtatgtgatatggtttggggtgtttgcgagcgtttctctcggtgct

SEQ ID NO: 517091 - DNA, 342 bp, Homo sapiens
  misc_feature (74)..(74): n is a, c, g, or t
  misc_feature (137)..(137): n is a, c, g, or t
atatgagagttgaatacctgcccctagttcccacctcctcctccctgtcaaaggggatacatttcggccaagtnagtcaacggcacctcctgaaggactgtcatatgcgctgtatgctctggccgtcacctgaaganacagttcccccctttctaggaccacctgaatgtgggactactctttcccctgaggtgatatctagaatctgatagtctagatactatagtactcaatttgtcagatgttgagtatgaccataggtattgtgacctctctgagggaaatccagattttgtcatgtcaaaaaaagacccatggatgctgggtatgtgaaaaaaaaaa

SEQ ID NO: 517092 - DNA, 701 bp, Homo sapiens
cgaacacatgggcctcggatccccggcgtccttcacgctgtcaccgaatctgggctggtcgctgtatctacgtctgatccagagataaggccatcccacatggccctagagagggaaggacctcctggctcgggcccagcacggcgctccgtggaagacgcgccgctttattgctacttcctggatgcttgccacgtctcgtgtgcatccatacgagataggacgacaaggtcctggtgtgctagcaacacgagcatgatgtacgagcgccttgttcttgttcctaccataggagactggcacaggcaatagcacaagtaccaatagatatcagacagcttgggctacctatctgatgacatcgaggtatgtccgagttggggcaaatggtctcagcgtgcgtgtaagcactcagtcttctcaaggagaaggcatgctgactgaactggtagtaagaccatgtactgttgtggtagatagaggaacccctatctcgcttattatgccacttgcagtgaagacagactgaaacttcgtgactccctggagctcttgggtggtggacgaagcttgaccttcttgtttcctctaggctattgagagaagagcgtcacgagtctcctctgtcgacttggccccggatttaccaggcttatctcatgtcagctacttttaacgaggacgtacaatgcactcaatga

SEQ ID NO: 517093 - DNA, 342 bp, Homo sapiens
tgtcgcccaggctagagtgcagtctgcgcaatctcggctcaccgtaactccacctcccaggttcaagcgattctcctggctcggtctcccgagtagctgggactataggcgcccgccattgtgccggctaatattagtatttttagtagagacgggtttccccatgttggccaggctggtctcgaattcctaacctcaggtgatccgtttttgctcagcctcccaacatgctgggattacaggtgtgagccaccatgcccggctgtgttacactttttgtggtgtctcacaggtctctagagggtctgctccatttgagtatagagtatttagggtaccgag

SEQ ID NO: 517094 - DNA, 302 bp, Homo sapiens
gatcgactggccagctgcacatgtcctgttcctataaataaagttttactggctgggcgcagtggctaatgcctgtaattgcagcactttgggaggccaaagcaggtggatcacaaggtcaggaaatcgagaccatcctggctaacacagtgaaaccccatctctactaaaaatacacaaaatcagctgggtgtggtccctgtgcctgtggtcccagctacttgggatagctgaggtgggaggatggcttgagcatgggaagttgaggctcaagtgagctgagatcgtccaactggtcgacg

SEQ ID NO: 517095 - DNA, 366 bp, Homo sapiens
aatatccttcccttacatgttatacattctctgtctttagagctcttacacctctgaagcgacagatgcgtgtattaggaacatctttatagattaaggagggctgcctttgaagtgaggcacgtgggctggatggtatcatcactccacttcaggagatgtgaacagttgccatcagatgtaatctatgaacttactcatcggattaatggttctgggcttcagaaaagtaaagcgtaataggagcagcaatcatttgctggctttcatagggttcttgtatcgcaaacggtctgtagtagacctgcgctccttccagttgcatttcctccgtcccgacttcccttgcggacccgatttaacttg

SEQ ID NO: 517096 - DNA, 384 bp, Homo sapiens
  misc_feature (41)..(41): n is a, c, g, or t
  misc_feature (45)..(45): n is a, c, g, or t
  misc_feature (328)..(329): n is a, c, g, or t
tgcccctaagatcatcaaaggcatggttaaaatggctaaantccngggggtggggagctggggtgagggctccttagaaccctggagtcccaggtcagggttggtggctcacacctgtaatcccagcactttgggaggcccaggctggaggattgcttgagcccaggagttcaagatcagtgtggccgtcatggaaaaacccatctctacaaaaaaatttcaaaattagccagacacggtgactcgggcctgtaatcccagctacttgggaggctgaggcatgagaatcacttgagcctgggagtttgaggttgcagtgagccgatanngtgccattgcactccaccctgggtggcagagtgagagcctgtcaaacaatcaaac

SEQ ID NO: 517097 - DNA, 261 bp, Homo sapiens
  misc_feature (227)..(227): n is a, c, g, or t
tttgtgggcgagggagggggtaaaaggttttaataaaaaaagtttaaaaaggtaacttcggggcaaaattcttttaccccggctcttgtttttaaccaaaaaaataaccaatcttctttaggctatcccaaccgagttctttttagtagggcaaaccgtcttggctcccaatttggaaaaatttattttttaaagggcccggcgggtaaaaccctctaacccgttgngcttaaaggttaggcttccatgcttttttgtttt

SEQ ID NO: 517098 - DNA, 390 bp, Homo sapiens
  misc_feature (148)..(148): n is a, c, g, or t
  misc_feature (294)..(294): n is a, c, g, or t
  misc_feature (369)..(369): n is a, c, g, or t
  misc_feature (384)..(385): n is a, c, g, or t
ctggaaagggtagaacctatggaggcagtaaaaacaggagtggttgcccagagggtgagggaaggttgtgcctgaatagacaggcatagaggaatttcaggacagtgaaactactctgtgtgatagtataatggtggctgtatgtcantatatgtttgtctaaatccatggaatgtacagcatcaggagtaacactagtttaaactgtggacttcgacagtattgaggtgtcagtgtaggttcgattgtaacaaatgttctgctatgtgtagcttgttgatagtggggagatgnggggtggggaggccaggagtatgtgggaactctactttctgttcagttttgttctgaacctaaaactgctctaanaataaagtcttcttnntatct

SEQ ID NO: 517099 - DNA, 285 bp, Homo sapiens
tacctcacgaagaccctgaccgagcgcgactgcagtgacaccagcacgacagagcgcaaaagagggcgagacattgtgacaaagctgagctcagaagcagtggacttagagcataagaagtgcactactgtttccagctgatgcatgaatatgagttaccagctgtctgacggcaacttcatatccattggaaaggaacggctacgctgccgtgaggcgatctgccagccttacttgctggcctagaacgcctgtagcatgcactagactaccttcaactcgatc

SEQ ID NO: 517100 - DNA, 832 bp, Homo sapiens
agcggggggtgggaagtatcccgggctgtgggtggggtgtacgccgcacagctccagtcgccgtcgcggcttccggtgctaggtggaggcgaacggaaggagggcagtcggggagtgggccaggccagcagccgggctgaagtcggcttggggagccagagggagcggagcggaacctgcggggcagaggctggcggccgcagctggcgccgctgatagcaggaacaggatgcaagtcttccataccaagggaccacgtgccaaaaccagactgaccactggccctaacttgggccccactgtccccagaaagcagtcttgctgtgatcagtgggcaagtatctttgggaaaccttctcaagagcctgattgggaagacggagatgcgcatcctgatggtgggcctggatgccgctcggaaagaccgccatcctatacagagctgaatactgggggacgatcttcacctaccatccctatccattgggttcaatgtggagacagtggcagtataacgaacatcgagctttacagtgtgggatgtgggtggccaggacgaagattcgatccctctggagacacgtacttccagaacacccaagggttgatatatgtggtcgacggtcaatgatcgggagcgagtaaatgaggccgggtgcacagctgatgagaatactggcggaggacgagctccgggattgctgtactccttgtctttgcaaacaaagcaggatctgcctaatgctatgaacgctggtgagatcacagacaaagctgtgcctgcattccattcgtcaccgtacctggtacattcaggccccctgtgccaccg

SEQ ID NO: 517101 - DNA, 116 bp, Homo sapiens
gccgccagcatggatgacatctacaaaggctgcggctagagcagtgacaagaagagcagaaaaaatgagcttcaaaggcaagccttcgacaatcttcgtgctggcgctgaggatgg

SEQ ID NO: 517102 - DNA, 2168 bp, Homo sapiens
tcaaaacaaaacgaattgtggggtggttttaaatttattaatatcactactaggattctaaacttcaaactaacaccaatcaataattcagatagtatactactcacacatacaaagtgtatagaagatcagaatatataatacaaagtaacaatgtaataagagatgctgtaactcactacactagtcaatagttactaatcctacttaatacatatctctcacaacgctatcactacatgacaactacacagtccatcaaatacgatacaccactccataatctacgataaaatcataacatagtcacatgacaaacaatgtaatatagtaagaaggtagaggtgttcgaaagaaagtgcagtcgagtgaggaaagcagagagggagaggggacggaatgaatgggtagggaaaatgtggaggagagcggatgaggcgcgagaagtgacagagagacgctagaggaagggaggagaatgcggcagaaagggagttcggctggctcgtgcgtgaagtgcatggagggaaagaggtaacggggcgtaagaacgttgaagaatgcagcaggaaggttggtaattattaatataatgaagggaggacgaggaggcgctgtcgtagcggtgcaaggttgttagtggtgggaggtgttggcttgcaatgtgtgagggtgtagaagagaaagagtagaaggtagagagagataagcgctgagtgatgattgaggagattgtaggtatatatagagcgtttggtaaacgatatacgcacgttccggagagcgagagaagatggaggatggttaagagattgtttgtggttgggtgagtagtacaggaggtagagtatgtaatagatacgcgtaggggaagggtgggctgtgaggggtatatggagggaatgagagatgatttgggagtataggggataagtgtggtaggagcttgagatgatggtcagggagtagacacgtagggagtgtggggggagagagaggaagttgtgttgaggaggagagagaggggagacgtaagaaaaggagatgaggttgaagagaaggatggaagttaagtgaggtaataagttgatgagtaggtgagaggatagggtggtcgattggtaggtgatgggagggattaggttgaggtggttgtgtatggtggtgaggaagagtgaaggtaagagtctatgcaggggactggggtggatgaacggaggagtactgaggtgctggtgatggtgagtgagccttatagactggtgatcataggtgaggtgaggtagaggttgagatgctgacagatcatagcagataaggagagtgatgagtaagagacgtgagaaggggtatgtatggtgtgcatataggaggatatagagggtgtgggggtcgtgatgagctggttaggggtagattctggttgcttgaggcatgaaatggggagatgttgaatggggagtgtggggtgtgagggagagattatggtaggtgtgatggaggagagcgcgggatgcgaaggagagagaaatccagatgatgagaattgaggtgagttattaagttgggagtatttagatgtgagggtggcggggagttgaggtatgagatgggtataagaatagtatagagtgtgagtgttctgggagtcaaggaaatagaggagaagtagtgtggggtaagagggggagacaaataaaggaggaatgggacgtagggctaggagaagcagtagataggcactgtgttggtgttgtgagagaggagacacgatggagtagcggggtatggtaggagtgactgataggtcggggtagaggcgattggtgtcgagtcagtggcgtaactagtagctgctagaggggaaagtgaagggggcaggagagggggattcgtgaggaagagggtagttagcgaggaggtgtgggcagggttcggttgtgggggagtggtgatcacgcgaggtgtggtgagagttaggtgggatgataggtgcgtgtgcagagggtgagaggatgaggcgagggaggagagtaggcggggggggtaggttggagatgggtagtgagtatagagagagttgccgaagcgagaagataggaaggagtgtggagatcgtatgtagaagattggtggataaggagtgcgggcgtaggtaggggatgcgt

SEQ ID NO: 517103 - DNA, 232 bp, Homo sapiens
  misc_feature (182)..(182): n is a, c, g, or t
  misc_feature (221)..(221): n is a, c, g, or t
caggttggaatacagagaggtggaatgactcttctgcccttgggagcactggcaatccaggtcaactgcaggaagaagaaagggctactcaaaaaaacaaaaactgattcggtgcctgtaatcccagcactttgggaggctgagttgggaggatcacttgaaaccaggggtttgagaccagnccctgggcaacccctaagtgagacaccggtctcttacanaaaaaaaacat

SEQ ID NO: 517104 - DNA, 480 bp, Homo sapiens
  misc_feature (11)..(11): n is a, c, g, or t
  misc_feature (343)..(343): n is a, c, g, or t
  misc_feature (385)..(385): n is a, c, g, or t
  misc_feature (401)..(401): n is a, c, g, or t
  misc_feature (404)..(404): n is a, c, g, or t
  misc_feature (410)..(410): n is a, c, g, or t
  misc_feature (436)..(437): n is a, c, g, or t
  misc_feature (448)..(448): n is a, c, g, or t
aatgcccttgntggttccatttttatgtaaatggtgttgtttatattttatagggatgctgtgcatatcttgctgtgtgtccctggcatgtgtttgatgtgctatgtatctctgtttttattcttggaaggttaacataacttgaaaatgtgtctttatgtggcccatggtctgctgtgatgacatttagacatcatttgtgctatgacatttggctcatgaaaacataaatttaacattgacaggttctagtgatttaaaaccacaactgcccacttggtgaaaatgtgctcttgatgatgatttgtggtgtgatgctgtccacagataaaccagtgccatnagatggaaggcagaggatactgcgaccacccctgacagacgntggcgtagacaccagntgngccctntggggctcagagcaacggatggtcanntgcgaacagtntcgtccgatgttaggaaatggtcctgcggccg

SEQ ID NO: 517105 - DNA, 160 bp, Homo sapiens
tgttgaacacgatttggtaaaggtagcgatgagaggccatgtaggagtacatggtgggttgtctcattgcagccgtcctcaggaactgagttctgtgttggttgatccatgaacagctactaccacgcattaggatccgggcgctccaagctctctcgac

SEQ ID NO: 517106 - DNA, 423 bp, Homo sapiens
  misc_feature (294)..(294): n is a, c, g, or t
tgggaatgggatgggaggtatagtagaatcaggaaactgtccagtcagagacttcgacggtcatggattgggagcttcctagccagtggctgagttacgaacagagcaaacatagagcccgctatgcttggtagtattatggcggataaagagctttggtccgggtagctgaaacttttcattattggtccaagaatactgtgccggtgggttagagtccgcagaacaggacaagtagaggacttctcctgaacggtattaggtgattgaggggtaaatcctggggaggtcggnaccatagaggacatccaggctgacggcgtcactgcggatgccaccatatcggtcccgtatttcacattgatagggtccggttccatttctcgtgacacggggtagaaggaggatccggactaaatggtg

SEQ ID NO: 517107 - DNA, 846 bp, Homo sapiens
  misc_feature (54)..(54): n is a, c, g, or t
  misc_feature (93)..(93): n is a, c, g, or t
  misc_feature (96)..(96): n is a, c, g, or t
  misc_feature (99)..(99): n is a, c, g, or t
  misc_feature (167)..(167): n is a, c, g, or t
  misc_feature (172)..(172): n is a, c, g, or t
  misc_feature (175)..(175): n is a, c, g, or t
  misc_feature (186)..(186): n is a, c, g, or t
  misc_feature (196)..(196): n is a, c, g, or t
  misc_feature (199)..(199): n is a, c, g, or t
  misc_feature (203)..(203): n is a, c, g, or t
  misc_feature (206)..(206): n is a, c, g, or t
  misc_feature (222)..(222): n is a, c, g, or t
  misc_feature (275)..(275): n is a, c, g, or t
  misc_feature (278)..(278): n is a, c, g, or t
  misc_feature (306)..(306): n is a, c, g, or t
  misc_feature (323)..(323): n is a, c, g, or t
  misc_feature (333)..(333): n is a, c, g, or t
  misc_feature (337)..(337): n is a, c, g, or t
  misc_feature (339)..(339): n is a, c, g, or t
  misc_feature (343)..(343): n is a, c, g, or t
  misc_feature (356)..(356): n is a, c, g, or t
  misc_feature (369)..(369): n is a, c, g, or t
  misc_feature (373)..(373): n is a, c, g, or t
  misc_feature (378)..(378): n is a, c, g, or t
  misc_feature (384)..(384): n is a, c, g, or t
  misc_feature (390)..(390): n is a, c, g, or t
  misc_feature (399)..(399): n is a, c, g, or t
  misc_feature (409)..(409): n is a, c, g, or t
  misc_feature (413)..(413): n is a, c, g, or t
  misc_feature (416)..(416): n is a, c, g, or t
  misc_feature (419)..(419): n is a, c, g, or t
  misc_feature (428)..(428): n is a, c, g, or t
  misc_feature (437)..(437): n is a, c, g, or t
  misc_feature (443)..(443): n is a, c, g, or t
  misc_feature (447)..(447): n is a, c, g, or t
  misc_feature (449)..(449): n is a, c, g, or t
  misc_feature (453)..(453): n is a, c, g, or t
  misc_feature (456)..(456): n is a, c, g, or t
  misc_feature (501)..(501): n is a, c, g, or t
  misc_feature (510)..(511): n is a, c, g, or t
  misc_feature (514)..(514): n is a, c, g, or t
  misc_feature (533)..(533): n is a, c, g, or t
  misc_feature (553)..(553): n is a, c, g, or t
  misc_feature (564)..(564): n is a, c, g, or t
  misc_feature (649)..(649): n is a, c, g, or t
  misc_feature (653)..(653): n is a, c, g, or t
  misc_feature (676)..(676): n is a, c, g, or t
  misc_feature (683)..(683): n is a, c, g, or t
  misc_feature (717)..(717): n is a, c, g, or t
  misc_feature (721)..(721): n is a, c, g, or t
  misc_feature (775)..(775): n is a, c, g, or t
  misc_feature (827)..(827): n is a, c, g, or t
cggggggggaggggggagggggggggggggatatggggtcagtggagtttccanttcctgggttcaagggatggtgctgggtcagcgtccggngtnggngggactagagggaggggtgaccataatttttgtatttttagtagagagatggtttggggatgtggggnggggnggngtggaagtggngaggtcaagngangggnggnggggtcggaaagtgtngggattagaggggaaagcgaagggtgggggggagggaagaagtttagaatganggnaatatggaaaagaagatgagatgaaggntgaattaattaggatgnatgaattagnatangngggnaattatgagtatntggaaaggattgnaggnggagngggtgngaagangtgtgtggnggatgggggngagnggngangggggaggnttgtgaggnggaggnatgngngggngangagtggggaaaatagggaagggggggggggaggagtggttttatngggtgtggnnggnaaatgggtagggatgtganggtgggtggtgtttggtatngtttgaggaanagtggagggaaaaggttatggtcttcagcgttttaattatatccacgactagatactggggtctgtattcttcaaagtgtggggntgcntattctcccaggaaccaaatggnctccgtnttaagaaagtatgcttactaggaaataccctgcntacnttaggaataaatgctacttaaggaaaaaataagagagctgaaaaagctggtgcnatttgaaaaaaaaagggaaggaatgagatttaactggtgctcaaagtttctncgatacaaaatatttggtt

SEQ ID NO: 517108 - DNA, 173 bp, Homo sapiens
ctcaggactatcgggagccttaccctgagacaaggtgtcaccctgtcatccaggttggagtgcagtaggtgcaatcatagctcactgcagcctcaaatcccctagatcaagccatcctcccacctcagcctcccaagatagcatgggacacatagtgcacacacaccacacct

SEQ ID NO: 517109 - DNA, 215 bp, Homo sapiens
cgacgtccgtctctgtgccggtagccgcccagctcgcagcatgccctcgtgattacggatctctatgacagaacacttgtctttcatattacgggactgtgttaagtgtctgctggcctattttaggttgtcgtctctcttctgctttcggagctttcttctctagtgtcgcaccgacctgagtgatttgaccagcagtgctgcggtaaacgctt

SEQ ID NO: 517110 - DNA, 304 bp, Homo sapiens
cggtccgtcgacggacatcacaataaaaagatatacaggaagggccgggcgtggtggctcatgcctgtaatcccagctacttgggaggctgagacagaattgcttgaacctggggtgtggaggttgcagtgagctgggatctcaccattgtacttcagcctgggtgatgagaaactctgctcaaaaaaaaaaaaaaaggtttccccggtttttggcccttttctttaaaaaattactgctggaattccaacctttagggacctcagggttccattggttaattgttgattggagttctaagcgt

SEQ ID NO: 517111 - DNA, 104 bp, Homo sapiens
agccgcgcgtccagcatcatagacgagctcttccaggacaggtacttcagccgggagccccaggataactaacactacctgcccttcagcctgacccaccggag

SEQ ID NO: 517112 - DNA, 135 bp, Homo sapiens
tctgcattcgtcaaggccaagtaggggcacgtatctttttctatttcgtcacgtggttcatcttcccaccacacttatcttgcaccatgtccgcatgtccttaacaccactcctttgcgcctgtccatatgcaac

SEQ ID NO: 517113 - DNA, 335 bp, Homo sapiens
ccaccagctcacctagtctctggttccctctcagtaaccatcttttctgttgaggacatgattggctccttctctgtgggccttttcgtataaccgctttggccggcggaattcaatgctgatgatgaacctgctggccttcgtgtccgccgtgctcatgggcctctcaactctgttgaagaccttagacatactgatcttgagacaatacatcatcggtgatgtagtgcgtacctgtaccacagctgtacgcgcccatgtatgtgtggtgaaatgacgcccacgagcccttatagcagacctgggaaatctgcatcaggagggcatagtcgtca

SEQ ID NO: 517114 - DNA, 360 bp, Homo sapiens
ctgactcagccacgttctgtcggatatggagttacatagggcatcatacctggtcttcactgtcaccactctatataacactagaccatatactcacataaaccaccagagtgatctttcaaactaaaagcataaataatattcaaaaacctccagtggcatccatctcatgtaaataaccactccttcctacaagatgacgcctcacctgccccgacagactcatgatagttccctctgcacaatgaccaattagccacaagatgtgtgctcctgctggctcttggatgagcccaacagtcacacttctgcctgagggcctagcacatgctctggttgctgtctgagatacttatcccc

SEQ ID NO: 517115 - DNA, 404 bp, Homo sapiens
  misc_feature (92)..(92): n is a, c, g, or t
  misc_feature (361)..(361): n is a, c, g, or t
tgatgatcacgctcgcgggcgcgatgagcaccgccgagctcggcctcacgctcgccgaaaagatccgcgccgataaggtgcacctcatctcntgcaccggcgccaacctcgaagaagacatcttcaacctcgtggcgcacgaccactacgagcgcgtgccccactaccgctccctcagcgcgcaagacgaacaggcgctcctcgacaagcacatgaaccgcgtgaccgacacgtgcattcccgaaggcgaagcgatgcgccggatcgaagacgtgatgctgaacctttgggcgaaggccgagaaggaaggcaagcgctacttcccgcacgagttcttcttccaggccgttcgctcgggtgngctcaagaagcactaccagatcgatcccaaggattcgtggatg

SEQ ID NO: 517116 - DNA, 598 bp, Homo sapiens
gagtagctaggaccacaggtgtgcactaccataccaggccaaagtaatagtttttaaccatggtttgggacagatatcttttgagaatctaatgaaagttacataatttttcactagaaaaatgcatacatgaatgtcatcgacatattgcataaaatttgggtgactcacagaagcttcctcctctgatgcatctataaacccttgcaccccagttatgaagaagtaatcacttgatttttatgaattttatgttctgtaacaccaaagaatcctccctactttcacctcctctttcatttcttattaagaaaacaaaaaaattttgctcttgtgaccatgtagtattaattattatcgatatggaaaacatgttgtcctcatgctctttagcctggcacatctcatgccaagagttatctgtgcgagggagtttagtgggtataagaatcaggttttggcatcagacagatctgggttcaaatatggagtctgcagttagtggggtacaatggcaagttactcaactgccataccccatttcccttatcagagagaactgcaccttttttagtgggatgcatgggcaagttactct

SEQ ID NO: 517117 - DNA, 197 bp, Homo sapiens
tctaccaccagctagtgtgttcttgtgacccccaagcctgggaagggggaggtgagtttacacaaatggaaatgctataaaatggatgaaaagtgtgaaccatgaggttttgatgaatgccctagatgtaggtagatgtaatggcctaccatgctgctgcctactggtgtgcagtggcagcagtggcatgagtgaga

SEQ ID NO: 517118 - DNA, 199 bp, Homo sapiens
atagatgttgtactgtaaagaatggaagaagaatatgtggaacaggaggttgtaagccagcgcacctttaatcaaaacacagctatttgaattcaaaatccagtacacaggactctggggtattggtgtagcgactcagaaggttaacttgaatccgattcctctaggacagagatatgcacagtctggtgatgagaaa

SEQ ID NO: 517119 - DNA, 109 bp, Homo sapiens
  misc_feature (67)..(67): n is a, c, g, or t
ctccttctcccgggctctggaaatgccacccggactactttatcatctgccctataatcgacatggncagtgcctggcaaagagggcccgatgaaacgtcttcatgtac

SEQ ID NO: 517120 - DNA, 453 bp, Homo sapiens
  misc_feature (427)..(427): n is a, c, g, or t
  misc_feature (444)..(444): n is a, c, g, or t
cattgcataataataaagagttcaattcaatgagaagacctaactattgtaaatatatacccacccaatgtaggagtacccagatgcataaagcaagttctgaaacacctacaaaaagatgtagataaccacacaataatagtgggatactacaacatgacactgacagtattaggcagatcattgagacatacaactaacaaaaacattcaggacttgaactcaacacttgactaaatgggcctaatagatatctacagaactctgcatccaaaaataacagaatataaattattctcatctgcacatagcacatactctaaagtcaaccacatgattggccacaaaacaaccctcagcaaatcaaaactggaatcataccaaacatactcttaggactacagtggcatcaatcaacactaagagnaatggcttacctatgcnatttcttgg

SEQ ID NO: 517121 - DNA, 346 bp, Homo sapiens
  misc_feature (318)..(318): n is a, c, g, or t
tagacttagatatacgtccaccaatggtgtatgatatacctgttttatgtgtagaaggatagagagacttagggctataaaggaagcatgaaagttgtattgccatagggagatgtattgccatagggaaaattgtattgccatggggatgtggtcatgatttatgaagattaatctggtgacagtgggtaggattgattggcggaatcagaatttagaagcagggagatgtaattagagaatatgtcattacctagaaatgaagccacaaagtctaaagtaaaagcagttagaaaggaagtggacagataaaatagntggattaatcgtatttgagtgtacattt

SEQ ID NO: 517122 - DNA, 499 bp, Homo sapiens
cgatgggatttcatcatgttgcccaggctggtctcgaactggaactcttgggctcaggtgatcctcccacctcggcctcccaaggtgctgggattacaggtgtgagtcaccggcctagccaaaaatcttaaaactgtttttagtcatcatattgttagtagtaataatgttgtaaaatatttaaatatgtggaaacgttttagattattaatactaatgcatagtatatattttataaatttactttatgtttcatagtatataaagcacaaataggcaactatgttggtgttatcaagaaccaagatttttcagtgtaagagaagagaaatctaaacaaagttaagctcaagtcacattcccatttaaaaggaagcatagttttgactactagtgtaagataaaggatagaacataaactaccctaagtatccaataggcaaaattcaataaatggtaaattctacaaatgatctggtttcttcagtaaattgaaaga

SEQ ID NO: 517123 - DNA, 392 bp, Homo sapiens
ccttttttcaaaaccggaatccagtgggcaaaggcagctttgcagggggtccccggacggactccttccccgactgtacccccgggggagttacccggcctctttgtgccgcttcatttgtaaagggctgtaacagtgacctcgcccggtcatccggagtattaagccccagtaaggtgttcaggactggtaaacgactgtcctcaagtaaggcccccgtgttgggccccccccgtgggggccgggtccccccctttgggccctgggtgggcccccccctgcccccctacaaaaaccagactgggttccccgggcgccagcaggggcagcccccgcctagggtgggctccagccctgcggggcttttttgcaataaagtcccgggggtttga

SEQ ID NO: 517124 - DNA, 529 bp, Homo sapiens
ggtcccgtctcatttgaatccttctccatctaaactatctaccctgccctacgacaatgctcgaagtaaacattgtacgaagcagatgatctaaggcaaactcttagcaattaaaataggatatcacgatacaaatgtctggttgaaatgcatcacaaattctgtccgcacattaaacaaaagcaattgttatgcttgtgtgcatggacggccagaggcccagattgtcccctttccactcgaatggtgctccagtcaaccgggcatgggctgcatggtaactctcttccaggattctacagctaggagtaataaatcatgccaagctctctccctgctctataccaaagtacaacacactgtgggttagaccccaagggccatccagcttccatctctcaatgtacatttcaccttgtgtctctcacggaatgggaaaaacttggcgttcctgggaagcttaatggaacacagtgagcttaaagccttccaagagcttaccatcagtctgccttatgcatcttgagcc

SEQ ID NO: 517125 - DNA, 1403 bp, Homo sapiens
ggctggaccccagatgcgctttcgtgcgtcctggtatggctcgccgtctcttccgacggcgaatgtctggcgcgcgaggcagtctgtatagtcatgcgacgtgtccatgacgtggaggggctccgctccctgcccctgtccccagggccgtgtcctcatgccctctccctcgggtggttctcaccgcgccgtccacgtcggcgcttgcgtcgaatgcagctgctcgcagcgtaggcggcgtagtgcttgctcatcgacgctggatgtcctcggttactacgtagtatccgacttgcggggtttccgcgtcggtttgccgcttgcggtctgttagagccgtgaagcgcccgctgattggctctcgccgtgaatagcgggctcgcggcacgggtgtgaaccgccagtcgacagggctccgctcgttggccgtggtccaattagggctcggtgtgaagcccggggggctctccagggttggttctcagctctcggagtctcggccctttgcgaccgtttcgtccgatttggccgccgcatggtgggcgcccgtatgtggcgtttgtttgtggcggtccgcggtcctggtcttcgggtgaaggccttcgttgtgaacgacggtgtgcgcttttggtaggtctttcctccaggcgttgccgcgttacaggcgctgcccttaccttgcgcatcacctactttgccccttacaattcccctgagtgctgttggggttcccatttccaggtttttgcgtgctctcaattatgcgctgaatttatggcccgccgattaacttataagcgcacactgtgagaaggaggtcccccatggcaatggggggccccggaggcttgggttaaacatcggacctctcgaaattgagccccccaagggtgtcgcccaaatgagaaggaaagagccgagcgagtgttggaatgtgaacttggttcggttgggggaggcctattggggaggcgaatttcgggttgcgcccacagagggccccgaggcaagatggtaaagcgaccgaaccttcgtgttatggttgtacccccatttgtgggtggaaactagggccgctggaggccaaatccaagagagattatccacaagcctccgaaagcaagcgtataaagttatggacgacttggtcggcaagttgcagattccggaggctcggcgagggcacaaaggcactttgtggtcacatttccaaaatggatggccagatcttaaagaggtaaacgcggtacactattcctccagaggcaccattccgcgacccgccgggatctcttacccacgctagaccgattagcacccttatcttggacaccgcgtacacacaacggggttttggtcggcagatgacacaaggagaagtttgcggagatattaacgccatt

SEQ ID NO: 517126 - DNA, 940 bp, Homo sapiens
cccgggggtgagggggttacccttcccagtgttttttattcctgtggggctcaccccaaagtattaaaagtagcttgtaattccaaaaaaaaaaaaaaaaaaccagaaaaggaaaaagaaaaaatggaaggggaaaaggaggacctgatggaaaggttgaagcaaatcgaggaacagattaaaagggttcagcaaaaacgggaagaaacagaccccgtaagggctctgggaccatggagcgggaacgggaagctgtgcccagagctgagagcttgaaaacgctgggccaagggagcgtcaaaaagctgaagaaggccaagggagggcctggttggagggcctcccggggaccagaaaaagactcgggaacagctgggcctgggaaatgggcagagctgacagtcgaatctcccagcgggagatgggcccgcaagaaaaaggagaattgaggttggtggatgtgggcgagcaaaaggcccagtatgggtacggaagatttgggagaaagacccgtgctggagttgaaatatggcttggagtaccctctaatgttggaaggagcccggtgtgagaataatgagctggatgagcgggatgacaaataggggcagagggtaagtggctggaccctacgggtggtatgctatggccacggaccgggtggggcgggcacgtaccctcttggggcggagaaaaatgacgcttgtgcggaagccctgaggccctcatcgggagtgggcatgccagagtgatccagaaaatgcgattgagtgtcccgggtgaacatggatgggcgagaaataagacctggcaatccggtggacccagcgggtggatggttttgtgtggccagttaggcccctcctttctggcctaactatatcctttaaaaattttaaaaaaaaaaaagggtttgtggggaaagaaaggcagtatttca

SEQ ID NO: 517127 - DNA, 579 bp, Homo sapiens
  misc_feature (574)..(574): n is a, c, g, or t
aaaaattactgaaatgtcaaggattttgttttgtggcttgggttccctgaagcctagcttgaagagaccagcagtgaattacagtgtcgcactgtaaagacactgacaagatttttgtcattaaagttaaaaatattgcagcagattgcctgggtaatcagaccttcctttgatgtgtgtggtaagaattcttattcaagggaactgaggtgggatatatattcattattagagactccagcgtggatatgattttaggtttcaatgaaaagctttcttccagaattaccatgcttgaggaaatatgattaagagttgatcacatttgttcaccagccacagacattcttgcctgtttgagagcacgggtacgagtgatctctgtgcttctaggcatatgcacctatcattgttgggtcttccaaggatctaatatgtcaatccagatccatgcatctggtggctttcatccctctgcctggagcacagcctcactttcatgataatggatgcccttccaactttctaataaggaggctttgtgttggtccttgtgtttgttcttgggataaanggtaa

SEQ ID NO: 517128 - DNA, 218 bp, Homo sapiens
catcaatcatccacatttcaatgacaacaaatgtgtttccaaaaataccattcgttgaaggttcaggtatctttcttttctctatgtggacatctttcacaggattacacatatgtgtaaattcaagtgcttcttcattcaccagcaaatcacttgaaacagaataaacacatcaaacatggcccccacttcctatttcaactactccatctccaacc

SEQ ID NO: 517129 - DNA, 176 bp, Homo sapiens
cacgtgcgaatattcaatttagaatctcctgtaacctcaagaggacagatgtgcacacaacctgtattgatcagctcttgagcagcagcagcacatagctacactgattaaacagattaaaaaaactgtctcaagttgtctgtgtcggtatccccaatgtttgtttaacttcacta

SEQ ID NO: 517130 - DNA, 507 bp, Homo sapiens
gtgtcacactggttcgagtcatacaagaggtataccttagactaaaggttctctgcctctatcttggaaatacggacaacaaattccagaataaaatatggtacaacttcaccagcctataatgaaattttgtattccaagagagtcaaaatcacggcgtccattgtctgattaaagattgccaggcatagaaagagcaagacaatagcaatacacaaccagggaagaaaaatcagtcagcagaaaagagcaagaacatgacagcgctaggtggcgatagaaggcaagtaccttaaaacagctatgataaacgtttcccatgtgtttaaaaaggtagacagcaaaatgtgaacattcacagtgcaaaaactggaaaatctaagaaagacccaaattgaacctttagaaaagaataataccagtatctgacatgagaaacactgaatggaatgttccagtagagtggacaacgcagaagcaaatgtaagtgaacttgaagacatagca

SEQ ID NO: 517131 - DNA, 114 bp, Homo sapiens
  misc_feature (81)..(81): n is a, c, g, or t
cggtgtctcgcaaaggttctagaggacaaccggcgccactcggtcgggagctcacatcttgtccgcccataaatattcgtnccctgtcttgggtcgctggcacagccccagacc

SEQ ID NO: 517132 - DNA, 495 bp, Homo sapiens
gtaggatcaccccggcgctgtagcgaatatctggcacgcagaggggagtctgtagaagatgggcgctgtcacgagaagatgatggggtacacagggacagagctgtgccaccatatctcctgtgagataggagacgggcagcacagatagcccacaagaccgccagagagcacagacacgcggtagagcctgtgcgctcgtagagggaggcgttgcgggagcacagagacgcgcctcttctctcacacgagcgtatatccgcgcggttccacgcatatccatattgtgcggagctccctcttcctcttcttcttctctctacatctgggggctctctatatctcggtgtgtcctctgagatgcgctatactcttctttttgtgcgctctggagacactcttacagcctgtgcacacagtgtacactcttttttctctgtggagagtctcgaacatttataatatagggtgaatgcgctcgtgtgagatgcgcact

SEQ ID NO: 517133 - DNA, 718 bp, Homo sapiens
  misc_feature (396)..(396): n is a, c, g, or t
ctctgtactatctacagggagagatggtacaggatctcccttgtggaatagactcatatgcgggggagtggaagcctggtgcaccattatctattaagaggtagaggtgccacaacagagatgaaagagtgggggagtagacacttggacctcttgtatcccaccatcttgggccatgaaggggctggaatcgttgagagtattgcagaaggcgcacgcacagcgaaaccaggtgacaacagtatcacactctttctgtcacagtgtggagaatgtgcctctttgctgagatctgagggcaagttttgtatacaactcatacagggcagaacccaactgatgtctgatggtaccagacggttacactgcagggacagtcaatatatcacgtatgtnatacccagaccctctgtggatacacagggataataggtacctcagtttgccaggaatgatgcagtcgctcctctagagaaagtatgcctattagctggggcgttcccactggttggtgctgcatcaagactgccaagggcaacaggttctacttggccttgaatgcctgtgaggcgccggcttgtctgtgttaagggttgttaaggacatgaggcagctcagacataggggtggaggtttaccctgagaaatttaagcaagcccaggattgttgctccttttaccttaccctaggactatagaccctttagaggtgtttggc

SEQ ID NO: 517134 - DNA, 369 bp, Homo sapiens
ggatctagaggacccccgagctctgctctgatcatgcgggcacttacactatatgattattagcataagtgtagagtggcgtgtttgaggaagttaagagaaggtacatgtggcctcacccgatgtcacttccatcttattgacatacaacctttccaacacaaatgcttgtcatgtctcccctaagaaagaagccctgaaaatgctgcggaatccaacagatgaagatgttccttggcctggattcattcttgggcagaccccagcttcagtatggtactggtgtgctgaccaagtcatcgtgcagagggtctgtgtagatcatagcattgcgtgctctcaggataccgagctcgcagtccgaccagt

SEQ ID NO: 517135 - DNA, 291 bp, Homo sapiens
aaagggccctgtgccccccccccctcatccctgggttggggccccggtggctaaaggccctttcccttgggcccccccccccccggatggggggccgccccctcccccggctgggtttctcccccaaccccctttaatgggggagggaaaggggggaaggggggggggcccccccccccccccgggcttttgggggggcccgcccccctggggttttccccttcccggggggcctctcccccccccctttgtttaaatccaacccggattaaaccccccggttttttttga

SEQ ID NO: 517136 - DNA, 302 bp, Homo sapiens
gataaagaaacgtgggggcagtgcacggaggctcatccgttgtaatcccagcacttggagtggctgaggcggagagatcacctgagtgttcgtgagttcgagagcacggctgtatgaagcatggcacatccccgtctctactaaaaggacaaaaaattagccgtgcttggtggtgggcacctgtggtcccagctactcaggagcctgagacaggagaattgctggaacctgggaggcagaagttgcagtgagccaagatcattgcactccagcccgggccgacaacagcgagacaccgtctc

SEQ ID NO: 517137 - DNA, 555 bp, Homo sapiens
cctccccccctgcctttcataaccactcccatgacacactcccctatttcagctcggtcccccaaccgatttaatatcgctcttgctcccctcttgcaatattgatatagaactcgccttacgcccccgctttgtgtttccccccaaaggagcacctcacctacttcgccgcccttattctccccctacttttgttctatttgttcggtaaccacatctcgcgccttactgtctattttcccccaatatttgacgcatcgcgcggagcgcgcatgcatccgcctggcgcacactgcttcagtcagaggcgacctcgaccctatggccgcccgcttattatggagccgccccgcctcgggctcgatgttaccaccgcacgtgacgccctttcccgtcgcccacggtagtgtttagttcgccgacaatatgtattatgccctgagtaatccctaagtaatacagccgctccccgctttcttccccaccctgcataggtgttatcaccacgcatctaggtgggtaacgcctctgcaccggccggccacccctcaatca

SEQ ID NO: 517138 - DNA, 941 bp, Homo sapiens
gggagttggggaagctgggttggctgggttggtagctcctacctactgtgtggcaacgaacggtatgggtcatgaacagaaccaaggagctgcgctgctacagatgttaccacttctgtggctgctaccccactcctgggccgtccctgaagctcctactccaatgtggccagatgacctgcaaaaccacacattcctgcacacagctgtactgccaggatgggagtcccagctgtgggactctctgaggcctacgacgaggaccagcttttcttcttcgacttttcccagaacactcgggctgcctcgcctgcccgaactttgctgactggcgctcaggaacagggcacatgctcctgcccatcttactttgacaacagcagcttctgcgagctggcatgatccacgccaaatagggcccaaaacctctgcatggcacgaactcccggctgtccacgagcggtttcctaatcgctgaagtgtctcacgcctgaagcccccctggagctctggcaagccccaaacactcttggctctgctcctcgctcagctacatcttcttccccacccattgctgacagctgcaactggcacgcactcaatttcccgtccccctgtgcgacagggactctgggggccctacctcttcgctcctcagccttgctcgcactgcgaccttcacgctttccacggcctcctcctctcacttcacaccctttcacaaccagaaacccttctgcagcacttcatccttcctggccactggtgacctcacccgcaaccatctgaccgccttacaccaggcaacttgtgcctaatcggggtacccccgggaaaccgcacctggccccccacgaattctgcctggccgccattgctgcctgccgttcgccgtctggcctctggcccttggcgcctgtgtcctcgcacacatcccatcc

SEQ ID NO: 517139 - DNA, 347 bp, Homo sapiens
cggaaaaggtacagacagatgaagagtgctaggaacgtagaaattctagacaggccgagtaatgtaggtgcacgggaaggacgtggtgagagactaggcttgaaaggtaagcaaaggctgtattatggcaggctgtaaattgactttatctggtctcaaacagaggagtgaaaggaaatgatgtatatctttttttttttttggaaacaggtgttgcagtcgtggttcccccgagggtgggaggtgcaagggcgtgtgatctcagtctcacgtgcaaccgtccagcctcccgaggtttcaagcgaattctccttaccgtcgctctcctgagttaccggggaattacg

SEQ ID NO: 517140 - DNA, 508 bp, Homo sapiens
agcagagtctccagagctatttgcacaccctccatggcagcactggtagacaaaaggtggaaaaaacccaaatgtccactgatgtatgaatggataaacaaaatgtgatatacacatacaatggaatactacacagaataaaaaagaaaatattgtagcacattgtcacatgctacaatatgagaaaatttgagggctttatgctaatgagataagccaatcacaagaggacaaatacggtatgattccacttacataaggcatctaagctagtcaaatacataggtatacaaagtacacagtggttagcaggggtgaagggagggggcaaaagggaattgttgtccaatgaatatagtttcatttctgcaagataaaaaagttctggacatctgtttcacagcaatgtgattatacttaacactactaaactgtacacttaaaaatggttgagatggtaaattttgcaacacatgtcccttaccacaataaaaagcaaaacaaaaac

SEQ ID NO: 517141 - DNA, 668 bp, Homo sapiens
tagccaggcgtggtggcgtgcgcctgtaatcccagctacttgggaggctgacgcaggggaattgcttgaaccagggaggtggaggttgcagtgagccgagattgtgccactgtacaccagcctgggtgacagagcaagactcttatctcaaaaaaaaaaaaaagtgctccagggcttttaaagtgagaagttaaaatttttcttaagtttaattaaagattgaagaatgtgggctgacttatttattgattgaaccattaacttaaagtgtctttatttaaagcaacgtgagtgtgtcttagccccttaaatttaaccgaggtaaaaacgtgttaacacttaaccgtgaagttttgggtgaataacgtgttcttataaccttattggagaatgttgtgcaagaaaagtgcacattccaggggtggaacgtgggaagctagtgaaagttgactaaatttcctcctttgcagtggtttacctttcaagatggtataggtattctctcctctttctttcccccagtccccatttacttattggcacactggtttaacctggacttccggtttggatatttatcaccaagaccataaactcatcaatatgaatttcctggatgtatactcacgatggtcttggatttatggtccctaaattttttcagatag

SEQ ID NO: 517142 - DNA, 513 bp, Homo sapiens
  misc_feature (26)..(26): n is a, c, g, or t
  misc_feature (33)..(33): n is a, c, g, or t
  misc_feature (61)..(61): n is a, c, g, or t
  misc_feature (70)..(70): n is a, c, g, or t
  misc_feature (160)..(160): n is a, c, g, or t
  misc_feature (162)..(162): n is a, c, g, or t
  misc_feature (173)..(173): n is a, c, g, or t
  misc_feature (328)..(328): n is a, c, g, or t
ggattcaagttgggcaacggaccaanagctgtntccaaaaaaattccaaaatggttgggcncagtggttnacacctgtaatccccagcgctttggaggccaagcgggcggatcatgaggtcaggagtcgagccagcctggccaagatggtgaaacccatntntactaaaaatncaaaaaattagctgggcgtggtggcaggcacctgtaatcccagctacttgggaggctggggcaggagaatcgcttgaacccaggaggtggagattgcagtgagccgagaccacgccactgcactccagcctgggcaacaagagcaaaactccatntcaaaaaaaaaaaaaaaaaaaaaaaggaaacagaaaacaaaagattagccgaggatggcagcacacacctgtagtcccagctacccgggaggctgaggtgggaggatcacctgagcctgggaggtgcagtgatcataccactgaactccagcctgggtgacagaataagacccgtgtcccccctg

SEQ ID NO: 517143 - DNA, 135 bp, Homo sapiens
tgggtctgtttttttaggtctaccgggccgggtaaacctaatttccctctaaatttctctcaaacaggggttttatttttatttttaattcataggttgaggtctaccgtgggggttcccgacctcgaattccgt

SEQ ID NO: 517144 - DNA, 653 bp, Homo sapiens
  misc_feature (541)..(541): n is a, c, g, or t
aagtcagctaaggcaataagcttatgcatgaacatttcccagactttcatgaagctgtggaggtcctagggcaattaactgcagcagttgcgataaagtaaaaacatctcacctaagtctccttttcttcataagcatagatactgacatgatgaggaagctctcaggcttagggaaagagaagtaagattattaggagttatacgaagcatggatgtgcaaaaggtgacatggtaaccaaagtgtggctggacaccattatctcggtaacgcgtgggtgtagtcgtcttcctgtggtggtgtgagtcacctctcgagagaaatgtgtgtgtcgcaccgtgagagagagtctctaatgttgtctggaacagagaaagtctgtagcctttccagccagtttactgtgcgtagtgggtgaaaggtaagactctggaacctagggttgcaagagctctgtatccacgagagcgtctggttaattccgtctcaacggccttagaaataccacttaggcaagcaacagatgcgcgcgggtataacncttgtgagagagttgggcttctggtgtcgtgcgacaagccccattaaaataacccgaacactgtggggcttaagtctcgccttatgtgggaccccctaattttaacaggccg

SEQ ID NO: 517145 - DNA, 468 bp, Homo sapiens
tcgagctgccgcccagcgccactagcgctgatcacagatatgatggggctcgggacaccggtgggggccgcactgccggtactcatcctgggggccctggcaggctgcatcccgcgaagaagggcccacagcatacacgctcccgtcgctgggtgcaagccccacacgtgacgctgcaactgccccatgacgcccaggcctgccacttgccatgcactgggcgctgctgcgggaagcagtctggggtcttcacccagtggccctgggactccgcacccccgtacgaaggcccgttgcattcacgcgtgcgctggtgtcggccctgggagcagctggcggagcacgcgctacagctcgaccactcatttcacgttccatacactgcccgggcatggcacagggcaatgttgcaaaaatcggttcgcttctcagggccctcacaggggttgcccgcaaactgggggggcc

SEQ ID NO: 517146 - DNA, 766 bp, Homo sapiens
ggtcttcctttgtcttctgccgtgatcgtgaggcctccccagccatgtggaacttataaaataataatgatggctgatcctgcaaagaggcggcggtgacatcaaacagtgactcagtctctatgatggtattagtaactggacagacctgactctgcctattgtatctatcaacgttaatgttccgacaataagacttgtcaagatctcgaggaaagaatgacaaatcaccttccaggcatgggttcaacgttaagaagctgaacactagtgtcttcgtatcagctcaaagagaggtttcgatagtgtcgtggcttccttgtgtattggttgaggaactgtgccttggcatgcggtgcaggggtagtcttgagaatgggtcaactgatggagggggagtggaagacattggttgcccaagaaatatatgtgcaacgtctgtccatcactgctactccggcctgattatcatctcttctgcttctgtaagcaccaatgagactggtgccactgaaacatattctttgtagcctgtcagtgatttcccaccattgcgccactgctgtatatgctaagtgaggaagcccaggttttagtgtgggtgaaatagacttttcaggcagcatacagtgggtcaacaatctcggactctgtacagcggtcagcctgtctgtgagagggtcctctttcggacgggtccttctcacaactgattggtgagtgcgtctggcgttaggaaggccattaaccatctgggtggtgtccg

SEQ ID NO: 517147 - DNA, 660 bp, Homo sapiens
gcatgggacccatgtctcctgggacagaggccatctctcttccagagagaggcagcattggcccacaggataagcctcaggccctgggaaacctcctgacccctgcaccttcgttggagcccctgcatcccctgggtccagccccctctgcatttacacagatttgagtcagaactggaaagtgtcccccaccccacacctcgagcggggttcccctcatgtacagatggggcaggacccagacacgcgtgctggcagagatggtcatgagaacacatccaagccagatccccccagaacacagcgttcccccatccgtaacctaactgtaggcttgccaccacagaccgacagcgggtcccaggccccagagaagatgagatctatggcatcaggatctgaaaaccaggaaagcacacatacaggagcggaatcctcccatgcactttcaacacagcatccaacgccatcacactcatctggaactacctaggcaagggcgggagaagggagggggcataggagggtccccaaaaccacccaacgatggccgaatactaccatagaggaaacaacaggagggaccagaaaaaatagggaccaagcagaagagactgagatgaggacaaacaagggaacaatcaaggccagaccccggga

SEQ ID NO: 517148 - DNA, 418 bp, Homo sapiens
agtcgattctagaggtatcccgtactcccactcaggacgaaagagatccttagtatcgtattttggtagtggatgtttacacagaggacagcttccgtgtttttcacaagtgaggtgagacatctaccacgctttgagacaaactctatcttttcctatgaactcttctctaaagcacgtcacagggaaaaaaagggtttaaagagaaataacttctccgggcaaaaactgaggttagcgggcctatcagctgtttcttctcactccaccactgctgctgactggaggagcagcctggaaagcagccgccctcccgcaaacaggtaaaccacattacctattcctgtggcggaggcaaatggatggtcaaacctaacggggtagtgctgaagttcggggacaaaagcccatcggggag

SEQ ID NO: 517149 - DNA, 108 bp, Homo sapiens
tcttttgataggaggagaattggggataggtgtataacctagggtgtatctcgtgtgaatagggtatatgttgtactgtgtgggtagtagccccattgtgtttgtgga

SEQ ID NO: 517150 - DNA, 577 bp, Homo sapiens
ggcggatcacgaggtcaggagatcgagaccatcctggctaacacagcgaaaccccgtctttactaaaaatacaaaaaattagccgggggtggtggtgggcacctgtagtcccagctactcggtaggctgaggcaggagaatggcatgaaaccgagagacggagcttgcagtgagccaagatcgcgccactgcactccagcctgggcacagagcgagactctgtctcaaaaaaaaaaaaaaaacgagaacaaaaacaaaaaaacttaccatctaggccaggcacggtgactcacgaccataatcgtagcactttgggagggcaaggcaggtggctaacttgaactcaggagtgagaccagactgggcaacatggtgaaaccccatctcaacaaaaataaaaataaaaataattagcagggcatgtcagtgcactccagccccagtgcactcagtagccccagctactgaggaggctgtgttgggaggacggcctgagccctggaggtggaggttgcaatgagccgtgaatttaccagtgccctacatcctgggtgacagagtgagaccctgtcttatt

SEQ ID NO: 517151 - DNA, 220 bp, Homo sapiens
cgcagtccacttttcctacttctcccccactctttcgggctttttgtgttcgcccactctcctcatctccatttctcccacattgcacagtccatgcctcacactgttcccatatctcttttttctctccattcatggcatcgcactgcatgtctctcctgcacccgcgcttcttcatccctcggccgcctccccaagcgggtcccgcagctcgcaattg

SEQ ID NO: 517152 - DNA, 310 bp, Homo sapiens
tccccttggtcctgctgacacagtgctggccagggacatgtaagtactagtccagctggggatagctttctttccataatcaaaaatcaaaatcttatgggagatatttttaggccttcagccttcttcctgccaagaatattgaactgatgcctggaggttcatcatgagtatgaaaactaattcgagggaatgctctgcaaatggattgaaagacttggttttgtgatgtcatttatcacctgcagtcttatccattccttggtctgtcaagccccaggctgtggggggtccgagctcgaatttctaa

SEQ ID NO: 517153 - DNA, 197 bp, Homo sapiens
gaagacaacagtaactaagtggggggaaggcataaggcagggactcactggtactcaatggatcaattacaaagagacaatgaaaagcatgaccctggaaagaacaaataagcagaaggcaatagtcggtcaggcatcaatgacaaaaagtaaagccatcacaagggtttacttttctttcttattctctcttttat

SEQ ID NO: 517154 - DNA, 816 bp, Homo sapiens
tgggctaggacgaggccgcagatgtacaacaaggacagagggtcttaccccccatatcagctggaagcatgctgtctgttctgcatggagcagctgaacatctacatagatgttgcccggccctccccatctgcaccctgttgagttgtagttggattagtctagtttatgctatggacttcaccagagtgactactgactagtgaaaagaaaaaaaaaaaaaaaaaaaggacagccagtgatactactggaacacggcacggaaacacgaggaacccaagaccccaccccaccaccgcaggaggcctcaacaacccccacacaccgggagagcacaggaagagtgcccactgaagaatgaagcaagccaacaccagtgcccagaggcacccacacacacgaatcagagaaagagcgctatctacacctcaagacacaatcaatgagagaccacaaacaaacaaaacaacacaagcatacacaccacaaacaataagagcgaacacaccgcgaacacaacacacacgagagacaccgacacagcgacacggaaagaagcacaacaagacacacatcacaacggacaacaagagacaaaaaccccgaacaacaaacacacgacaccacaccccagacatccccacagataacacaaacgtacccaccaccaacaatgaagacaacaacacaccaccacctggcgacagcctcaaagcgcgcgaaccaaacaacaaaaacacataaaaagagaaaccacaccgaccacgacaccaacaagcaaccacaaggagaacacataaaaaaaaaagacaacaa

SEQ ID NO: 517155 - DNA, 147 bp, Homo sapiens
  misc_feature (104)..(104): n is a, c, g, or t
agacagccctggcatccaccgagcgcagtggagccagcagaccggaagcgcgccgggcgagaaaccgagcagagctgggtgcgtctccgggccgccgctcacgnactgccagcgccctccccatgtccctgctcccacgccgcgccc

SEQ ID NO: 517156 - DNA, 658 bp, Homo sapiens
taagtagctgatagttctcattagtcatatcctcaaccttaattacttctaatcatcgtagtcaagatgcgtgcagaagacgatgtcggctatgaggttgcagtgcgcgcagccattgagtaaggtgtggtagataggtcggcctgtgtgtcttcctgagtgcttacagcaggaagtgggcctccttaggatccggctctcatctcactgtctctccatcacatagttccttagtgtggtcagggagtcccgccggatgtccgtccaggtaggtccattattatagatgatctctccatgtcgctgtgcgcatggtacgcgaggaggtcgcctctgctcgagtactcgtccttgtagtccagcagcgcttccttcaccgccttgtagccgtgcatcaccaccatgcgcttcgagcacacgtacagcgtgcactccggcacgaagctctgggcctctcgtgtgaaggacttgcgaatattcttcaatttcgactggaagaggttcacgatgatggcatagcgggagagtgcctgtgggcagattccaactgctgtgcacctgcctccacatggacatcagcaggaggacggccgcccactccagcagggccgcggtgactccgagcgcacacatggtgccgctgaggccctctcgtgcc

SEQ ID NO: 517157 - DNA, 536 bp, Homo sapiens
  misc_feature (21)..(21): n is a, c, g, or t
gtgggctgacttagaggaccncgagtgggtccctgccctatccggatccctctgcagaccttcctaccctcgggcagatcagcacttcagcctaagttggtaccatctgcagacttcctgagcgtgcactcaattccctcatccggaccactgatacaactgctaaacaaaacagccacacaactgagctccggtgatcgtccaccagccgagctgagctctgctcacagtgactccaatcctgagcacccagcaagctgtgcagctgcccaagccacagacaacccagctgatccgggacggcgccgttaaacacttcactcagccctgttagacagcacccacagccttcctctcttctgctgtgtaggttcctgttgcaggtgtcgtggaagggctgatttggccgcccagaaggagccctgccctggagctggcagctggtggtgaagctgggctctgtgtccagagacatgcagagatgcctggagctgagatgtggggatttcatattctagcagaaaaagcagcttcat

SEQ ID NO: 517158 - DNA, 404 bp, Homo sapiens
tctgagaggacctcattgaacatgggaagcttcccttcatggccactgctgcggaagctgtgccaccctgctgcgggttggaatcagtacccgccaccatgagctccttctccagagactccagcatgcgacgtcggtgatccacagtcggcagtatccatagcagatttctaaacgcccatgatgccattgatgccctcgaggctcaactacagaactcacgcattgccctattccttcgaatatcacactgatgaggcggcatactaactagccctgcacacgcacacgtcccagagcggcaggtttctttgccaactaagccgtcagcagcttcgtatggcaatgcggatacctgtgtcgtctgagcagctcaagagggcacaactgagagtacacaaggc

SEQ ID NO: 517159 - DNA, 841 bp, Homo sapiens
  misc_feature (311)..(311): n is a, c, g, or t
  misc_feature (841)..(841): n is a, c, g, or t
tggacttttaaaagaagtaagcctttattcccttgttttggcaaataaaatctgggctaagtgggttggcttttggtgtgattagtcaaagaaaccaaatcccatatcctcgtccgactcctaccgatctcttccttggcttcaacctttagctgtggtggctgcagcacgcagcaaggagcatgctgtgtttggcatgcagccacagtggtgcagcagcccacaaatggcaagattgggatcatgccacaagaatggccttgacccttttcaagcaatgtggtgaagtgttgtaactcctgtcctccacnagacaatggccaagtgacctcgtttgtgtcccctgttgatggatacgaatgtgtgggtgtacttgatggcaccttgttcggtgtacgccaatcttgcagacagacactgggcacctttgctggacaccctccatggaatgcgagattgcagagttccctctgtgatatcaagcacttcagggtgtgtagatgctcgccattgtcgaacacctgcctggtatgaccagcccaatgtgtcgaccgggggacgatgttgacgctttgttcacgcagcgctggtcttcgctggctcccactgttgtctccacgtctttgatcatgctgcacatccactcaggaattcaatttggtgccccgtggagatttagtggttgatcctaaagcctggaacaaggaggtcttctcgggcccgacacagtgttctgctgtgcacgtagtctcctttgggccatgctcagcctgggcatgttgccctttgtgcgacattcctatctcagtgtgccccggcacccacccgtccccgtttggcn

SEQ ID NO: 517160 - DNA, 217 bp, Homo sapiens
gagggtttcaatgagttcctgttgctgtttggtgagcacaacatttctcgttggcatcgtcgttctcgctgttcgacccttatggcacaatatgccagacgggggctgttgcttcaatcacggtctgctgacctgacgaaggcaatacgtcctatacgtcaccgctaccccagcgccgacgcgacatgcttcaggatcgcttcgatcgcatgcgcgc

SEQ ID NO: 517161 - DNA, 242 bp, Homo sapiens
  misc_feature (82)..(82): n is a, c, g, or t
cggctgctgcggtcgcctctcgcaggctccccctttccccaatcccttcaaggcgcacatgtactcccatttctttccgggnggttcccaatcactccaccatgggggtccattttggtccagtggcccagttggtgccagttgtgtgcacttccatggcagcacccattcacctgcaatgcagccaggtgcaacagcccatccacagcacatggggtgcacccacgtgcacccacacttgc

SEQ ID NO: 517162 - DNA, 392 bp, Homo sapiens
gatcctatcttgatcataccgtagctccagcatgtatagagcattaaatctcatggttccataatctgacttcatttccgctgtgccacatatatccaactctgaaacgcataaatttaatgcccgatacaggctgcaccggtgctgccacagggtattccatactgttccacttctccgttttctcatcaatccttctgagcggacagctgtgcagctggcagttggtctacagctttatcaggtctttcctcgaggagaccctctaggtgcaactttgcgggggttgccttgggtgattcctggatctcccctgttgattcggtgctctcctggggaccttacctgtacagcatgtctcttctcgaagacaaaggtctggcagaggtgtc

SEQ ID NO: 517163 - DNA, 249 bp, Homo sapiens
  misc_feature (173)..(173): n is a, c, g, or t
ccccaagtgaccaaactgtgttttttgcctcatttttttccttgaaaatgaagaatggcctgtgtcactcagcagtgggacagcaacctgtaaagtggccagcaagggggtgtttagctttatgttggatttcaagagccctgtcagtaaagaagaagttttttccagtttgntttgcccttttttttaccctggtggggaaagtacaacctgaaaaccctttgcctcaaataaaaaggggttttgtga

SEQ ID NO: 517164 - DNA, 489 bp, Homo sapiens
tatatctctcgtgcggaacacaggccaggtatgtaacaggtgtcaatttatatgtgtgacgaatgaatgaatggactactaacgttttggtgtttttttctacctctgtgttctcataggtaggttttttttttggacctaggtgatggcagcatacggcctcgtttaattcttacgtaacacttacctcaattctcatttaattctgcctaacttcaaaagagtttttaggtgacggtatgtttttctcatccattctttcagtagaaatagcacttatttccttaaaaagggtctaaaagcatcaggcaggggcagatatatacaaattttatgtattggaaatcggtgtgggcctacatcagggaaggtaagtaacataccagagttggtggtcagcatcggcagatacggaaatagtacagggtataccagctttttgggaaaaacagcggtgtcattttatccatctttaaggctggtccttca

SEQ ID NO: 517165 - DNA, 1069 bp, Homo sapiens
gcctgcagagggagatgtggcccttcctccccctcattgaggacttaataaattggattgatggcttctgctcctccactggtacctcagactcataaatattcacataaaggcacacaacacaaaaccataacaaccctattgtaaagaaaaaatacactaaagaagattaggaaaaacgaagaaaacaggccataaaaacaacaccacaacgaccacgtcaaacaaaatcataaacaccaaactaccacccatcaaagaccaccacatcaactaaataacactaccaataatacaacaagaacaaacatcactacccatcataaaatacataacctcaaatcctacccctcttacacacagaaatcaaaaacctacacacataacataaaaaaatcataaaaacacacaccacacatcaacaactaactaaccacacaaacacacaaaacacaccatacctacgacagggaggccaagacgacacgagagacatcagaacacccaagagactgaacccgaccaagcaataacgagagtcggcaaaacaagaggacactgagcaacacccagaaccaagagagccgctacggccacacggaaccaggaaagctcgcacacgcaaggcgtaggcgcgaacgataggacgacgacgacagacacgaccagaaccagcacgcagagaggagaactaggatgaccgaacgacagagacagagcatacgcacgaccgacacgagagacactagcaacacaacaacatcagcataacgatacagcaacatcaaacatgcatacagaaactaatcaactctatatcacaaaacatatataacacataaacaaataaataaaaatcaaaaaacccaaaaatctaataaattatcataaatagttacaaaacagacaaaataatcacatcccaaccaataataatacaataaaagatatacacaataataataataataaatcattatatgtaatattctactacactattaaaaccctatttaaacatcaatataaacaataaaatattcaatcaacaacagtacaataaaactaa

SEQ ID NO: 517166 - DNA, 1495 bp, Homo sapiens
  misc_feature (348)..(348): n is a, c, g, or t
  misc_feature (1495)..(1495): n is a, c, g, or t
tggagggggtggtccttttaattgggaacccttaattctctggtccacaaaaaaattattttcttacaatccagagggtcctcttgtgtgccgccctacacaaaaaaagtgaagctctttgtggggtttaaggggcacaaggaagaagaagaacagttaacagagaggaaccaaagaacccctccaccgaatgaaagtgtcttcttacagcccagtctttatccagctttgtgtgccacacagattttcttatcaaagtgggtctcccacccatatatatataaagggcgctgtgtgtctctgtgagagaaatgtggtctcatatattctcaccctgtgcacaaaaanatctctgtggtgtgaaatatctctctttgtgatgtggctctctctctattcaggggtgttcccccacgtctatctccccacatatatattgaccgcgtgtgagaaaagatctctctacaaagacaaccgctgtgagaatgtgggctgtgagaaaacacaagaaaacgcgcgcgtgtatatattattccgcgtgtgcacacgcgggagaaacaccggtggccacacacctgtgtggttctttctctctctccacagaaaatgttttctcactctcacataatatccccacagagagtattgtgtggcaatagtagatatatctctcccgtggagagagagaagacttctgtagtataaatctctcttgtgacagaagagaatctctatatcgtgtaggcacccccaccaccacggagggcggaccacacacactcttcgtggaataaaatgttgtctctcacgctgtggcccacaccaccacagtgtgtgtggggggagattctcccagagtagagtactcccagaacagagagggtgtgagagcgtctcattaaagaaaggagagtctcccacacagggtgtgtgagaataataagactgtgcccccacaagatgtctacgacaccacaatatgtgagcgccacccgcgcgatcaaaacagaggatatacaccaagtgttgtggataatatggaaccattctcaccaaaagatgtgtggggcgccacaacagcgttatataattataaaccacgagggggctgcagccagggggcgtcctcccagttcctacaaaaagatatctactaacatccgagcgagtaggggacccacacaattatagataaaatacatccgctcgttggtattccccacgaaaaaggtgatagcacataaaaaaatccccccatctttcactgttggagcagacaaggcaggcggaaccaaacattcaacctattacaccggatggaacattatatataccccccagtttattttcctagttattgagccaccacaggacgtatcaaggcagctctatgtaataataccccccaccacaacgtacaaaaaaagaggggggataatcttgtagggaccccaataattataattgggtgcagacaaccacccttctttgtgan

SEQ ID NO: 517167 - DNA, 267 bp, Homo sapiens
aaaacgggggggtcccgggccccccctttttccccccaccaaaaagttttcccccccccgggggggggggggggggggcccttggggaaaagggggccctcttttttctcccttcttttttttttaaaaaaaaaatgttcccggggggtttttttttttttcgggggggctttgggaaatttttgggggtttttttttttttttccccccccaaaaagggggggggtttttttcccccgggggatttaagggttcccccagggggga

SEQ ID NO: 517168 - DNA, 272 bp, Homo sapiens
gtcgttaagactcaccattgcgttggaattaacttttcagaatcaggtctatctaccggggcctgttgccagatgataggatcgacaccagctggctgaatcatgaaaagctggtagaactgtgctggagaaagtactgttctaggcatattaagagttacaccaagttgctgccatggtgaatgtatattggcttgaccaaaatgagcatatagcggtggcgctgtaactcttctagaagcaccatttggtgaacgctcatcaacataaag

SEQ ID NO: 517169 - DNA, 470 bp, Homo sapiens
tactcaaaggaagatagtaagagaggacgaaggaacaaagagtctataaaacaaccaaatggcagtagtaagttcttacctatcaataataaccttgaaagtaaagggtttaaattctccaatcaaaagacatagagtgcgtgaatgggttaaaaaaaaaaaaccgatctcaatagtatgctgtctacaagagactcaccccacctgcaaggacatgcctagactgaaagtgaagggatggaaaaagatactccatgctaatggaaatctaaagagtggcaggagtagctatacttatgtcagataaaatagactttaagttcaaaacttttaatggagacaacaaacatcattttataatgataaagggatcaattcatcaagaggtcttaacaattataaatatttatgcacccagcattggaatgcctaaatatataaagcaaatattaatggatctgaatggacag

SEQ ID NO: 517170 - DNA, 123 bp, Homo sapiens
ctacacgcatggtgatcggttggtttgcaattacataatagtatatcgggggtaggtatctatcttagaaagtccctagtcacctaattatatgttattaggctgcttgtgatcgccatgggg

SEQ ID NO: 517171 - DNA, 404 bp, Homo sapiens
  misc_feature (364)..(364): n is a, c, g, or t
  misc_feature (391)..(391): n is a, c, g, or t
  misc_feature (403)..(403): n is a, c, g, or t
tggcccacccatttcgtccaagagcctttgaagaaaggctctttactagggaatggtgtcagaatccaacatctgagttctaagtcctaataatgttttaaggatagattcttaggattataatttttttttttttttggtcacagtatagttttggagattctttatatgtatcaccaaactgcttcctggaaatgtactgatttattctcctacctgcagtgcataagaacgcacttctctttccatgctcactaacattacctttttcctaacttttcaggtagaaaagtatataataatttttgtttcctaggatgatgatgatgatgatgatgattattattatttgaggacaggagtntccctctgtcgcccgggctgggagtgncagtggggctgng

SEQ ID NO: 517172 - DNA, 1380 bp, Homo sapiens
  misc_feature (264)..(264): n is a, c, g, or t
caaaaaaaaaaaaaaaaaaaaaaaaaaaaaaaattcctaaaaaacaaaacaacaaaaaaaaaacatttttttttccaaaaaatttttcttatagggaccggattattgggataattattgtggcccattcttaattacattatttgtgggggccatttctccttatacattgtgtctcttggaaccaaggattataacaaggtgtctctgtgggcccaaatatttgtgtgatattttatattgtgtggggagacacttctcttnttctccacagagagtatagagtgtgtgtgcccacagagaggagagagtctcttagaggagacatttgagcagagtgtgtgctcccccaattcacactgtgggtttgggagaagtgtggtgccaatttctcttaaaagagagacattttggagattctcccgtgggaaaatgtgcaccaattcttattttttacacccttgtggggggggggagaaagagagagtttttgaggaccccccaagagctcttcccacttcctgagagacacctgtgtgcgaaacattatactctctttatattgtggccactgtgtgtgttggagccccccatttaaaacggcatatgtattgtcttaagaaaacaggtggcgccattttacccggagaaaacaaattttaacacacacaattcctggggggatatacatatgcgtgtgcccgaaaacaaaatacagtgtgcacatctaccagagggtgtctacaccccctttaacaacttttctatcatctgtgtggcaacactggtgtctcccaatggggcacccacacacctttacaacagaaattcttccttttatgagggaggacttataacacaccaaaaaaaacaaaacacaaaacaacacaaaaaaagcaaaaaaaaaacaaaacaaaacaacaaaacacaacaccaaccagaccacaccaaacacaaacacaacaaaacaaacacagcaaaagccgaaaaacgaccaaccacacagccagcagcaccacgaaacagacgcacagcaatacacaaacacaaaagcaccgaacagctataaacatattctctcaacacaacctcatacagacacctataaaaaaaaagaaaataaaccaagataatgatcaactcataaccacaaaaataccacattaacaccaatatagtaaacaattaaaaactatcaactataacattatccagtcattatcctcacgaacaccacaatcgctttctaataatataattcaatacacactatacatcccgctctgagcaacgcccaacacatcctaatcatcggccacaaatgactaacaatccactcttcaattttttactatgacattatatcagcctagcactttt

SEQ ID NO: 517173 - DNA, 919 bp, Homo sapiens
  misc_feature (602)..(602): n is a, c, g, or t
gaagctggatggagctgcacagctggatgtgcaatcactgagtgctccaagcagcgctggtgtttcggccgagcaccatccactcacagcttagccaagtgacatcaactgagaacaaactggatcgacaggtgagatatcggtgctactccaagtgactgaatgagtcctgtggaaaggcctccgttcgactacatcctggactggcgtccgccgattggtggtaccgcggcttgccgttcggcgcgcgtgggaggcgtggagcgacatgctggactccatggctgggagatggtaggcatcggcggggccacgcccccgaagcgtggcgcggcgagtctcgccgagcggcatgaacgtactggttgcacccgctcggtgcgcgtgctgacttctgttaccggctcgggtggtgaatcgccagagatcgccttaacagcgaaatgggttggccacgtgccctggacgtggcgaggagcataggctaacaagccggggtggtagcgaccacggatgttcggccgtattctggtcccacgtcgttccaaggtgatagagggacgcaataccatactggggatgatcgctccggatacctacgnagcacaattacgtacgcgagagacactatggcaaagggcttgagaagtgtcctaacgtacgtatcggttccaggtgaggtgaccttgccctcctagggggaatgtttcgcgttcaagcaacgacgggagggcaagccacgcaggtggagcacgaatcacgccctcgcgcccggggataacgaggcgcactttttaagtgcctccctagagaggcagtgttgattggcgtgagtcggaagttcaccgctcccgaagagtgaagcattggactagaaaacggccgatggagaatttcgaccagtttgggagccgggatg

SEQ ID NO: 517174 - DNA, 428 bp, Homo sapiens
  misc_feature (253)..(253): n is a, c, g, or t
acagcccggaatatcaagattcatctttttcactaattgtggcattcacatgtctgcacactggaaattcttcctggttgtgagacaagacctcagacttatctgagctaaggggaagaaagactgcaacagtgttgggcctgtgggtacacagaagtcaagaattgaagattggaaacctccacctagatttcagaggacatatggaaatgcctggatatctaggcagaagtctgctacaggggcagactcnactggagaacctctactagggcagtgtggaaagaaaaggtggggttggagactccacacagagtccccactggcacactgcctagtggagctgtgagaacagggccaccattctccagacctcagaatggtagatcaaatgacaacttgcaccatgcaccaggaaaagccacaag

SEQ ID NO: 517175 - DNA, 564 bp, Homo sapiens
tgtttaataatgtgccccttttgggcagacaaattgccagaaagcatttactcccttggcctcagtagtccaggccatggtacaatcagcccagatggcccaggtgttgggaggatcttctcaaggtcttcagcatcatttttagttgcacagctttctccttcattctcccaaactgaataatgaaatttacctatatttctaccatctatctagctatccatctatccatctattatctatccatctatctttctattcatccatccaactatccatccatccatctattatctgtccatctatcatctttctatgcatctatccatccattatctatctatccatctacctatcatctatccatccatccatccaactatctgtctatccatccattatctatccatctatcatctttctatccatccatccatctatccattcatccatctattatctatccatgtatcatttttctatccatccatccattcattatctatccatctatcatctttctatccattcatccatccatctatccacccattatcatctatt

SEQ ID NO: 517176 - DNA, 657 bp, Homo sapiens
  misc_feature (101)..(101): n is a, c, g, or t
gatctcttatgatagtcgcattagcggacgctccaaagcagcttcgttgtgaggcccggcctggatctaggaagaacctcagatttcttcaggtactcaancgatcgctaatgtgcattgaattgcttgcagagtgcgacctcatagcaagggctataattctccttaagtgaacttacactaagagtttgccggaccatggtcgtgctccataatcagcataggggagatcactccgggcgaccaaacaggacatcgttgggtcataccatataagatatgcaggtgcttgaccgacgtatgaacgtagttccccgtatgaggcttactcttagcgcggttaaacctacagctgatgaaagtgaaccccgagtactagtgtcaatgagggggacgtgcaagtaagcacacggtggcttacaaggcaacgtaggaacatattcttcacccccctccacgggggaatctcgaggacagttccttgtcaggttactcccaacatgggtgcgtatgctcctccctctagctcttaggctgagttcgctcggcggtagaaagatcccatttcgaggtggccaaagctttcgcccttggagttgcgttgccctggcaaagtcgatgcctggtaggacctattgcgatggccctttactcgtg

SEQ ID NO: 517177 - DNA, 164 bp, Homo sapiens
tgacagcactcccaaagcacgagacttcgtggcagagctgagagcagtgggagctggctgggatggtgaagtcctgggcaagaagctggaggaaaggggtttgacaaggcctatgttgtccttggccagtttctgtgctacagaaagatgaagacctcttccgg

SEQ ID NO: 517178 - DNA, 321 bp, Homo sapiens
taacgaaagcttatagtgcagacatatttctccaatcttcttttttggggatataaaagcctgtgatgccactggttctgggaaccaagttgagggaggtgactgtcattctgtgtgttggatcttagataatcctccagctttccacatggtccctaacaagagtcttcagcagtgtcttgagtttgaagtctctgtggtataacctctttaaaactttccttcagacttcccacctagggctggtgggagtatgcttttggctgttaaggaactggagagtctaatgatttctgaccccactttaagccctcacctgta

SEQ ID NO: 517179 - DNA, 101 bp, Homo sapiens
tcaggcagtccggaaaaacatcttcagtgctccggtgacaacgtgtatgtcctcccaactggctgtcgtccaaattcagcttctcttcttggttgacaata

SEQ ID NO: 517180 - DNA, 222 bp, Homo sapiens
agaagactgaatgcgcatcaggaacgagtcgtgccggtacatgtggtgcgccgacagcacgtgttggcgtacaggtctttgcggatgtccacgtcacacttcatgataggagttgaaggtggtctcgcggatcgcgcaagattccatacccaggaaggaaggctggaacagcgcctccggacaccggaaccgctcattgccaatggtgatgacctggccatc

SEQ ID NO: 517181 - DNA, 1041 bp, Homo sapiens
  misc_feature (38)..(38): n is a, c, g, or t
  misc_feature (78)..(78): n is a, c, g, or t
  misc_feature (80)..(80): n is a, c, g, or t
  misc_feature (131)..(131): n is a, c, g, or t
  misc_feature (153)..(153): n is a, c, g, or t
  misc_feature (184)..(184): n is a, c, g, or t
  misc_feature (524)..(524): n is a, c, g, or t
  misc_feature (528)..(528): n is a, c, g, or t
  misc_feature (785)..(785): n is a, c, g, or t
  misc_feature (975)..(975): n is a, c, g, or t
  misc_feature (1038)..(1038): n is a, c, g, or t
ccccccccccccccccccccccccctcccccctcctgnccccgccctgcgcccctttccctctgtcctgccggctgcncngcccggctcctccccggccccctgcgctcctggttgtcgccgccctgtccngccgcggcgctgcctgcctgcntttttctcctcttgttgcggcgccggttgtncgcggtcttccgcgtccttgctcttcccctggtcgtcgtctccccgcctcgtggccccggccctggtcctctcctccttgccttcgtccccgtggtctttgtcctcctgccgccctcgggccgtgtggcgtggggtctgtggccctcccctcgcttggttgctcccggggtggttcctgccctgcgtgctggtccgcctctctgtggggtctgtcttcccccggcggcggctccgctgcttggcctcctccgcgccttctgccccctccggcttggggccgccgtcctggccccggcgcctcctcctcttcctccccggggcgctggcctggcccgtgtnggcntcgccgggtgggccgcccccccggcggctgtccctgctgcccccccgggcccccctgtcccctgccttgtcctccttctctggcccccggccctccggggccccctcctcgggcgtctcgccgggtgtctgccgggccttttgggtggtctccttcgccccgcccccctcggtgcgcttccgccctgcgtctttctccttcgctgtgtcgcgtcggttttccggcttgccctctcggtgggccctgttctggctgtnccgcccctggctggccgtgcccctctcccgccttctctctgccgcttctctctccgtgcccgcctggtcgccccgctcctgcctcctgctgcccccctcccccccttccctgccttccctgctgctgcggcgccgcgcttgccctggtgcctgttctcctccccctcccggctgccgcccctctgggggncgcccgccgcctgcccgttctggtctccctcctgccgggccttggggctgtcctcccggcgcntcc

SEQ ID NO: 517182 - DNA, 177 bp, Homo sapiens
ctgggacggtatggaggaggctccgggtggggctggtgaaaggcaggacgtgggtggggtgtggggagcacgggggctgctggctgagaggagcagccactcctgccagtgcgcagtttgtaccagttagttaccagcagtcctgatgtgacggcatgatcttttgcaggctctggg

SEQ ID NO: 517183 - DNA, 884 bp, Homo sapiens
cagaactacggtgagcgggaatcccgttctgcttccagaatgtggatagtgctcacggatcggggaaatctgcaaggcatacccctgtcgaatggtctcgctccaaggaagattccaggcgttccagattcaaagtccaggctcccgagtctgaatctaggtctagatccagagagaagctcccgaaggcattatacccggtcgacggtcttcgctcccgctcccatagacgatcatcgtagcaaggtcttacagtcgagattatcgtagacggcacagccacagccattgctcccatgtctactcgtcaggcgtcactgtgggaagtctgggcaaatcctgatcctaactgttgtcttggagtactttgggctgatgcttgtacgaccacagaaccagagatctaacgcagaatgtgttctctaatatatggtcccagttgccgactgtgtctacttgtactatgaccagcagtctaggcgttcaagtaggatttgcctttgtatactttcgaaactgtagatgatgccaaggaagctaaagaacgtgccaatggaatggcagcttgcatgggcgtaggatccagagtccgagctctctataacgacaaagaccacatacgccaacaccaggaatttacatggggagacctacctatggcagctctcgccgtcgggattactatgacctgaggatatgatcggggctatgatgatccgggactactatagcagatcgtacccaggaggaggtggacgaggaggaaagctggaaagctggccaagaacagggatcggactgatagaaggccgtcaccttctccttactattcgtcccgggacggatacagatcacgttcccagcatctccgatcatagtcaacg

SEQ ID NO: 517184 - DNA, 87 bp, Homo sapiens
gaagatcgccattactatggttcggggagttttgggccgtacttctttgactactggggccagggaaccctggtcaccgtctcctca

SEQ ID NO: 517185 - DNA, 623 bp, Homo sapiens
ggaatcaccagttcagtatgctgcgtatgtcaacctctgggaggcatcacctctgtttattaagctgatgttatgcaggacttgttctttttcgttctcttgtgaggtttggaattggaacggcaacttcgtcataataattcccattggttcttctccatttggctatttgttcaaaatcaaggcccaactactttatacagattgatgctgcctcatttcatcgctgacattctgttggtcaatggatacagccataggcactgggtacaggatatagaacaataccacaatatcaaaagtttgtactcagagtgaaacggaccagatggctggtctattgtggcttaccctccatagctatggttcaggcaagccatgactcgttctaagctgatgcttctcatctgcctaatggcgggcggggtcttcacacctggagcagcttgttgccaaaacaaaggtagattgacagactcaacaaacatcggtattgagtttagtgttattagcagctctgaagtctaaacactggaagaattaactgaagtcataacggtgcgctgaattaacagcttctctatttgatagctggcaattcttctgtaagcctgtccgtagtt

SEQ ID NO: 517186 - DNA, 432 bp, Homo sapiens
  misc_feature (1)..(1): n is a, c, g, or t
  misc_feature (29)..(29): n is a, c, g, or t
  misc_feature (63)..(63): n is a, c, g, or t
  misc_feature (88)..(88): n is a, c, g, or t
  misc_feature (109)..(109): n is a, c, g, or t
  misc_feature (146)..(146): n is a, c, g, or t
  misc_feature (197)..(197): n is a, c, g, or t
  misc_feature (201)..(201): n is a, c, g, or t
  misc_feature (213)..(213): n is a, c, g, or t
  misc_feature (353)..(353): n is a, c, g, or t
nttctattcaccatggcttcttctgatanccaggtgaaagaactggagaagcgtgccatcagncaaggcttttgagcatgattctcancctcggtcaaaagaatctgtncagaattcccctttccctccaaagaagaaggatcttncctggaggaaattcagaagaaattagaagcctgcagaagaaagacacaagnccantgaagctgaggncttgaagcagctggctgagaaactgagagcaccgagaaagaagtgctttcagaaggcaatagaagagaacaacaacttcagtaaaatggcagaagagaaacttgacccacaaaatggaagctaataaagagacctgagangcacaaatggctgccaaactggaaccgtttgcgagagaaggataagcacattgaagaagtgcggaagaccaaagaatcc

SEQ ID NO: 517187 - DNA, 1107 bp, Homo sapiens
  misc_feature (1)..(1): n is a, c, g, or t
nggtctaataataaaccaacaccgccccgcctcctttctatatgacaccccgctacacgacgcccccctagcggcagactccctccccccacacccccctgcttttgttgacccccccccacaagaaagatcaacctccatcgcgggcgggccgcactttaccgccctcccccccggcacattcttctacccaccacatacacccccccgcgcggcccgacgacaatacaaacaccactcatactccaacccacgggtcacacccctgtccgctcgcccactcacggccccccacctgtcttgatggtcgaccaacacacttccacagaaacacacacactcttggctcacacacatacaagacaccgctctgtgatctcaccaccgcctcccgcaatttctccccggcacatatccacagcatctgcgagagggggcgccacactctctggagtagggcgacacaacaccgtctctcaacataaaatctccccccccctctctccctagagtgagatactccaccccatagtcacccccccccactcattggctccgccacctctctaatgagtgaacacacacaagcacacacacactctcctctctcttcctggtgaacaccccggctccaaccacgacgagaggcacactacaatcccttgtggttccgccaccacaccacatccgcccccccccccaagaccgacctcaactctctcttgggggacgtcccccaccacaacaaaagttgtttgctccccacgcgctgcgacccacattcatttttttcccccaccccacccgcggggcgtcacacacactccacccccagcatgtgtcccacacctcgcggggcggttgtggccacacacaccttcttttctagaggtgtagtatccttacatagcgacctcctgcccacctctgtaacatcacttctctcctccacgagtgttgcccacctaacgcgggcgccaccccgtcgatattagagttcctccataataaaagattggtccggcgttgttttcccctttttttccacggggttttttttaaaaaagagttttttttttccaaaaaaaaaaaaagttttttttggga

SEQ ID NO: 517188 - DNA, 115 bp, Homo sapiens
atgctgtgatcattgatcaggaactgtccaggtttattgctgccggagactacactgcaaaatagataagtgaatgaaatagtagaaaccaacccgggttctgtcatgaacaaac

SEQ ID NO: 517189 - DNA, 1218 bp, Homo sapiens
gacgcggctcattctacactcagcggcggatacactgtgtccgccagaaagacgtccagactgcgagaggtagcctgagggagcagaaggactaaggaggctcttagagaagagtacccagtgctcctgatcggagacgggtgtatgagcctgggctcggcatatcgaggagccagcaagcaggcgcagccgcagaggcagaccagcaggcggcatgcatgttggagctgcagtgcgtgtgagctagcgagcgctcgaggagcagggtacaccggtgcaggtcgaacgggacgagatggaacagacagctgtgcagcccgggcagaaacccggtgatggccgccagctgggtaaagtcgagggagtcacagcgtgtactgggagcagtgacaccggttcgtggcccgtaaaaagttgaagcgcaagggaaggccgaccctgtcggggaagccaccaggaagtaaggggagaacacacgcgaaagtagtgccggccagggggagcacgtcccatccgggccaggggaaatgctaacccgtaacagtagggcttgccccagtcgtccggtcacctgccaagcagaaccctgagcaagagcccaacgctggcctgtaaggcgcagtgttcaccgaagccattagcaccttggacccccattgtggcagacgccagtcgctgtgggccaggagtcaccctcgcgttgagtacccacctcagttcgcactctgagttatgaccttagggagaggaagtcgatagccggcgcgaaaaggcaaggcgcatcaagagggggactttcgcccaagaggataacggaacgggcactttgaatactgcctaagagcgagaaagaggggcgtgaccatttagactcttgggaaacggcaccgataagccctttgagtgagtacaacgaacaagggggcacatatagttatcgccgcaccgcaaatgaaacccgttgggagtaccccgtaaattcagagacgggacacgggtcgcgccgttcgtacaggattcccacattctccataggaaacgccttctcggaaagaaatactgcgagttactcaggcagcgtggtccaacacaacatggtgcaacataccactccggttttccccgttaacagttttatcgcccaacagattacccgaactacgacccaacgtcatatggtatgacctatttccctgtgagccccacattctccctagg

SEQ ID NO: 517190 - DNA, 228 bp, Homo sapiens
agatgtgcattgcactccagcgtatggcacaaagtaaaacgccgtctcataataaaaaaattccaccttcagatttgacctgtggtaattctgtccagactgccgtaacagaagaccataaatggggtggcttcacatttttacacaacacatttttttctctcatagtatctggaggcgggaaagtccattatccggttacgggccaacgtgttaccgctagctgtg

SEQ ID NO: 517191 - DNA, 219 bp, Homo sapiens
ggctcaacagctggaggtttagtccacttaattatagcactggaaggactcatcgtcgcattgattgagaagacacgtgcggaggagggcttctgtcaccgagcagatatctgagttggcacgaggacgcgacgatcttcaaagtaacccttcttctgatggccaacagtccgtggaatgcgtatgctggcgctgcgatatggtacaccagcagaaagt

SEQ ID NO: 517192 - DNA, 666 bp, Homo sapiens
  misc_feature (666)..(666): n is a, c, g, or t
gaggagaagatggcgaccgtgtgggatgaggccgagcaagatggaatggggaggaggtgctcaagatgtccacggaggagatcatccagcgcacacggctgctggacagctgaagatcaagatcatgaaagagtggagtgttgagagtcacccatgagctccaagccatgaaggacaacgatacaacagagaacagtgagacaaatcaaagtgaaacaagaacctgccgtaccttgtctccaaacgtcatcgagctcctggatgttgatcctaatgaccaagaggaggatggtgccaatattggactggatcccagaggaagggcaaggtgtgctgtgatcaaaactctaaggacagaggtacttccttcctgtgatgggttggtggatgctgaaaaagctaaagccaggagacctggtgggtgtgaaccaaagaattcctatctgatcctggagactgctgccacagagtatgactcgcggggtgaaggccattggaggtagacgaagagggcccacggaggacaatacagtgacatttggcgggttggcacaaggcagcatccagggagctgttggaaggccattgtcttgccaatgaacacaaggagaagtttgagaacttgggatcaaacctcaaaaggggtgctgtggaatgggccccagn

SEQ ID NO: 517193 - DNA, 2053 bp, Homo sapiens
gcaaacccagctccaccttactaccagaacaagcttagccaaaccatttacccaaataaagtgataggcgatagaaattgagagatcctggcgcaatagatatagtaccgcgaagggaaagatgaaacagattatagccaatgcataattatatgcaaggactaagccccttttacccttcgtgcagtaatgaagttgaacatagaaataacgtttgcaacggagagccaaagctaagacccccgaaaccagacgagcgtacctaagaacagctaaaagagcacacccgtctatgtagcaaacatagatgggaagatttataggtagaggcgacttaaactaccgagcctggtgatagctggtatgtccaagatagactctctagtacaactttaaatgtgcccacagaaccctctaaatccccttctcaattgcactgttagtccaaacaggaacagctcttgggacactaggaaaaaaccttgtagagagagtcaacaaaattaacaccatagtaggactaaaagcagacaccacattaagaaagcgtcaagctcaacaccactactaaaaatcccacacatcctaactgaactctcaccacccaatggaccaatctgtcaacctatagaagactaatgtcagatacgtaacatgaaacatctcctccgcataagcctgcggcgatcaacactgcactgccataaacggccattctcacgaacacaacagtattattagctacggtccccacttgtgctcttggttgtcccacgaacgctcggaactccgggtgcacgatagttcccctaggcggcgacttgagcaaggaagagaacactaaggcagagggctattaagtgggcgaactacacatcgtacacagaaaagtaacagaagcaccagacgagcgcagatcgagaggacagtactgctagcacaccgcgcagcgcaccaacaacagtagcaacaactcacacgcaacgagacgactcaacaatcagcaacaagcacgctacccagaacgctaggacacacagcacctaaacctacaacggtacagcacgcagcaaaacaacactaaggatagacaaacacctgcaagcacaacgaggcaagcagcagacaagcaacgaccgcgacgaaagcgcgcagacggacacgcgcacagagagcacgaaacgagaacggaaccagagacgaggaaagaggaagagggagaagccgacagggaacagaaggagagcacagagacgcaagcgccgcaggacggagaagagcgggaaaggaaacgcagagacacaaggcagagagcgagtagaagaacaagagaaagcacgacgccacgagaggcagaaaagacgagagaggcaggacggagcgaggcaacagacgacgagatcggaaacaggaagaggaagcagacacgaacgcagctgaccacacgcgccacagagcgacccgcaggaagggcaaggagcgcgcagcaaagaggacggcaaccgcggagcaagcacagcgaagcagcagcgacagaacaggcgagtagccacagaagagacaggaggcgagactgtaccagacagaactacagagcgacgcgacgcgagcagagaagagtccagcaccaagagagagaagccagcagcgagaagagcgtagcgagataagcgacacgcgagacgagcagaacgaaggcgagccacgcacaagaacggcgatagagacacaacacagaaagcagaggggagagacgaacgaagagcaagagagcgagcgcacagacgacgacgcaagagagcgagagaaggatcgacgaggatcgaggagacgcggaggaagaaacgaagggcgcgcgcagcacgagcagagactgaggccagaacggaccaacacggacagagacggacgaaagaagcagtgcagcgacgagacgatgcagccagacgcgccgagtgagatgagagagcggcggagaggacgcgagcgagggatagacactcgccgagagaacgagagcgacgcgcagaggcgaagcgagcggatagcggag

SEQ ID NO: 517194 - DNA, 1666 bp, Homo sapiens
  misc_feature (39)..(39): n is a, c, g, or t
  misc_feature (92)..(92): n is a, c, g, or t
  misc_feature (124)..(124): n is a, c, g, or t
  misc_feature (144)..(144): n is a, c, g, or t
gttgggcttgagctgtatcagtctgtcctttctatctgnttcagctcgagctgcgttgttgatctgatgtctccgctgctgtggcgcgcggngtgcgtgtcgcgtactcgagggttgtgtgtgntctttcgactcgtgctgagntagtctcgctgtcggtgcttgtcatctgcatgtcgttggcggcgatcagtgctggtgattggctggagcgagctgcactcgatcagaccgagttcggtggtcgtcagctcgtttggtcatgaattgaatagtgtgttcgctgcgtcgctgcctatggtctgttttgactgtgtcctgcggagtttctgttttgtggtatctcacgtccggtgtgtgtgggagccctgcagtttgtgcttcgggtgcgtactgtctcttgcgtggccgtggcggttcgacctttctctgttccgctcctgctcgtcttgactacacttgcttacgcggcgtgatcactgatggggactgccacccacgttgtttattttttcttccctctgtcataagtagagtgggttggtctccctccgacttgttttgtgttagtatcgtgtgttggtcgccgcgtgtgggggacctcgtcttctgcgtttttgttccgcgtcatgtcctttgtatgtttccttctttgggagttgttttttcgcgttcggcgctttgtgtgtgattcctcgtccatggggggcttgttgggggggcgccaaataggcgtgtttggtggggggttcctttcctcctcgccgctgtgggggccacatgtccacgggggttccttttttgggaggcgtcccgccccctttgtgccgagacacagctgttcccgccccggccttttatgttgcttgtgtgtaggggggctccccggggctcccttctacgcgcttcttgttgtgtagccacagggtctgtatgggtgtgtcttggggggagcagtgcgtctgccccctcgggatatataccgtttttgtgccccctcttcgggtggtgtccccacttgtccccccgcgcgttgtgtagatatggtggacagtgtttagcccccgcgtctaattccgcgggcgtccccacccaccctctttcgcccctcgcgggggttttttctcgcggagggaaaccctctttttccccgggcacacctccttgtgccctcacctgtttgcctctgtctttggatagttccctcggggtgtgaccccgtggagaggacctttccgcctctctcgcagtttgtctggagcttggattgtttccacagtttgggccacacgccccttctttccgaccccctgccaccctttgccccttcctaactcctgtccaccgcctctgaaagggtccaacgcacttttggggtgaagcttctgggtttataggggccccccccactccctcacggctataccccggagtttttgcccaccctctcttcctcacgaggccccccctgagaggggccgctatgccctcattttatgggctgtggaaaggagagcacgaactggtgttttaaactttttccctccctcctgcccaccaccaccactccaaaggattttccctaccaccccttttttgcccttatttttttgaatttggggccaccttggaactaggggtttttgggatataaggagaactggga

SEQ ID NO: 517195 - DNA, 268 bp, Homo sapiens
tctctgcctccagattcaagttattgtcctgcctcagcctccccagtaagctggggttacaagcatgtgctaccatgccttgctgatttttagtaggcttagtagagatggggtttcaccatgttggtcaggcttgtcttgaactcctgagctcaggtgatccacctgcctcagcctcctgaagtgctaggattacaggcgtgagccactacacttgggctccttgattcttcatgatccttttggtcttggtggtgggtgcctgtgc

SEQ ID NO: 517196 - DNA, 877 bp, Homo sapiens
gacttccggcggcgcgggaggcgccaggcgagccagagtggtggctgtcccggcgaaaaattctgagctgtacacctctagggacaagtgaaacactaagttcagaagaaggcctgtgtacaacctcttcttacaaaatacaatggtggttattccacccaagtgaggggtcacagccaaaagccccttaaaaaggcgggggacattatccttccggaagccttcaaaggcccaagggtggaaacgggccttatttgaagcaaagcatagggcggcagaataagcatggggccctggtgacaaggcgggcgcaacacaaagatgtgtgtgggggcaattggaacaataattatgccggaattgttggggacgcttacgaaagggctttgccaaggggtaaaaggaacgtctccaagggaaacaggaagcagcgcttgttgggaatttgagaccagaaatcgcccctataaattgacacggtgtggttcacccgtggacacagtggggttggacacaagaaggaaaggctttatcaccaaggttacgaacgaaggtttctcccaacagcggtttctatttatgttgttaaccgaaagggagatggcagcaaggaaaagagggaaatttccgccaaagttaacgcgtgtggtgaaacaagcaggggaagagaatatttcccccgacatattcacgacagtttggggtttggcccattgagacagtttagtgggatcgagggagcgaaagaagaagaacgggtatctcagctcgtttattaaccacaaagaaaggatttcgaataaagagttgcttaccagattttgaccacggacaatattgacgcgagacggtggggaattatcccacaagtgttagg

SEQ ID NO: 517197 - DNA, 238 bp, Homo sapiens
agagaccggttcgcaatgttagtagtcaagcatctccgtttagcaattatgaatggatgctatggacctttgccttgaaggaaaggaacacagttcattctcaacaatcaggaaaatacgggaggaaggttaagtcacaaaataaagttatacgatattatttttttttggaaatgagttctggcccatttgcccagctgggattacagagccttgatcttgtctcatggcagccgtc

SEQ ID NO: 517198 - DNA, 110 bp, Homo sapiens
gtttctatacatacatcctgtcagctacatacagtgacagttttgcctcttctcttcccatttgcatacattttatttcttttgtttgtctgattgccatgtgcttcatg

SEQ ID NO: 517199 - DNA, 433 bp, Homo sapiens
gatgctttcacctatactggctgtggagggaatgccaataactttgttagcagggaggattgccaacgtgcatgggccaaagctttgaaaaagaaaaagaagatgcccaagcttcgctttgccagtagaatccggaaaattcggaagaagccattttaaaccttcttaatatggcctcctgtttggcttaaagcgttatttgcccttaagggtggatctgaagaataatatggcagcctggggaaaccaatccttgggggtttattcccccggttttattaaaaccaggccctttttaaaaaatttgggtttttttatatataactagctgctattcaaatgggggtttcccctttttaatttatgggtcccctggttggggggctggattcttgcaatggataagatataaaagccaatatggctcccccca

SEQ ID NO: 517200 - DNA, 226 bp, Homo sapiens
tttattttttggctttatttctttttttttccgagacgaagtctcactttgtcccccaggctggaatgcagtggcgtgatgtcgactcactgcaacgattcaggtttttgacctgatgctgggtgctggccttgaaagccacgggtggcaactcattccgaaggtaatccagccttttttccacaacctccttggggaccaggtcaatcttgttcaagaccaggac

SEQ ID NO: 517201 - DNA, 365 bp, Homo sapiens
ttgacacttcagcctgggcgacagagtgagactccatctcaaaataaataaataaataaaaaattttattttacctttacttattcattctataatgctcttccttttttaaaaatgtagacccaagtctgacagatgttaatttctttatctctgaaaaatttattttaaaatttctttcaaagtaggtctgctggcaacaaattttcaatttttatgggtctttatttcacttttgaaagataatttcacaggatatagaattctaggtttggcgttcttttattttttttcctctcgactctactttattcctgcgtacatagtttccgaggataagtcagatataattcttatcttagctt

SEQ ID NO: 517202 - DNA, 149 bp, Homo sapiens
ttactccaggatgcgctccttgctcatgacgtgatcgattgtaggtcagcaccagttcctggcccttgcgcaggtagctgcgggaactggacaggaacaggttcttggccaattgttgcgtgatggtcgagccgccccgcatcttgctg

SEQ ID NO: 517203 - DNA, 147 bp, Homo sapiens
gcagattctatcgcgggttggcggctggctctgcgcgccctcgatgtgttgctgggtgtttacccgtctctggctattgtgggcgccaccgatgacatttatatttgcttccccagcaactgagctgctgtcagcacaaagtcttct

SEQ ID NO: 517204 - DNA, 290 bp, Homo sapiens
  misc_feature (156)..(157): n is a, c, g, or t
  misc_feature (186)..(187): n is a, c, g, or t
cggggcccaaaaaaaaaaaaattatttccagggggggggccccctttttaggggggggttttccccccttgtggggggggggggaggggggggggccccgggcccccccccccccttcttccttttgggggggggggtttttttggcccccgggcnngaaaaaggggggggggggtttttttttannacccccccccccccccccccccccccccttttgggggtttttttttttttttttgggccggggttttggttggggggttttaaagggtttttttgggggggga

SEQ ID NO: 517205 - DNA, 301 bp, Homo sapiens
aaggctgaggccgctaagaaatgattcttcgtcagcctccgtcttccccatgaagcatctgacgggcggcgcggcaacatctccttggtctgcccctggattcttacctgtaaccagagtaggggtaggaaacggtgtggtgggggtctcatgaagtcagagaaaaagctagagagagaagggagagccctcttatgaaatgcttcttccatttcagggatcgaaaggaggaggacgcaagtgccttggggtgcctggacaagatcagactagcatacgaacttctctgctggcaacggtt

SEQ ID NO: 517206 - DNA, 833 bp, Homo sapiens
ctttaaccttttggggtcagatgcacaccttcctcctcccccaatcctctcctcaggcagccctccccagacccaggcaaccgcatcacagacctccctgcctgggaccacctagtggcagcctcagcagtgtgccaggtgcccctcccccacagctgcctccaaagccgccagtagtccccagccctgtgcttcaaagcaccatcacgaagtgactggggactggcgggcaaggccactggctctgacactctgcacgtcccctggactggtggacgaggcttaacctttaccccagccctgaagcagggcctgagcactgacagtagcaaggctaggcattccacatgggacttgctatgcagggccattgcacaacacatccccactcatcgacgacacttggagagcaagccctcgcccacatctcataccaaattgacctcaaaccacacacagatacaacttacagaacaagtagcattagaacatgggtgagcgacgcagacgagaccaaaccgcatcacacacacacgaaaaccacccacagcaaacagaaacaccgcaaaacaagagcaacgagaacacacatgcgaaccaccaccaataactaaatacctcactcaagacacacagtaaccaaacaaataccgtgccacattaacacacaaaccatgaaacagaacactaacccacatcagaaaaataccctacaataataaaccaacacatccaaaccataaaaaaacacaaccatacaaactataaaacaaaactaccacaaaaacaaaacccaacacacattataaccacaaccaaaataccataaacac

SEQ ID NO: 517207 - DNA, 774 bp, Homo sapiens
agcggctgtgaaaccgtcatgtttctggggagtcacctcagctggcagttaccaccgtgttagaaagcagcctcaggaccggccacctccatcactgtgcgtcaccatgggggctgtgctgggtgtcttctccctcgccagctgggttccatgcctctgcagcggtgcctcatgtgtgctgtgtatgttgctgtcctaacagtaaagaaatttcccacgggtggactcgcgctcatttatgctttcattctcctcctgagcactgtgcgtatcctatatcatgcacgagaaaagagatggaaacttacttgaagaagattcctggattttgtgaacgggggatttaaaatccatgaggcgtgagtatataatgcgcgatataagattgtgatagtgcgtgggttgggtgtataaagctcgtgtatcgcgatcacgctttgcgcatggggcactctttttcttttgtgccttttctcctgctcactgttcacaagtataaaacacagtataaagatctcccgagcggccagtacacacatggggtgtttgggctcttccccaaatttgcgttgacccttatttggagatcaactggttggcatcctttcttacattccctgggggggcgtatattccagcatcagatcttggtttgttgtttggcactgaatagggggcccgcctccttcatccctcattcagctggtgctgctggtagaattttgctcattcttggaatgaatcatgggtaaatcgaatggagaaacgaaaccc

SEQ ID NO: 517208 - DNA, 1190 bp, Homo sapiens
  misc_feature (670)..(670): n is a, c, g, or t
gggcgtgatgtctcacagaacagttctccgactcccatgacatgtggtccctcgtgcttcctgacctcgtgaagctgcagcacgcatgtgcatctgtggtgacagtgtgaacgacgccttccactacaggcatgaccccactccaatgcctgtgatccaaccatcaccactgccctatccttggtgactaccacacggccttgggcatgaacatcaccactctgctgccgtggacatgctcgaccactgtgcctgcgggactaccaaactggattgacaccacaagcaacagtgcagcgttgggctcgggcatgtgcatagcttgcacgctcatattgcttcagccaagtcaaccaacccacgcccaaatagtgctagcggtttggttagtgcgcccactctctggtagcggtggcctaaacatggcttagagaacaaaatcccacacccacttcctggaactggagacaccataccccggagacacacgacaatttatcacaacatgggaaacccaattgccttccatacatcatagggcacattacggactcgcactagacacaacgtttcaacgaggtctccggaactataggcaacaccacactttcgccccagtacacccggtggaacaagcagaggagcccacgggacattcatgacacctccnattaaaagcttttcacagacgcctgccacacaacgtttggtcggagctggaccagcaatattaacagagatcacgtatgtcccgttcaacgcaccgcggccacacaccgaggcaaaaccacgctggatggccacccccatctacatacttcacaaccaccccgaaatcaaccttgggcgctatcccacccgctcttagtggtgcccaacgaccaggcgaccaacacacgacacgcgtatggggccgagtgccccaccacactggcgcggaaaacacacactggacagaccacgcgcacgcgcacgacctattgcgaggtgccaccagtacaacaccgcgcgaccaacaacggtgcccgcacaagctgacgcccccacttgcggcgcagcatccggcgcaatacactcggtccagagcaaacgccatgtaacatgcgacaccaactacccgcacacaagacgacacgacaacatcgcacaccacagcacaggtacacccacacgtgcccatatcacacacg

SEQ ID NO: 517209 - DNA, 110 bp, Homo sapiens
  misc_feature (4)..(4): n is a, c, g, or t
atcnactgagccaagagtgcgcctttgcactccagcctgcgcgtgggtccccgcccatagagctagcctactggaggttctagggaaatagggccgcagatcgcatgaag

SEQ ID NO: 517210 - DNA, 931 bp, Homo sapiens
gcgagtgatcttaatgatgccggaagggtctgggttgaaaggttctccgaaccctgtgtggccaaccggctttggctacgccggtttgcggcggccctctggggtgttgcccgtggggggcctcgcacagtctctctgcgcacgctcggttggtctccacagtgtatcgggtgcaccggggaaaacaattgtttaaagcccgctcccagcgtttggttcaatgccgtccccccagaggttcgcactgcgtaactagggaccctgggattgttgagacgccagttggtgggacttctgggaacctgtgggtctcacgacaaatacagcgcccctggcaggtccatataccgcagcgcgccgagggccctcacatggcgggaacctcctcctgaccccaacgagcgcgagaaacgcccaacctcggtcgtgccccgcaattccccaggggatttaccgcaaatctcaggggagggcccccccgtaagcataaaatagggtcacccacccagccgatgggtcggggaaccccgtcgtaccacctgctccagaggacaatgtgaggacaatctgcaacgcaccatggcgggaccccaggcacttcaccaccccgctgagggagctgccaggcgccagcccgggccgcacataatgaggaatggctcgctaaaaggcgaaggagctgtgggcacttacacatggtaatcggtacccaataaaccaaaaaaatattgctcggcgcccctacgataaaaagtaagaactgtgatactcgatacctgatacaatctatgttgggcagatagatgctgtttcttgggtgtctagggttcgacgacaaaaaagcgagttgtcacgcgggtgtggtgttgcacggtgatgccctcccctggacaagcttaaaactttgcttttttggacccaaccacaaaac

SEQ ID NO: 517211 - DNA, 492 bp, Homo sapiens
tcttacaaagtagacccaaataaataaataaagcattaacattaggataaaaccgtgctgtgaaacaaatgacatcccaaagcaaatactcaaagtacgcacacacggaatgatccagacattaccatagtgtccttattatcacattcagcttataaaaataatgccaagtgcagagaaaagattacaggatgtaccatccactgggatgatgtagaatgggagagtttctaccagataccggatcatgtgacaaatatgtgagcaactttcctactgacatggagtccacgttggagctttttccagaaaaaaggataaacccagggaaggtctccacttcctagaagcagcaatcacacttcagagacatggaagagtctagcattacctatctcagatacatgcaactttcccagcagctccaaaaagtggtcctccaatcttctagcttgtgcaagtctctctccccagagtctccaaaggcatccc

SEQ ID NO: 517212 - DNA, 130 bp, Homo sapiens
gcttagaagtagtggtcatcggagctgtggtcgctactgtgatagtagtaggaggaagagctcaggtggaaaaggagggagctactctacaggctgcgtagcagcgacagtgcccagggctctgatgtgt

SEQ ID NO: 517213 - DNA, 108 bp, Homo sapiens
agttacacttagtctatttcatagcgcatgaagataaaccaacaaggtactataacagtgaactgaaacatgcaaaccaataagacactcagttaagagattcctatt

SEQ ID NO: 517214 - DNA, 464 bp, Homo sapiens
  misc_feature (251)..(252): n is a, c, g, or t
  misc_feature (296)..(297): n is a, c, g, or t
  misc_feature (310)..(311): n is a, c, g, or t
  misc_feature (316)..(316): n is a, c, g, or t
  misc_feature (322)..(322): n is a, c, g, or t
  misc_feature (377)..(377): n is a, c, g, or t
  misc_feature (415)..(415): n is a, c, g, or t
ctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccnnatcttgatgggccaagggctaaacactagcatgtgtcagtggcnntttggagcaggtnntaggnctgggngctcatcgagggttctcaggccagagagccactgcggtggtccagtgcccccacntgagagactagaggcagagcagctgggggcacttgtgnttccatggagcgctggatttaaaccagtgtctttggaggctttctgtga

SEQ ID NO: 517215 - DNA, 258 bp, Homo sapiens
  misc_feature (4)..(4): n is a, c, g, or t
gtanctgagtccacatcatcagctgaactcccatgtaaatatccccattagatagacagcgctggcacaaggaaataaacctgcacagacgcaacactggtttaaaagtgtgatcaaacacattgtttcttcaactactctagatatctacagagtaatatgtatagtatacaaggtggcaggcgaggccagaccagacttaagtatcctctgtggccataaagggagtcctcagttctctctctccctctctctctc

SEQ ID NO: 517216 - DNA, 284 bp, Homo sapiens
  misc_feature (12)..(12): n is a, c, g, or t
  misc_feature (81)..(81): n is a, c, g, or t
  misc_feature (90)..(90): n is a, c, g, or t
  misc_feature (102)..(102): n is a, c, g, or t
  misc_feature (113)..(113): n is a, c, g, or t
  misc_feature (120)..(120): n is a, c, g, or t
  misc_feature (123)..(125): n is a, c, g, or t
  misc_feature (129)..(129): n is a, c, g, or t
  misc_feature (136)..(136): n is a, c, g, or t
  misc_feature (139)..(139): n is a, c, g, or t
  misc_feature (141)..(141): n is a, c, g, or t
  misc_feature (149)..(149): n is a, c, g, or t
  misc_feature (160)..(160): n is a, c, g, or t
  misc_feature (209)..(209): n is a, c, g, or t
  misc_feature (251)..(251): n is a, c, g, or t
  misc_feature (266)..(267): n is a, c, g, or t
  misc_feature (284)..(284): n is a, c, g, or t
aaagcctaacanacctctaaggcacagactggtagcaggagaaaactatgtcctgtactccagatgctgggtaaggagcanctggatgtnctcagatggggntcatctgaganggtggangtnnnatanatggcanaananagtaagcnacttccaaacntccctccaaaaaatctgaaaggagttactatgctaatgcgctgggcatnaatccaattcagaaccaatctggtgggcccctcatggctcanaaatactctgggtanngctggctgttacttcan

SEQ ID NO: 517217 - DNA, 314 bp, Homo sapiens
tcccaaggtccaaatcatcaaatatttcgtgatcacaaggggtggacaccagcaatttccacgtgtaactacatgtatccatacttgtgacaagcaatttcgataagagagtccaggcacaggtggctcacgcttggaatccctagcacttatgggaggtcgaggtgggtgaactgcccgagctcaggagttcgagagcaggctcggtaacacggtgaacacccaactctactaaaatacaaaaaattagctgggcatggtggtgcgtgactgtagtcccagctacctgggaggagcgatcctctagagacgag

SEQ ID NO: 517218 - DNA, 525 bp, Homo sapiens
tacatccaagcactgggggattctggtgggctccaaattagctttactgattgaacatccacagagatggaggcatttaatacaaaaccaggaactccgaatccattgctctttcctcctttgctttcacttcttaagtatatgtgttctgaagttgagatgggagagatttgaatatagaatttttattctcaaactgtttagtcatctaaggcttcattgtacttcggggagagctataagtaactcacctttaaaacaacaggctctgatttgctgaagaggtttggtattttttaaggtatgtctccctgtttgcactcagggttaaagtgtcagactaaatttttagaagaaaacagaaattcaggtgtgtgttcattataggttattcagcaaagtggaccctgacagtttctcggtttccccagtgctgaagacagcattgccatccaaagaaactcacattttctttaaagctatcacactttgtcttcttatcccctgcttcctgttccttcagcc

SEQ ID NO: 517219 - DNA, 551 bp, Homo sapiens
tgtggagacggggtcagctaatacctcccattatggcatcctgtgccgcagggtatgaacagcactggttgaggagccagcactacgtgtacctgtgtggagaccatgcctgggctgggcagggtgctcaggaggtccttgtacgaggaggagcttgagcccaagtggcctacaccggaaaaggtaacggtcagggtagggtgagggggctgaagtcccctaccaagtcgaaacatcttaagcttcatcgtggtccatgtctgccagctctggaatcgggacatgtggatgcggatgccgtgaacaatgccggggccgagagtgcatcatccctgaggtatcccgatcctaccacttgggcatcgtcggcctcaacatgaatggctactttcacgtgagtgggaggcagggagcagggcacagtgtggcctgacagtcacgaagaagaacagggactctgaagcaatcttaggtctgctagtggctagccatgtaagcttggggcaagagctatcctattttgtgctcagtgactttatctgaaagctgag

SEQ ID NO: 517220 - DNA, 1722 bp, Homo sapiens
ccagaacacaggatgtcgatgaacaactacccctaaaagccaaaatgggaaaggaaaagactcactatcaacactctgctcgctcattggacacgtagcattcgcggcaagtccaccacatactggcacatcatgatctataaactgcggctggcactcgacaacaagaaccatctgcaaacaacttctgagcaaggaggctgctgagcatgggaacagggcctcccttcaagctactgcctggcgctcattggcactaacacatgaacagcctgagcgctgaacgctggatactcacccactctgactactctcctctgcatgagaacactctcgacgaccagccaaagatactaatgtgactactcacttgaatgccaccaggcacaccagacacaccatttactcaaaaaaacactgaaatctaccaggggcaacactcatcacggacatgcaccatagatgcaatgcatccctgaaaattggattagcactagcactgcgcctgatctgcgctggaaaatctatgaaacgccctgagctcattcgttcccaaagaacactgggggcaaagcacactcaagcagcgaggccagttgcccaccatcattcatgcggccttataaccaccaacatggaagatgcttgcacaaaacaaccatcaaaatttgatccggcttgcttatacaccaaaccacagtgggacattacacaccattgaagcaccaaacccacttaaccagggcaccacgcaaagagaagcactacctagcagcgcaaaaacttcggatctcacagcgacacgcatccaaggccacccatctcaccacatgacaaacgacaccacactcttgcgccctaaccaacagcgacccggaacagaagccagccaaggacaaataactggatgacacaacacaatctaccatcggggctgcgagcacatcatgcagatgaaacacaaacagcattgcccatagcgcacgagcccaaaacgctggcattacacaaagtggaacatatagcaactactccaaaagggagaattggcgacaacaggctcaacacccaccggtaacagaggaaatgagacaaaacagaccacagaaggagaacaccacaaaaccggcgatgagagagcactcagtagggaaagtggcaatcatcgtaaccgacacacaacaatcgcgacaccaaacatgcgaagcacgagaccaccttatacagcccagtgacacacacacccacaaggaagtggtcctgatcaacaaaacatgcgaagagacaaatagaagaacaagagacacaccatgcttggcacccaacagtacaacacatagatgaatcacatcacacacaccagggaacatggaggagcacacaccaagtagcacaagaccagacgacgcaaagcgagacaacaaaaaccagaggcacgaaacgacaacagacagacgtaacgaagataccacgcccacgagcagaaacaagaaggcccgacgaccacaaaggatgcaaaacacgcaacacgcaacagaccaccacacacaagcccccacaagaacgacagacccacgcgcaagtgacaataaaacaaagcagcaatagcgagacgaaaggataagagccaagataaagcgaagatagtgccaaagctagactacatgacgcagacatcgaacacaccagacggctaaaaacacacgaccgaagcacgaacca

SEQ ID NO: 517221 - DNA, 812 bp, Homo sapiens
gatttatttttgaaggaaaaattgcttataactaagtccagagacatgctaggtgagcccttttgtcaggctgctaatcatgacatgccgatggttgttaatatgtgtaggtgtgcatctttttcttcttagcaattccttgtatgatcaccattcccttcttgttcactccctcccgctctctcaaaaggaacttgggaaatcttgtgaaatccaggaaaacctttagtcttatacctcaactgacctttcagtccgtgtctggtgttctgaaagtaacgtgaagtagaagaacttgatgtattatgtcctgacataagaatatatttatcaatacacgttttaatgcagtaagctctccttaccataaatgtttcttgggtgacaacatctaagacaatattagtgggatgaagaaagaaaagcaggggtgcttttggaagcagagttagtgttacctcaaaatgtcggaacaattgcctgttgatatattaataagacattaaagtccaaattttaatgttgggctctcaaatgatttggataccagtctgcaaagtatttctaactttaattcccaggttttgaaaagagatataataaatagcatttaagtggggaatatactaggcagtggaaaaagtatttgaaacgtaaattgaccgttagaagattaagattggttttccaagtggatgtccattaaaagtagaaaaagttatttgggaaaagtgaggtgtgtttccttaaaatgggtactaaataaaattactgggatacaggtattcctttgggaggaggccagtaagagg

SEQ ID NO: 517222 - DNA, 268 bp, Homo sapiens
  misc_feature (11)..(11): n is a, c, g, or t
  misc_feature (49)..(49): n is a, c, g, or t
  misc_feature (58)..(58): n is a, c, g, or t
  misc_feature (216)..(216): n is a, c, g, or t
  misc_feature (240)..(240): n is a, c, g, or t
tttcacctggntaatggggttgatttaccgagacggcgtcatgcaagcnatggacganttcgacaagagccagttcctgtttagaaacccccactgtgacctgggcgagaagctgcctggaacacactggcccagcaaccacatctacagcagccaaggcctgatccccttctacatggggttcatccccgccatgcaggacaactacgccctganattcggcaacagaacccggaggcnttactggaaggaattgggcaaagcgaaa

SEQ ID NO: 517223 - DNA, 1057 bp, Homo sapiens
aggaaaaaaaatccacattaatattgaaactgcacctgtagatcccagcactttgggtaggctgaggacagaggattgcttgagcccaggagttcgagagcagcctgggcagcaaagtgagaccccatctctactaaaaatttaaatgtatttatcaaaactgtgctctagaagcttggactgaatcccaaaagtgtccataagttcaaaagcaaaagtatagtaatttcaacaacaaaaaatgtatttctatcatgtaatcttggaaattattaaacagtccttttagcttctagcccatattttgtacaaaagagtttcaaggaatgggtggcttggtcatggttcgcaaataaaaccacactgttatactgacgcaggccgggcgtggatgagctcacccctgacaaatcccagcacatttgggaaggccgaaggccaggcagattccacacaggtccggcaggtcccagatcaggcccggggccacgaatggatggaacccccggcctctcacaaaacacacgaacaaaattgcccacggcgaaggcacgcaaggtgccctgtagatcccagcacaactggggaaggtgaggacggagaactcgctcgactccacggaacgacaacggacggcagcgagcccacacaagccgcgccgacacccccacccgcgccaaccgcgccacacccgacccaacaaccaaccgaacgcaacacgcaaaccccgcaacccgaccaacgacagcccacgcgcaggccacaagaaagaggacacacaggcccaagaccggcacgccagcgacaacacaggccgcagccgacccgagcacgcaaagcagccgcacagacacagaccaagcaccacacacggacaccacaaaagcgcacacagcccgcctgcagacaagcaaacccgcgcagagacgcgacacacacaagcggcgacccgacgagagccagtcacgccaaacaacgaacgcgccaaacacgcacaccaccatgaccgtaattcacacgcccccgcccaacagccgcaccgacgcccacacacaca

SEQ ID NO: 517224 - DNA, 320 bp, Homo sapiens
  misc_feature (159)..(159): n is a, c, g, or t
acaccgatattagtcaatgggtaaggtgtaccttggtgccctccagaaaggcaggacaactagaaggatggggggcatccaggtcatagataagagacaaatggttgcattcttttgagtctttgatcagcttttcacttaatacacaatttacatgtnagacaaagggataggaggatatgtcacttatgcctatggcggcttaattgatcttccgttttaacatacacagatgggacagaggaggcagtcagttcgcgcatttgcctctcaggtgggagagaggggtgactctgagttctgtcctctgtcccatacct

SEQ ID NO: 517225 - DNA, 152 bp, Homo sapiens
ttaggctgactctagagtgatcccattccctgtcggagacaacacgaccttgcatttgtacggaatctcagcggcgatcacaccttccggtcggtatttctgcgtttcgcccacaccctgtcgtaatctttcccatccaggttcgcaggctt

SEQ ID NO: 517226 - DNA, 167 bp, Homo sapiens
  misc_feature (116)..(116): n is a, c, g, or t
  misc_feature (120)..(120): n is a, c, g, or t
atagggacaggctagaactttcactttatggggctgacaaagaaaacaccatttgctgaagaggctgacaaggggaatacatagggtacggggggggtctacaaactcctattttntcanctgcttgggtggattaaaacttcaataaagatcctgtgataaaacag

SEQ ID NO: 517227 - DNA, 1142 bp, Homo sapiens
  misc_feature (1)..(1): n is a, c, g, or t
ngtgttattacacgcggcccgtgctttttttttggtcccccttctcgtcatgttctcccttcgtgtgggtgcgattcgtcctcctccccccgtcggtgtgttgtgtgccgcccccctgcttttgttggacctcgccgcgggggggcgcggttttcgttcgctgttgtgccgggtggtttgtttgtcgctttgttgaccccgccgcggggggcgggggggtgttcgcatcttggttttgccctcccggggggggcgcgcgcttgtgtggcccctcacgtgtggcccccgtcttttttgtgtgcgcccccctcgttttggtcgcccgcagtgtggtgtctccctcttttgtcactcccggtgtgttttcccggcgttccgcgagatattttccccgcgcgtgtgtgtgttgttggtcctcccccctcgctttttgcgcggggtccctcccccgcgcgcgtgtttttttgtagtccgcgctctttctttttggtagagtgagctccccccccctggctctctcttgtttgttttgtgtgtcgcccaccccccgctctctctttgcgcgcgggcgggggtgtcccccctcttgtgggtgtgttgagataagagggcgccaccactaaaatgctgtgggtatacgcactcctcgcgcggcctcacacaaatataagagagagtgttttttataagagagaacacccctcccgcgcccccccgcttgtttctcccctcgtgtgtggtttgtgcgccccatctcctccccccccgcgcgcctgccgcgcgctctgtgagacgcccccgcgcgcccctcctcccgcggcgggcccccccccgcgcgcggtggccctctcccccctctctctctctcttttccccccgcgcgtgtttccccccgcccctctcgcttcttttttttgtcgtgctctctctcccccgcgcggcgggcgcccccccgcgcgcccgcgcgcgcacaagagagagaaaaatccccacaaaaggccccgcggggggggggggggggagagaaaacaccaagagagagagagagagagagagaaagaccccccctcccctcccctgggggtggtggggtgtttttttttttttttcccccaaaaacccggggcccccccttcccccca

SEQ ID NO: 517228 - DNA, 970 bp, Homo sapiens
  misc_feature (181)..(181): n is a, c, g, or t
  misc_feature (478)..(478): n is a, c, g, or t
  misc_feature (511)..(511): n is a, c, g, or t
  misc_feature (545)..(545): n is a, c, g, or t
  misc_feature (567)..(567): n is a, c, g, or t
  misc_feature (610)..(610): n is a, c, g, or t
catgacccctaagcaggggccctctcagaacctcctagatgagctccggcctacccatgtgatttcacttccgactcccataacgctcctgcatactctggcctacttaagcacacacactcaaccattataccaagtgcatggcgccgatgtagacgcgagaacagcagcataccaaggntcaccagcacaacgcagctggtgcaacacaaggtctgtacgtatagcgggcataactccgtactttagttagcctcgagcacagttgtcatctcgtgtcagcacgagactttggtcattgaggctcgttcttcaccctacgtcccacgtcacatagaccactcgtaaaccgccacgaatttgaacggatgcggcgacgttgggtgccatcgagagcagtggcgatacatccgcgcggcgtagacaatcgcctctatagtaacgttcgccaacttcgcttaagacgacgattccagtnagtgtatcttcgacagtgcatgcgatgatactncagagtgcatcgctcgtacggctgcgacgcgatnacgatgcgtcaaattaggcaanagaacgaaccgcgtagaacgtgcccagagtaagtaacagatgnctacatggcgtgtagttaacgaagtacttaatagtggagaatcatcctagtctattagcccgtcccgtatcgaagtcacgtcaagagggatactatcaaggatcgtcccccttcgagcgaatttcgcgtaccagacggtctaacaggcgtcacacattcatagagtcagccaccagtgcttccaacagaacttcgtcgattcttcggcgtcaccatttacttcacctatctcggttcaaccgcccaaggaactattcaacttaacattcccaacatcactttggcttcgaagcagccgcatgatacaggcctttggagaccgtggttgactactgctgatgctccacactgccgggttac

SEQ ID NO: 517229 - DNA, 253 bp, Homo sapiens
tgtcttccttgggtcctctccactgctcagctcagtgattgggtagggcttccagaaagacagaagcttgtcaggagactggggctgggacagtgtgccttctcttctctcagcagccctgagttgtgtactcttcccaggcgctgccacctagcagccctctgtgcccagcactattcacttccatgtcaggccccagggccagtgcggtggtccccatgctgctgcagtagggggaatagggctcagagag

SEQ ID NO: 517230 - DNA, 108 bp, Homo sapiens
gacactaccttcccgaagttgaaggcaagcggtgattgtttggtagacggcgcttggtcatgggacctgtgcggttgggaatattgcttttcctttttgctggccgtg

SEQ ID NO: 517231 - DNA, 563 bp, Homo sapiens
  misc_feature (410)..(410): n is a, c, g, or t
ctcaacgctttatacttcttattggggtcttcaaacttaatttccttactatttcctacctgatcccttctaagtcatgatcttgtttatatcaacaatcacttgttttagttgttacaaattgtctgcagtgtttatcctcatgatggcaacattttgagagaaatgtcttcctgcctttgcttttctcattcgcctttttcctttgtgtggtgcctatgctgtttcttcttcttatcgtcgagtatgctttttcggatccagctatctggaagaacttaatataggtccgggcacagagattttccttgtggtgacgtaagtttgaccgtgagcattctgagccttttcttcttcacggcccagagtcaggcaagtatctcaggcagacatgttctgccatgtggttngtcagggtgtttcctcattcacccccacttcctttgcatatctgaagcagacgaggtcctagaaaacttcagtgccagcctttccttctagagaactctggcttttacactgaggctatgcaaaggaagtataagcgtgaggggatcctctag

SEQ ID NO: 517232 - DNA, 258 bp, Homo sapiens
  misc_feature (97)..(97): n is a, c, g, or t
tgggcaatgtggcctatacagaagcagattattaccatacggaactgtggatggaacaatgccctaatggcaactggatgaatggcgagatttctanccatagataaagtctctgttctagaattattttgagctatgctggtatatcatgcagggatgacctggataatggcactttttgctcacaaatgaagcttcttgaactatgatccttgatatgattatgagatgggtacctgatgctctgagattctgtaa

SEQ ID NO: 517233 - DNA, 80 bp, Homo sapiens
gcggccgcctactactactactgctcgaattcaagcttctaacgatgtacggggacatgtattttattaatttatgttcc

SEQ ID NO: 517234 - DNA, 1248 bp, Homo sapiens
gtgaaatctgtggagcaaaccacagtttcatggcccaatcgtcctagcaattaattcccctaaaaaaaaaaaaaaaaaaaaaaaaaaaaacatatgtgtgtggggcgcgcgttgtgcggccccccgggaaaagctttcaaacaacaattcggtgtgtgggcggcgcggcgggcccacagtgggctatgtcggacacaggtgggaatatcggggtgtccctaagagaacaccccgcgggcgcccaagcaccacaacgggcctggagaatttctccaccccaataacaaaacagcgccgccggcgggaccaaccgagaaggcgctcctgcgaacaaaatttccccacagcggcatcctcctggaaggccccccacacgcgggaacctctaactaccacggtgagagctcccagcgcgcagaccgccctccataaattactacaaaattatacaagcgaccccgcgcacaccggtgggagccccaaccatacccttaccctcgccacccaacatccaccaagctcctaacgtacgcctacatcacacattcaaccacaagccgaaacccaaacaatcaccaatcaaaacacaacaccccaagcaaccacccaaatcaccactcaacgaataccacatcaacatcataccccaaccacacaaaccatcacaacgcttccacacagactccccataacacaataccaagcacccactactaagcctccctactataccagcccaccactccaaattctcccgtcactacacaaacctctcatcaccaacacagctcacccctcccactacgttcacactcaccaccatacctaccactcgacacatctcagcatcctcaaccactctcatcttccgcaccagacacatctaaccgtctcccacacaccttcaacccaaccgaccaccatcatctccacactccatcacgactaacacccgaaacagactcaaaaacgcacatacctacacccacactaccgacacatcactcctcacaaacacaagctactaaaccacagacccaacctcactccaactctaccaaccataccaccaacgcgtccacaaactcaactaaccatacaccccactcctactcactagccacgcccattaacagacacatcgcccaatcacacctacccataactctactacctgctgactcgacccgaactcacttacatcgattcataataacaatataccacctcctccatcatacacaaccc

SEQ ID NO: 517235 - DNA, 424 bp, Homo sapiens
gtcttaacacaggctgggtgaagtagctcacatctgtaattctagcactttgggagactggggcaggagaaatgcttgagcccaggagtttgagaccagctcgggcaacacaacaagactcagtttctatcaaaaaagaagaaaaaattctttaaattagcctggtgtggtggtgcacaactgtagtcctagctacgtgggaggatcacttgagcccagggattcaaggttagaatgaactgtgatcgcgacactgcactccagcctgggtgacagagtgagaccctgtctcaaacaaacaaacaaataaaaggagaaaatgattccttaacttgcatactgtgaagactgtgcttacatagaataagcaaaatacagcacaccaattacaatgcatactaccaggtcaggcctgtgggttaga

SEQ ID NO: 517236 - DNA, 377 bp, Homo sapiens
attaacggtagtacataatggatatccacaacagatagtatatgtagagcaaattatgtactaaatttccacaaaacttctattatgtaagatctgatctactttgccttacttaatgtgtcctccctaagagataaagtaatactcttacatggtcatcagtataggtggtacttacgtagattaacatagctataaatagagttgaacacatttataaactcaagagaataatttttataaaccctgtattccaatctgtcatttacttaaattattttggttgtttttccctttttttccttcttttcccaccccctccccctccatgtgaagatttgggtgcttaacatatcatttttttccctgccggaatt

SEQ ID NO: 517237 - DNA, 634 bp, Homo sapiens
gatcacaccactgcactccagcctgggtgacagactgagactctgtctcaaataataataataatatacatttaatttttttccttggttttctgtcactatgtatgctcatgtatccaggtatataaagcaaatattattggagctgaagagagacattagacccaaatacaataatagctgcagtcttcaacaccccacttttagcattggagagatcataacagaaaataaacagatcagacagaaaataaacaaaaaaacactggagttaatctgcactgcagaccaaatggacctaacagatatttacagaacattcatccaacagctacaaaatacacattcttctccccagcatatggatcattctcaaggatagactatatgttaggccacaaaacaagtcttaaaacattcaaacaaaagtgaaattttatcaagtatcttctctgatcataatggaataaaactagaaatcaatagtaaaaagaattttggaaactatacaaacacatagaaattaaactatgtgtttctgaatgaccagtgagtcaatgaagaggttacaaggaaatagaaagatttcttgaaacaaatgataatggaaacacaaatacaaaactacgtaata

SEQ ID NO: 517238 - DNA, 468 bp, Homo sapiens
tcttaactgccccaaactcactaccccaacaataaaactatttccaccactgggcttactgcagtcacgatttcaacctttactgaactaccatgaaaaatgattttagacagctgaagcagcatacttttaaaaagtatcccttcttatggacgaaggatttggcagtgcggtcattgagatttcctacttcttgttgcaggcacaggggattagctcaaatggtagagcgctcgcttagcatgcgagaggtagcgggatcgatgcccgcatcctccaactatttagtttagttcaatcagcacacattgttgtagctctggattgtatccactcattacaagtaatttccaccactgtgcttcctgcgggcactacttcaacctttactgaatttgtcatgaaagatactttcagacagctggagtaagcatactttcaaagaagtgtcctttctgatggacgagg

SEQ ID NO: 517239 - DNA, 350 bp, Homo sapiens
gggagttaatatgatcatcacgtatcaaatctaattgttaattccattacagcatatattgtgcgaagagtgcatgaccttatgggttaacagatggcatgtgcactctgcggaactgagatttcataccatataaacaaatggaaggatggagccactttatcacaccttcgcatatattaagctgcttaaactatcacgggcacaaagtactaagggcatttgatcataatgactactgatagggcatcagaaaggattttcagggctaccacaagaatgattccagatggttttacaaagtaagacttaggatccaattaagcatgatatacagccaccctgtggtt

SEQ ID NO: 517240 - DNA, 818 bp, Homo sapiens
  misc_feature (20)..(21): n is a, c, g, or t
  misc_feature (29)..(29): n is a, c, g, or t
  misc_feature (55)..(55): n is a, c, g, or t
  misc_feature (63)..(63): n is a, c, g, or t
  misc_feature (65)..(70): n is a, c, g, or t
  misc_feature (84)..(84): n is a, c, g, or t
  misc_feature (87)..(87): n is a, c, g, or t
  misc_feature (89)..(89): n is a, c, g, or t
  misc_feature (93)..(93): n is a, c, g, or t
  misc_feature (97)..(97): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (120)..(120): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (166)..(166): n is a, c, g, or t
  misc_feature (170)..(170): n is a, c, g, or t
  misc_feature (174)..(175): n is a, c, g, or t
  misc_feature (177)..(177): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (201)..(201): n is a, c, g, or t
  misc_feature (217)..(217): n is a, c, g, or t
  misc_feature (221)..(221): n is a, c, g, or t
  misc_feature (230)..(230): n is a, c, g, or t
  misc_feature (240)..(240): n is a, c, g, or t
  misc_feature (242)..(242): n is a, c, g, or t
  misc_feature (320)..(320): n is a, c, g, or t
  misc_feature (336)..(336): n is a, c, g, or t
aggtacttgaagcaatttcnnctaacgcncttcatgagccaggaggaggtggagnactggttntnnnnnnaggagaatatgatnganantttnttgntggagaangcaaantnanatttnacagatttcctgagcttttatacgctgggntgnagnatnatgaagnatgnaagnnanaanantgtnaaaagntgnttattntttctacaacgttcanagcncagagcgcnctcttctagncntcatgagcgacgcccttgtcctcgccaaaatgaaagggtttgatgtgttcaatgcactggatctcatggagaacaaanccttcctggaagaagntcaagtttggcataggggacggcaacctgcagtattacctttacaattggaaatgccccagcatgggggcagagaaggttggactggtgctacaataaccagtcaccagtgcgattctagataaagccactgaaaattcgaaccaggaaatggaaccccaccactgttggtccaattttcacacacgtgagaatccctagcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctcatgcagccgtgatcaagggaatgtaactgctgaaaactagctcgtgattggcatataatggagttaacgggtgaataataaaagtatatatatatattatatatatataaaaaaaa

SEQ ID NO: 517241 - DNA, 787 bp, Homo sapiens
  misc_feature (20)..(21): n is a, c, g, or t
  misc_feature (29)..(29): n is a, c, g, or t
  misc_feature (55)..(55): n is a, c, g, or t
  misc_feature (63)..(63): n is a, c, g, or t
  misc_feature (65)..(70): n is a, c, g, or t
  misc_feature (84)..(84): n is a, c, g, or t
  misc_feature (87)..(87): n is a, c, g, or t
  misc_feature (89)..(89): n is a, c, g, or t
  misc_feature (93)..(93): n is a, c, g, or t
  misc_feature (97)..(97): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (120)..(120): n is a, c, g, or t
  misc_feature (150)..(150): n is a, c, g, or t
  misc_feature (153)..(153): n is a, c, g, or t
  misc_feature (156)..(156): n is a, c, g, or t
  misc_feature (159)..(159): n is a, c, g, or t
  misc_feature (166)..(166): n is a, c, g, or t
  misc_feature (170)..(170): n is a, c, g, or t
  misc_feature (174)..(175): n is a, c, g, or t
  misc_feature (177)..(177): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (201)..(201): n is a, c, g, or t
  misc_feature (217)..(217): n is a, c, g, or t
  misc_feature (221)..(221): n is a, c, g, or t
  misc_feature (230)..(230): n is a, c, g, or t
  misc_feature (240)..(240): n is a, c, g, or t
  misc_feature (242)..(242): n is a, c, g, or t
  misc_feature (320)..(320): n is a, c, g, or t
  misc_feature (336)..(336): n is a, c, g, or t
aggtacttgaagcaatttcnnctaacgcncttcatgagccaggaggaggtggagnactggttntnnnnnnaggagaatatgatnganantttnttgntggagaangcaaantnanatttnacagatttcctgagcttttatacgctgggntgnagnatnatgaagnatgnaagnnanaanantgtnaaaagntgnttattntttctacaacgttcanagcncagagcgcnctcttctagncntcatgagcgacgcccttgtcctcgccaaaatgaaagggtttgatgtgttcaatgcactggatctcatggagaacaaanccttcctggaagaagntcaagtttggcataggggacggcaacctgcagtattacctttacaattggaaatgccccagcatgggggcagagaaggttggactggtgctacaataaccagtcaccagtgcgattctagataaagccactgaaaattcgaaccaggaaatggaaccccaccactgttggtccaattttcacacacgtgagaatccctagcaaagggagcagaactgaaccggctttaccaaaccgccagcgaacttgacaattgtattgcgatggcgtgggctgcgtgacgtcacctccggtcgtgtctctggtctccgtgttttccagttaattaaaaccccaacgaatatgagactaagggaatgtaactgctgaaaactagctcgtgattggcatataatggagttaacgggtgaataataaaagtatatatatatattatatatatataaaaaaaa

SEQ ID NO: 517242 - DNA, 132 bp, Homo sapiens
ttgctgctgcggtcgcctctgacggctccccctgttcccggggacgacgacggcctcagacacgacaaccacgccctgccaacaccttgatcttggacttctagcccccgggacacagctccccgggatcag

SEQ ID NO: 517243 - DNA, 515 bp, Homo sapiens
cgctccttcgtggtggtctatagcgcctttggtgttcaaggcttagcactccgcttgatgacagatagaacactatccggtgcctgatgattcgttttcgtcctgtacatctcgctgtaagcttctccccaagaggtccgagttactgttcctcgtgggtgtgtttgtgttgctttgcagcgctctaaagaactttgtgtttgggcagctgtgtgtctgtcatgtcaggctgctggacaggagttgatgcttacggcgccgctgaccagggctgctttactgaagctcactgggtgtccatcaatcacaaagtggcgtatgcagcctgtgaagggtttgctgggggccaagcgtggtgtcagtagagattctggaacacctccaacaaacacaggctccctgtgatcaattggttttggattcaggggtccaaccacatggttcacttcagagtccacatccaactgaaccacattagaatctctaataactgtaattctgtgccatctggcatc

SEQ ID NO: 517244 - DNA, 185 bp, Homo sapiens
tgatctagaggatctcccgcgtacagttgcgcgttgctttcgaccggattgagcgatgccgacgctgaattctggtgggagctttggctccgtcgttcgaacggcaacatccagatgcgattgccgatgccgtcgtcgcgatcttcactcaggccggcttgcaggtgcacagtgatcgcctgcgg

SEQ ID NO: 517245 - DNA, 417 bp, Homo sapiens
  misc_feature (61)..(61): n is a, c, g, or t
  misc_feature (218)..(218): n is a, c, g, or t
gggaggaatggtcccaatttgccccatggggtggacccaccgggctatgcctatcccggtnccgccgccgcccccatggttgggtttcccatgccccccgggtttttccccttaggcctttaaagggaaagggaaagggcggttttccaaaacgcccctttaaatggggggttttcgcccaaaaaggttttttaaaaacctggggatttcccaaaatncttccgggcccccggtattttgggggccctttttgcctttttaggtggggatttttcccccctccccgaacccttttttgggtttttttgggcttaaaaaagccggccggggtttcccccaaggtaatgggccggggttttgaatccccttaattgaggcccgggcgggccctccccttaaaaaatttttggggccgga

SEQ ID NO: 517246 - DNA, 725 bp, Homo sapiens
  misc_feature (230)..(230): n is a, c, g, or t
  misc_feature (280)..(280): n is a, c, g, or t
  misc_feature (386)..(386): n is a, c, g, or t
  misc_feature (514)..(514): n is a, c, g, or t
  misc_feature (534)..(534): n is a, c, g, or t
  misc_feature (543)..(543): n is a, c, g, or t
  misc_feature (590)..(590): n is a, c, g, or t
  misc_feature (665)..(665): n is a, c, g, or t
acccctccatgcagttgattcccagatctgtattattctactgaaaatccattccccaactttcttggctagaataacagaagcccagttagaattcatgataccagtttcccaccaccaccaccgtcgccctgccattgttagcaaaaccatctcttgagtggagctcaaagatttgtaatcccccactccccagaaagataacttcagactcagcctagaagtaaagntcctccagatatggcctcaactaccctccaacccatgtccccagtgcatncctttgatgcccccttcagtggagtttggagtgagtgtttttcttttcacatactcctggtgttcttccatgaatacaattttcacctcttgaatattttcaatanttctccatgctacacacagtgaaattcaagctccccatcaggaccccagtcttcccaaatgctctttgcacttttctgtctccatgctttcccttgggtcatcctcttctctaatataaccttgtgtnttactctaggttctccaganaaagagcanagagatagaggtagagctatacacatagagagagacagattgattanttgtaagggatggctcacatggttatggaggataaggagtcctggagtctgcagccagcaagctggggacccagnacagccaatgatatagttccaactcgagtccacatctgtcaggagaagattgtgtcccgc

SEQ ID NO: 517247 - DNA, 667 bp, Homo sapiens
tgcagtcgctgggctgcagggactgtgggcctgagggaagttctgacgggcacgcgtgagtggaggctggcggacaggcgacaggactgtggaggacagaggagcgagagcagaagaaacacaccaggagaatgttagggaagtgtgaaactcagagggggtatgacgagtcagaaaaaaagaactctgggggcctagaaaaggagaacccaatgagaatggctgacctctcggagctcctgaaggaagggaccaaggaagcacacgaccgggcagaaaacacccagtttgtccaggacttcttgaaaggccacattaagaaggagctgtttaagctggcaccacgggactttacttcacatactcagacctcgaggaggaaatggagcgcaacaaggaccattcaggctttggccctttgtacttccccatggagctggaccggaaggaggcgctgaccaaggacattgagtatttctttggtgaaaactgggaggagcacggtgcgcgtggcccaagggttgccagaagtacgttggagcggatccacttacattgggcagaacgagaccggagactactggttggcgccattgcattcacccggtacatggggggagtctctcggggggggccaggttgcgtgaagaaggtgtgcccacgcgag

SEQ ID NO: 517248 - DNA, 186 bp, Homo sapiens
ttacacgcgactcttccctaatagcatatattttaaagagatagcaatatgaccaacataacttgaaatttgaaaagcagtcataaggttcacccttgctattgctgtctgtgttgcagtgctgatacagaattggtttcattaattcctacatgtttataatcactcatcaagaaagtgggggaa

SEQ ID NO: 517249 - DNA, 124 bp, Homo sapiens
agcgactacggggaattcgtcataaagaccctgatgagtgcggtgtggggcgttcgcaagtgcatgccccagatgaattacgacaagctgagccgggccctgcgctattactataacaagcgca

SEQ ID NO: 517250 - DNA, 277 bp, Homo sapiens
taaaaagttaaggtctggtgcggtggctcacgcttataatcccagcactttgggaggctgaggtagaggatggctggagcccaggagttcaagaccagtctgggcaagatggtgagacctggtctctacaaacattttaaaaaaaaaaaaattagccaggcatagcaacccacacctatgttcccagttacatgggacgctgaggcaggaggatcacttgggcccagaaggttgaggctgcagtgagctgtgttcctgctctttaagaccctgtctc

SEQ ID NO: 517251 - DNA, 365 bp, Homo sapiens
  misc_feature (25)..(25): n is a, c, g, or t
  misc_feature (30)..(30): n is a, c, g, or t
  misc_feature (322)..(322): n is a, c, g, or t
  misc_feature (327)..(327): n is a, c, g, or t
acagaagggcgtggtggtgcgtgcngtgantcccagctattgggaggttgaggcagagaatcgcttaaacccaggaggtagaggttgcagtaagccaagattacagcactggcactccagcctggctaacacggtgaaaccccatctccactaaaagtacaacaattagccaggtgtgatggcacgcacctgtagtcccacctacttgagaggctgaggcagaaggattgcttgagcttaggaggcagaggttgtagtgagcggagatcacgtcattgcactccagcctgggtgacgggagtgaaaccctgtctcaaaaaanaaaanaagagaaaaggcggccgctcgttgttcgcgcggccgcg

SEQ ID NO: 517252 - DNA, 326 bp, Homo sapiens
gacaactccagacttgcgggaaatggcctgagctcgcattggacgctctggggtgccacatgtctggacactgtttcctgggagacctccgcctctccgcgcggatgaatgaggctgcagactgccgaagaagagctcgagtgctgtggggcacttgatggggatctggggtgggcacacacgcagaacggccatgggtacgctatctttccatgacactggtctccacaggttatgaaacagcttccaacacgtttccagtgcctccatgcctggcaatgcctctcccccctgctccccgacctcttgcaagggaaccccacgcg

SEQ ID NO: 517253 - DNA, 396 bp, Homo sapiens
agtgcacaatcttggctcactaaacctctgcctcccaggttcaagcaattctcctgcctcagcctcccaagtggctgggattataggcacccgccaccaggcccagctaatttttctattttttagtaaagatggggttcaccatgttggccaggctggtcttgaactcctgacctcaagtgatccgcacacctcggccttccaaagtgctgggattacaggcgtgagccactgcgtctggccctctttcttgtaatatatttaacagataattttgtgtgaatgataggtgtgttccccagaatactgatgttttcctcatactcactcactatcactgtaaatgactagtctggagtaccacctcttttttctttttaattagtacaacaggaa

SEQ ID NO: 517254 - DNA, 515 bp, Homo sapiens
  misc_feature (372)..(372): n is a, c, g, or t
ctcgtgtctgattcgctaggttgtgctcaggcgcaaatcctcttgtgaagcatatggtgaagacatggactcctataagtccagagtaccatgcgtgtgtcccggtacgcgaagagccgcggtcgctactatccagcggtctgcatgtttacgcccgctatatgattgtctactagtaatgatcgttataccgcgactgtcttttagtacagtgcagtcttacagtacaacgtcaccgacgatgtccttgaactggctcgatatgcataagaccacttactggaggagcgtgttctttatggagaccttgcgcatgctatttttgagagacaatgaatgtaggctcttatgcaggctactaattcaggtcgnggagctataacactcatgcacacataggtgaatgggaaggatcgtcaacatgttactgtggccatgatcctggaatgcattgtgtatcagaaggtatatactctgaccgctgtcagtttgttgaatccagcggaactgtactt

SEQ ID NO: 517255 - DNA, 138 bp, Homo sapiens
ctctagaggactcccggactgggagatgtctgagaaatacaagtggttgggaaaaatcgaggtgtagtggcttggtatgtggggaggggtagaagggatgaagtgaagggtgacggcccctcataccctccatcttgc

SEQ ID NO: 517256 - DNA, 249 bp, Homo sapiens
ctcgtcttttagggagtgtcgtgtgttcctctgcaagctcgcgtggctggttggtaccggtatgttccctctagtgtggcttgagcgtgtccaccttctccctctccactcccagaagacaaactggcttccctcagggctcaagaatgtgtcaggctggtggggcccgggtgacccactattttgtgtccttgagacatttgtgttgtggttccttgtccttgtccctggcgtaataactgtccaatg

SEQ ID NO: 517257 - DNA, 499 bp, Homo sapiens
  misc_feature (40)..(40): n is a, c, g, or t
  misc_feature (42)..(43): n is a, c, g, or t
  misc_feature (73)..(73): n is a, c, g, or t
  misc_feature (89)..(89): n is a, c, g, or t
  misc_feature (150)..(150): n is a, c, g, or t
  misc_feature (180)..(180): n is a, c, g, or t
  misc_feature (186)..(187): n is a, c, g, or t
  misc_feature (190)..(190): n is a, c, g, or t
  misc_feature (206)..(206): n is a, c, g, or t
  misc_feature (265)..(265): n is a, c, g, or t
  misc_feature (299)..(299): n is a, c, g, or t
  misc_feature (304)..(304): n is a, c, g, or t
  misc_feature (315)..(315): n is a, c, g, or t
  misc_feature (346)..(346): n is a, c, g, or t
  misc_feature (410)..(410): n is a, c, g, or t
  misc_feature (419)..(419): n is a, c, g, or t
  misc_feature (440)..(440): n is a, c, g, or t
  misc_feature (443)..(443): n is a, c, g, or t
  misc_feature (447)..(447): n is a, c, g, or t
  misc_feature (449)..(449): n is a, c, g, or t
  misc_feature (451)..(451): n is a, c, g, or t
  misc_feature (457)..(458): n is a, c, g, or t
  misc_feature (474)..(474): n is a, c, g, or t
  misc_feature (476)..(476): n is a, c, g, or t
acatcgccggctctagaatgagataaacctacataaaagncnnctgacgccaaacagaatatcgattgcaatnatcttgaggaaaaacnggttaatagccactccagcaaatctcacatcaatggcactgaaaagtgcgcttcagaaacnaggtcgaaatttaagaaactcctttagatnctaggnnttngagtagcggatccttntcctggtttcccgggaagaacacggcttttgcacggttgagaaagacactcaggccttngcttctgaccacattcccaggactattttctatngggtngtattccttgngtttatggtacaccaagagggagatcacagngacaaatatggccaagcagccaagggagaatcagggcacggtttgccatccttaaaggcgaggntgggtctcngtcaggaacagaaatcagggngcncgtnananccaggnntgtgtcatcccccagngngaggtcacacaagacgtcccaga

SEQ ID NO: 517258 - DNA, 82 bp, Homo sapiens
atgtgcgtttgggcggtgtggagcctgctgccatgttgtcggcgagagctaagacaccccggaaacctaccgtgaaaaaagg

SEQ ID NO: 517259 - DNA, 205 bp, Homo sapiens
tccagcagatgtggatcagagcaggagtatgactgagtcctggcccctccatcgtccaccgcaaatgcttctagtgcgtgactatgacttagttgctgttacaccctttcttgacaaaacctaacttgcgcagaaaacaatgatgagattggcatggctttttttttttttttttttttttttttttttttttataacgaggggg

SEQ ID NO: 517260 - DNA, 388 bp, Homo sapiens
atattttatattctcttatcagaaaaaatcaccatttgggaaagtataaattgtaaatggtaaataatgtgttttcttctctttttttcctttaatgtttttctaaatgattatacaaagaaaatcatctggctgggcacaatggctcatgcctgcaatcccaacacttttgggaggctgaggtaggagaatcagttgagtctaggagttcaagatcagcccgagcaatatagtgagacccctttatctacagataatttaaaaattagcctgatgtggtggcacgcacctgtagtcccagctactcgggaagctgaggtgggaggattgccagagcccaggccgtggaggctgcagtgagccctgatcgcaccactgcactccagac

SEQ ID NO: 517261 - DNA, 324 bp, Homo sapiens
  misc_feature (193)..(193): n is a, c, g, or t
  misc_feature (310)..(310): n is a, c, g, or t
ttgcccagcccgacatctttatttaaaagctttttgggccaggcatggtggctcacgcctgtaatcccagcaatttgggaggccgaggcgggcggatcacaaggtcaggagatcaagaccatcctggctaacaaggtgaaaccccctctgtactaaaaatacaaaaaattagccaggcgtggtgctgggcctngttagtcccagctacttgggaggctgaggcaggagaatggcatcaaccagagaggcagagtttgcagttgagcttgagatcgtgccactgcattcccagcctggggccaaggagttnaggattccgttttc

SEQ ID NO: 517262 - DNA, 200 bp, Homo sapiens
cccaaacccactccaccttactaccagacaaccttagctaaacccatttacccaaataaagtataggcgatagaaattgaaaccttgccgaatagatatagtacccgaaggaaagatgaaaaattattaccccggattatataggaagggcttacccccattatcctttgcacaaagtagttaactaggagatatctctt

SEQ ID NO: 517263 - DNA, 232 bp, Homo sapiens
gttgagaaactcattgaaaggcaagtgttgaagatgttgtagtatatagctacatagtgtgttttcacagagtgaagttttttgtaactaaattaaaggggggtaaaaagtgtaacatatttgacattaatgtaggtattttctgcaaatcaaaacaatccctgagaactctctacctctacaatggatagaaggagcgatagatctaaaaacgctaggtgacagcagagac

SEQ ID NO: 517264 - DNA, 362 bp, Homo sapiens
ctactatactctgagatttttcatgttgtggtatgtagagcagcggtcatgatgcatataattaacctacatgacgcttgaagccctctatctaaggcgttatgagagtgaatctgctcttgcactgaaccttctgcagttatactattgcagcgcatttttgaagcacagacaccagaggcctaacgattcctccatgctgtgtatcttctgtcagggcgttggatttacaccaaccaaatgtacttaccgctgtgtaaccttttgagcgctatatacttgctctaatatctcatggtacagcttgtatagctttaaatgtgagacatattagcctggcaggcttgcttgcctcgtgccgt

SEQ ID NO: 517265 - DNA, 122 bp, Homo sapiens
tatgtctcgatcgttataatgctatgcatggctgaagcctccagaaatgatctcttctgctacatcaagccggggagtttacacaatgatacactatgtcttaccttcaaagataatgctcc

SEQ ID NO: 517266 - DNA, 896 bp, Homo sapiens
actgtcatactcccctcccctatcgccttgaacaaccaaacaaggagcttaggtagccaccctccagtactcttgctgctccacgcacgcactcttctacttcgtcttcttctacccttttcccatctttggcattcttatcatcaccatccttctggtgcgttcaagagccggaactccagcaagaactctgatgggaagaatggggtgcctctgctgtggatcacagagccacacctcaactactacactacttgcctggaaccctctgtgctcattatccacccactggcacgtttactaacgccgatgatgcccccacccctgtaggccacagcggagacgtcgctcttccttccttgtgcgatggagcatccgaccgccgttaaactctgcagcccatgccagcgcgcatttccgcctacaccgcaccccctccgtcctgcggcccgtccgttactcgtacccgaccgccccccacgatccaccctatcctcgtacgatctatgctccacgctaagttaaacgttcccacctccccgggcgggccaatccctattcaatatccaccccctaattttcctgccatacgtaatgcgtcccggtcgggcttcgaacctaccccgtattactctcccgtcgaacggagcatcacatacccgtaccttaccgcatgccaaatcacctatacctcgctatagctcccacccgcaattagcccacctgcctaacgcaacgatcataatctacatccacctatctgttgacccctttgatcggccattccataccctcattccccgtgcacgttttcccccctacgttcccacctgctcccccgccgccgccgcaactactcccctaaccgtctcatgtgtcgcaacgcagccggcccc

SEQ ID NO: 517267 - DNA, 207 bp, Homo sapiens
tcgggagcgtgactaatcatccatccaatcaattgactaagtcaaacgtaacctcaatacaagctgataaccatacacagatcactaagaggacgaacctgattctcttatactagtatcctttagatcatttgtattgccacaactgtcctcctcggactcctgcctcactcatttacaccaaccacctcactatctataaacttt

SEQ ID NO: 517268 - DNA, 299 bp, Homo sapiens
taacgatacccaaagatctttgagcatcacctagtatttacattgtattttatttttctgaggcagggtctcactctgtcacccaggggggagtgcagtggcacactctcggctcactgcaacctcacctcccaggctcttgcagttctcctgtctcagcctcccaagtagctgggattacaggcacacaccaccatgcctggctagtttttgcatttttagtagaaatgaggtttcaccatgttggccaggctggtgtcaaactcctgaacttaagtgatccgcccgccctctgcctc

SEQ ID NO: 517269 - DNA, 535 bp, Homo sapiens
  misc_feature (127)..(127): n is a, c, g, or t
  misc_feature (404)..(404): n is a, c, g, or t
tggggccctcaagaccaggttgggccaaaacccgcggggggcccggcccgggatttccggggaaaatagggggggggtttctcttaagccccctgggtgtggggggggcgagcccccccccccgggnggggttttatgggggttgggcccccggttaagccccaaggtccccaaaacttgggggggcccccccctgggggccccccccccaggtccctgggggggggccccggcccccctttgaagaaaaaaaaccccccaaaaaagggggggggggtggggggtccccccccccccccttttaaaaggccccccccccccccgggggggggggggttttttttaggaaggggcccgcgggggaaggggggggcggcttttttttgggctggttaaccccaccngggggggacccccccccttggggggggaatttttcctttccgggggggggggcccggggggggggggggggggggttttccccccccttttcccccccccaaagggaaaaccccaaatttttttttgggga

SEQ ID NO: 517270 - DNA, 126 bp, Homo sapiens
ttgaaggaccatagtagtgcctaagaagcaggcgacatttaagaaagcgttgaagtctcaacacccacttatctaaaaaatcccaagacatataactgaactcctcacacgcaattggacctagtg

SEQ ID NO: 517271 - DNA, 741 bp, Homo sapiens
ggctagacattacgatattgcggggtggcccaagactacactgatgcagcatcacacaagagccaggcgtctcttgcagatcaaagttatcaagacatgatctgacagggaaggcgtgagtatcacactgctggtgcggggcctacgtgtatgctcccagagttctggtgagtgcactgggtgtgggagccctctgacgcatcaagaacgcatgtgcctgatcgacttctgtgccggcgtagtccaagctgtacaaggtgggcctgggcttgggctatctggagctgtcacagtatcaatctactaagtctctcctgatggaacataagctagtgtcccaaggttggagcgtgattgccaggaatgcggctgctgcagagtctgcttggacacgcgctgcgtgtacattctggactgttggtccgacgtgttcatctggctcgtgcgcaagtccccgcgcctggtgcgcgctgccgccctcaagctgggtcaggagctgtgcgggatgctgcaccgagcacgccatgccacggtcagccgcagactcgagggcaccgaggcgcaggtgttcaagggcaagttcaagaattgggacgatgtgtggacggtggactaaaacatgcaatgcggatgccgtgctgccagagcccgggtctctccgggaagggtgaaacgcgacgccgagaagaatgaccagatgaaggctgactcaatgcgcttttcctgccgcggcagcagcca

SEQ ID NO: 517272 - DNA, 1039 bp, Homo sapiens
ttgaaggtaccaaggaccccagccggaaccgctacaagctgtttctggagtgcaccctgatcctcacctcggtcgtgcctcctgagctgcccatcgagctgtccctggccgtcaacacctccctcatcgcccatggaccaagcatctacatgtactgacacagagcccttccggatcccctttgctggcaaggtcgaggtgtgctgctttgacaagacggggacgctcgaccagtgacagcctggaggtgcgcgagtgtggccgggactgagcacgacgggaacggacggtgaacccccaggtggccccaaagatatcccgtgctcagacacacaacacacagaggccactggacccatcagtgaccacatcgcatcatgcagcctggacagacggcacccatcgtgggtgaccctctagagaaggccatgctgacggccgtggactggacgctgaccaaagtgccctgaagcgaatgtccgagcttgcctcgtatgacacgctgggcatccaccgacctctgctacatcgcggccggtgaagggggccccgaacctctgcactccatgtcctcccagtgcccgcccgactaccacacatccaagaccgagatctcccggcaaggagccccggtccaggacgcctggcgtacacggagcctgggacaacttcacttcaccagcaagcccgcgagcagtcaaacaggacagaccctgacagtagcacctccagctacgacacggcaccactcgcagactcatgccaccactccggcctcaccccaagcgcgggacatccgggagcatccaaatgcgcaccaacggcgcgtgcccggactcccggcggaaacacaccgcgagcaggggcagtcaccccgtggccccccgaccgcacgcagcagggaaacaggcacacacgggggcacccaacagccccacccaggaacgccgcgcaacacaacgagcccacgacacagcaccacactcccgcccggccccggaaccacagcgacgacccggaacgacgcaccacggaccca

SEQ ID NO: 517273 - DNA, 299 bp, Homo sapiens
  misc_feature (22)..(22): n is a, c, g, or t
cggtttggtcgcgctctccctncactgaagtcggcacgggtgtcggcgattcttcgtcgcctatcgggggtgcgacagtgcccaggcgacgtgctcggggaagttcaacaacctggtccgtttccgcggcttcccctacgtgccgattccagagaccgcgatttaacaaccccacgattcaacccacagacccgccaaacgcgggtctttttgtttgaggacgagcatgacgacaccaccgccgattgagcaatttactggtgcaggtagccagctccaattccaacaagcactgagtg

SEQ ID NO: 517274 - DNA, 1473 bp, Homo sapiens
  misc_feature (949)..(949): n is a, c, g, or t
cctgcctgcggagataactgcaagatgatgctgtccgtgcgcgttgctgcgtgcctgtggtcctgcgcccttcctcggcgtggccggactggtctccagaaatgctttgtgtgttcatctttcatttgcttgcaaggaacttccatgcctctaacactcatcttcaagaatgactggtgacttgctgagcatgtcctctacttcttgaatgatgcgtattctctgtgagcttgatacctcctgttgatcttgcaatgaaactgtggctgtgtcttaacgctatattggtcgactggtatttgccctgcgtacatgcgtgctgagtgacatgtctcacatgccagaacgaaattgtgtagacgcttctctctatccagctgccttacacatgtgtgtcatagtcccttgcacccctgcgacactctcgactaacttgttggttgtcttgtccgttgtctctgtgacaacttgattcaacctcacattcccctgcggacaggcggcaatcatcagctcggactccagcgaccagcgatgcccaatctgcttgcgcaacccgtccccccacgctctgcgcttgcatcgtgcggctctcagctccgcgcgtctgtcggtacacgtctgcaattcccccgtttagtcgctaaacttggccttaatcctggcatttcgcgccacaccgtggcgctttccccacactcgttgggctttcacccaaagcaaccggctcgttaacctgcctccatctcttggggagtcccttgtcacaacgccccgcgcgctgaagtcaatccccatcttcccttaccagaacaatctccccaatcagctattgcctgtgtcaagaaacccccctacagtcgggccacggaatcactcgggccaccagctctacagcgtgtgcccttcgcgctacttgcacttcatgcccccatattgcgctatcacnctcaagactattgcgggaacccgcctctggcactccccagcgacggctatgcagcacccttttggactttcagcttctggagctagcactccttcaatcaagcaaccactgtgccgcgcaaccaccagacccccccctcccacggcaagcgtgcccacgacgatgggtcgacgacccacccaccactcccaccctactaagcagcccccaccgaacaaacaaacccgatctcaccccaccacctcgacacctccggcgacacccccttgcacccactgagcacagcaccggtcgccagaacacgaccgtgtcggctcgcctatgcagcacacatgcaaaacctggccctggcgccaccacctacctgcggcactccccacaacaccctacagtcactctccaccatgtgattgatgcccccccacccaagcccatgcctacatcaacgccaccaacgcaccgcttagctcctgccagtgtcacggcactattccccccacatagacgcaacataactcccacat

SEQ ID NO: 517275 - DNA, 509 bp, Homo sapiens
agattgaggagtacgtgtgggttaattcactgtatcgcgtggggtagcaataatagtgagagccatggttccagattttatgcttactcagatttcggatactgattcaatcatcttagtattcatagcatattcagatgttttatctgtggtttagtctgggtgcatttagtgtttcttgaaaatttgcctgtcatctgggttatcgaatttttggccacacacttgctcatagtactctcttaaatcttattaatttctgtagaattgttagtaatgcccctacttttattttggtcttttgtagtatgattttctctgtgggtttccatctgtggctttggctatgttgagatagtttacttctattcccagtttgttgaatattgttcttatgaaaggatatagaattttgtcagatgctttgctgtgtcaatggagaagataactttttttccattcggttaatataatatatgaccttgatttgtctgtggagtatccgttcg

SEQ ID NO: 517276 - DNA, 232 bp, Homo sapiens
gtattttcagtttgtttgtttttgtcacccaggttggagtgaagtagtaagccgagatcataccatttcactccagcctgggcgacagagtgagacactgtcaaaaaaaaaaaaaaaaaaaaggaaaaaaaagttctccaaattgtgggctaatttttggggggtttctccctttttttttttccaaaatttttaaaattattacctttcttatgggcgttgaaattggtcc

SEQ ID NO: 517277 - DNA, 713 bp, Homo sapiens
taactgcgccagaggtctgtgcgcgcgcacacccggcacctgcccgagcccagtgtagtgagtgccatgatgattcctgatgtgtgtgagtgagctggtagtggcggctgtgagtgagtgtgggcgtgcgtggtgtggtgtggctggggtgcggtgatgcgctccccgtgcccctctagccccgtggtggtacaactgcgaagtgtgtggtgaatgtgccgcgataaacctggaactgcagcccgagcggacacctccggcttcacttccgtaagagtgagagtgagtgtacggcaatgggtcctgggaactgtgaacttggccctgcctcgtttgtgagctgagctcagcggaacgctatttgtggcgtcactgcactgttaccccagcacctacgtgtctctgacgctgacaccttctcactgtgaaactgtcgctgagctgtgacgtctggggtggcgcctcaaatcgttccagctccaggcatcggatcccggaaaggcagcgtcggagactggacccaaaactcttcactgtactgccatgcagagttgagccccgtccagggtcctggagccggacgtagtacttgaccgctgagatcacctgtatcaactgcgattctcgagatcacccgacgcatcacatgtctggagccccagggaatgaccggtgcatacttccagcccaggagggcctacatcatcagtgag

SEQ ID NO: 517278 - DNA, 232 bp, Homo sapiens
gtgtgcacctgtaatcccagctacttaggaggctgaggcaggagaatcgcttgaacccgggagacataggttgcagtgagccgagactgcaccactgcactccagcctaggtgacagagtgagactccatctctaaaaataataataaataaataatgacatcactttggtcagagctctaaaatggaggaggaggcattctaaaaggactcctacatgacctgcacttgaa

SEQ ID NO: 517279 - DNA, 923 bp, Homo sapiens
  misc_feature (22)..(22): n is a, c, g, or t
  misc_feature (283)..(283): n is a, c, g, or t
  misc_feature (304)..(304): n is a, c, g, or t
  misc_feature (320)..(320): n is a, c, g, or t
  misc_feature (342)..(342): n is a, c, g, or t
  misc_feature (344)..(344): n is a, c, g, or t
  misc_feature (349)..(350): n is a, c, g, or t
  misc_feature (352)..(353): n is a, c, g, or t
  misc_feature (356)..(357): n is a, c, g, or t
  misc_feature (361)..(361): n is a, c, g, or t
  misc_feature (363)..(363): n is a, c, g, or t
  misc_feature (374)..(374): n is a, c, g, or t
  misc_feature (394)..(395): n is a, c, g, or t
  misc_feature (399)..(399): n is a, c, g, or t
  misc_feature (424)..(424): n is a, c, g, or t
  misc_feature (440)..(440): n is a, c, g, or t
  misc_feature (448)..(448): n is a, c, g, or t
  misc_feature (450)..(450): n is a, c, g, or t
  misc_feature (465)..(465): n is a, c, g, or t
  misc_feature (503)..(503): n is a, c, g, or t
taagtgtttagcagcagctttnatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggctttgcccgaggcttcttcaagaagggagatgtggtcattgtgctgaccggatgntccctggctccggcttcaccnacaccatgcgtgttgntcctgtgccgtgatggaccctnanagccnntnntanncccntntcccacccccntccccgcacccatccattannccancaacgcttgtagaactcactctggnctgtaacgtggcactngtaggttngnacaccagggaataanatcaacgcctcactgaaacatggctgtgtttgcagccngctctagtgggacagcccagagcctggctgcccatcatgtgccccacccaatcaagggaagaaggaggaatgctggactggaggcccctggagccagatggcaagagggtgacagcttcctttcctgtgtgtactctgtccagcttcctctagaaaaaatggatgcccagaggactcccaaccctggcattggggttcaatgaaacagccagcaagagttaggggccgttagggcactgggcatgattgttccaattgaagccgactctggcctggcccttacttgctatctctagctctctaggcctcatccagtttgcaccatgtccccaccctccacatcagctgtcctgcagcaaacactccaccctccaccttccattttcccccaatactgcagcacctcacaggccatgttgc

SEQ ID NO: 517280 - DNA, 304 bp, Homo sapiens
  misc_feature (273)..(273): n is a, c, g, or t
gactctagaggcatcccgattctggccacgcagtgggcatcccatgtaggcagaagctccctgaagctgggagcagggcagcccttggtcctctcctagaggaactggaacgcaggaaggctccaacttcagtcccatcttaacatttagacctcttcctggctggcatgatcatcatcagaccacagatctcagggatgagaggtgctcaccccagaacacggcagcagagagcagacacatgggcagagtgtgatggcggtgctattcccnacatgggcagacacttcacgagctacacgca

SEQ ID NO: 517281 - DNA, 101 bp, Homo sapiens
atataagggtgaattacatgccagaggtgaatttctgaaatacaaggaaatttctctcaagtagttcattcacataaggggcaacatcagcatagtttcca

SEQ ID NO: 517282 - DNA, 103 bp, Homo sapiens
ccccccccccccccaattggggtgccaaattttccggtttgccccggggtattataaaaaattttttgtttgaataatgaaaattaaacccccctcgtggcca

SEQ ID NO: 517283 - DNA, 335 bp, Homo sapiens
  misc_feature (204)..(204): n is a, c, g, or t
ggggccggatggtgcaaatagagtaaaactaaaaggtgagaaactagaaaaccaatactagctattccagaaaactaaaactaaaggatgcttgaaaaatagtctttagcaagataaagcagagtgacctatagacaagaccagagatagttttttctcccatgtaggagcccctgaaggtctggtgattaagagtggcaatanggggtctagagaagtctcactggatgacgtgcttcatacaatttttgcatgcagtctcgtatgactagtgcatcctcatatggcattacatgtctctctctagctgtggacggtgtccttcaggtacaact

SEQ ID NO: 517284 - DNA, 91 bp, Homo sapiens
catgggtggccattaagctttataaaatcatgtgggctttcaaattgttcttttatgtgtctagcaagtatttaataatcccttgtatagt

SEQ ID NO: 517285 - DNA, 727 bp, Homo sapiens
ctcaggtggccggcagtggcgtgcctggtgccctttctcctcttccgcctctgttgctccctttggtcctctggggcctcagagaggcaggtcctaaggagggggggtctcctgggggcagaccgagggtctcggaggatagaactgagaggtttccagggctggcagcagctgctgctgcgctgctgtgctgtgcaggaaggctttcgctttcaacacaacatgaacgatacaagaggcagctaggcaccctgcggcttgcgaacccaggggagcagactgcgggggcctgtagcccctgacactcgcgaatcgtcccgccaaaaaacagcaggggcagcaagagaccgacaacgaagggacgagagggaggaaagcaacgggcccgaaacgacaaagagaggacagaccacacgacaacaaacggcggggagagagccgcgaacccaaaacaacggacgacccgcacaagacagaacaaaaggagcaacggccgcagggaacgaggcaaagctcggcataaggagagggaacaaataaacgagcagattcagcggaccgaaaagagacgaccagactgtagtgcgcaaaagcacaaaacagcaacaacaggccagaaacacgcggccagggaggacaaagagagagcggaatacgagaaagaagggaaaaggacaaaaagggacggacaacgagaacaccaaacgatgagaaaaaacaaaaggag

SEQ ID NO: 517286 - DNA, 338 bp, Homo sapiens
  misc_feature (103)..(103): n is a, c, g, or t
  misc_feature (174)..(174): n is a, c, g, or t
  misc_feature (288)..(288): n is a, c, g, or t
  misc_feature (318)..(318): n is a, c, g, or t
aaacccacacaaagacaggctaaattatgtagacagtttactccacagtgagcttgggaaggtatcagactgttcaaaatgttagtattacaagagctgtctntaaatgcagcattaacactgccctctaattttacaaaagtattttaaaggatcaaaagggcggataacttnttggaatagaagatcctgttaccttaaaccattattttcttcacctggttatatatcaatgtgccttcaattaccctttctctgtggaggtgatgaacaaagcttttaagttgntctcctcccattattggagatgatcctttncccttctctccctgcctccc

SEQ ID NO: 517287 - DNA, 938 bp, Homo sapiens
  misc_feature (194)..(194): n is a, c, g, or t
  misc_feature (206)..(206): n is a, c, g, or t
  misc_feature (283)..(283): n is a, c, g, or t
  misc_feature (396)..(397): n is a, c, g, or t
  misc_feature (530)..(530): n is a, c, g, or t
  misc_feature (532)..(532): n is a, c, g, or t
  misc_feature (699)..(699): n is a, c, g, or t
catcgacgaatacattggaaatggtggtgaacggttttggaaaagctacaggcttccagcagacccaaagccactggtggttttgggcaagacgggtcctggatggtacacagcttggattggaaattccactggctccacttggatacggttaattcagcaaaccccaagggaatgggctggtcccccatccntccatggtgggntggtggtgggagactccagacctggtggttggtggtggggagagtttatataaacgtggtctcccccagaatctggnaaaacaacaaacaaaaacaacaaaaacaaaacaaacaaaaacaaacaaaacaacaaacaaaaacaaaaaacaaacaacaaaacaaacaacaacaaacaaaaaacactcggagnngggggcggccgcggggtaaccccaacttcgggcccctaatagtgtggaggtccggttattcaccaaattccacgtggggccggtcgcgtatttcaccaacggtcggtggcacgtggggacaacaccgcgtggngnggttacccccaacgtgtaagtccgccattggcagacaacaatccccccttatttccgccaggacgggggaggtaaatacgccgaacgagggggcccggcacccggaattgcgccctatccccaaaaaaggttgggggccaacacctgagaagggggggaaattggcncgaacttggtaaaggcggtctaacactttctgggttaacaaattccggggtatcacattttctgggtgacactcaaggtcccatatttttaacccaatatggggccgaaaatgggggaaagatccccttatatagtccagacgaaatagaccggcaaatagggcgtcagcggttggtccccgggtgggggacaccgaggtccccctaatagggtgtggcccccagggtgagggggggcg

SEQ ID NO: 517288 - DNA, 247 bp, Homo sapiens
tgacatcagcaaggtgatccagtgcgcctatgacatcagccaaggcatgccaagcagctggatcacatcaacacccgcagagaagaagcagtgacctctctccccacaccctcacctgcaccctaggacctcactggacataggagctgggccactccagacattaatccccaccccaacagagccactggcacaagtgcccttagtgcatgacacactccctggcagccaggtgccctggtgacca

SEQ ID NO: 517289 - DNA, 840 bp, Homo sapiens
tcttggtgcaacacttaatggggaaagatttacacacggtgacctgtcataggccaagcgatgagaagagggcgccaggagtgctggggtcccgaggtggctcaaatggaagccatggaacggccgtcccaaggcccggcggacacccgtcacctcagttctccccgttgggtgaaattgggaagctatatgctctccttccaagtcgtgcaatatgggtgtgcgagttgagctaaaaggtggagcgaaagtacacagggaagaggcttcccactcccaggaccgggcccccaagctcgcgaccccacatgggtggattgcaaagaaagggaattgggcccaaaacccatcgttgccgaggggccccttgccgtttgggggaagtgcaagtgctctctggatacccaaaagctgggagcagggcgccagtgactctggtctgggacaatcacttggatttggtaggagtggaggtggcctctgggcagagggcagggaggacacccccgggtctgctctcagttcgcaggcaagggtattaacgctggggaagaggaaattctctccaggaccctctccaaggtaaggaccctcttctggggaggaagacagcacgcctggttcacagaatccgggggaccagctggcagaagggagcgtccggacagttactcctcccggaactcctcggggcaaggtggggggctggatgtcgcttcggctgggttgccccactaaagcagccagcccaggttgccggccagaaggttcagaagttatggggccaacaaggtgtcgccagaaaaagcgaagcagcacatgtgaaagggctctcagaca

SEQ ID NO: 517290 - DNA, 343 bp, Homo sapiens
atcgctcatcgttaacggacgtgtcatgactctactccctacataatacctttattgtgacttctatcaggcctcgctaacctcgccttatcctccaatattaacttactgcgagaactctctgtgctaggcaccacgttctcctgatcatatatcacgctcctacttacaggactcaacatactagtcatagctttttcctgttttaaaatatttaccacaacacaatggggctcactcacccaccacattgaagcaacataaaaccctcattcacacgagaaaacagcctcatgtgcatacacctatcccccattctcctccacgcaaagtagtaattcct

SEQ ID NO: 517291 - DNA, 233 bp, Homo sapiens
tctcctgcctcagtctcctgtgtagctgggattacaggagtgagccactgcacctggctactttttgtatttttagtagacatggtgagccactgcacctgcccccatttccttctaatctgtatcttttgcattatttccctgccaaaatttcttgagtaaagcccatttccctagcgcagcatctgaggtgggcagtgcacacagcacagcagcctagggtactctgccct

SEQ ID NO: 517292 - DNA, 225 bp, Homo sapiens
tttattatcaggaactttatttttaaacttattacaggtacccaaagttcaaaagggtaatttttaccaaaatgagaacctcaacagccatagctgaatatttgctgcttattcttgtggccaaagaggaattctactaaatgtcaaatgaaggatgtctctaaactagaagacatgttaaagggccttgttgtcatttctgtcattgtagtgttggggataaca

SEQ ID NO: 517293 - DNA, 1234 bp, Homo sapiens
ggcggatgatgagaaggtggcggccggatgggatactggcatgatcccgctagactcgaggacctgagctgtacgtgactatcaaactcactatcgactgaaacgtcgtgccacggtgtgggagtctgcgtgctacccgggaacaggggagttatctgcgtcggtcaatagagagagtggcgaggtgtgaggcacttggcccagggatcaacagacgtgctccgcaacactgcctgtggttgtgtgccacagcaccagctcacgaggcgtgtcctatccgtccctgagcaggccaggtacactaatcacctcgtgtacgcaccggtaggaggcccatgggtaggcctgagtcgcatgggtatacctctccgaggacatactcatgagatcggtgacgaccggaaggatcatattgatcgtcatcgtaggtgacatcatacgggttcagacgaactgcatggcatcatgtaccaaatgggccaggagggacgtaacctaggggatgtcactatcacgtacagaaggatcacgaagtacatcaatacgcatttgtacaagaccggcactcagattcaggcagacatgttgaggaacggggaggacgaatgtagtccggggtcgcccggtagttaccaccagggtagtgtccctggctaggtccacaatttactccaattacgtactcgtcgatcgttgaaagttgaacggtggtcgggggaaagtccgcagtgacctgggccctctgttgagacacggacaaaggggcgagactcatcgcacggagtttcaaggatctggacccttatgacaccagaacaaggcctacccgttgggacacagagattcacacactctagattcgcaacttgaccaaccccgatctctacatgattgctttagggaccgggccacgatctcagaatgagaggcccgcaatttgtggtatatcgtaagattttaagggcccagctgacttttctcttgcgtagggttttccaagttgcaggtcaagaaattgggtgagaaaccgagcttcctagttgccggggaccgcgaagagaccacattgggtgggccctaccttggcaagccgagacttttgttagacaaaggcgaacgccgcttttaccaccacgcgccctagattttgaaagaggccgctaggaaaaatcaatcttgtaaacacaggggctcagcagggaaacacatcaagctcaacagaggggctctctaa

SEQ ID NO: 517294 - DNA, 472 bp, Homo sapiens
gcacgagatttatattgacaatgtattctaacgtacacaagttcactaagagttgtgtaataaagaaataaatctactgtagtcaatataaacatcacgatgtcaagtcagtaaactaaacagagagatgagatttcactgaaaataccacttcagtaattctgatggagtctaaggacaaacttttctgtctttaaaaaaaaaaaaattcatgaattttcactaacgattatcaagaaatatttcaatactgacctaaatagaattctgggggaaaaaagcaaatagcacatttatatttaagtaccttttaaacaaaaatatttaaactggtttgatataatttcaaattatatggtaatgcttttctaaagaagtaaacttctgagttttttcctagtaagtgaaaccaagttctagactaggtaaacacagagctgtccaaaaaggaattggatgttcttaacaaaca

SEQ ID NO: 517295 - DNA, 772 bp, Homo sapiens
  misc_feature (72)..(72): n is a, c, g, or t
atggggcccgggtccatggggtttcaaaagttggaagaaacccgggggcttgcggtttttaagcttccgganatttgggctcataaaactctaggttaagtttccaagtaaaaaccctactgggttcagctccccatagaaacccaagctccgtcaaagttgggatgcgccttggatagattaaaaaggcccagtggacggttggttttaaaagtgccagtgtgggattttagggcctttgcgggccctccgatcaaaggagggaaaactgttttgggggttttgttttttttggttttaaagcaattggctttttcttggaaagtaattttcctatggcatgttaactggggcccatcgggtaacctgtttggtgagcaacccacaattgggatgagttctagggacatgggtttgctgactttggggtaaaccactttgttataatacagtttttgccccaaatgcatgtgacctcttcaagggcccaaagtggcttaagaaggaaaacttccaactgggcctgggggttccaaacagtcattcccgggttaaatgattcgcagcctagggcatcaaagccccgcctccccaaagacttaaatcagagctttgtcctggtatgataaaattcctttgcctggaaaaagaaatgcttaaaaccagtgtttaaaatttttgggccgatgacccaagccattggcttggcccaaaaaaggtaagggaaattaacctttttccaaatggtaaaaagaaagtaaaaaacaaaaca

SEQ ID NO: 517296 - DNA, 384 bp, Homo sapiens
  misc_feature (241)..(242): n is a, c, g, or t
  misc_feature (352)..(353): n is a, c, g, or t
cgaggcagcatgattgttacaatgttgtgagaaaatgctgattgttgcagtgcatgcaatggttgtccctgcactaccatgagatgtggccattcacatgccttttccacctttaatgtggaattgcggaacaaatggctacgtgggaacttgcttttattgtcatgcattgccactccatgtgaccccctgtgacttcaatgccacctgaaccacatcatgatgtgcaccacatgatgcnnccccctcatgccttgacatgggcctccctgcatgtggcagacatgatgcctcatgcctcatgctgcatgggatggcaactgatgaatccaatgactgccccatgcctgcnntctcctcacatgtctctgtggcccctggggt

SEQ ID NO: 517297 - DNA, 1011 bp, Homo sapiens
tccactactggtgtgttcacgtacgtatatctagaggcttaacatgacattctgaagtagaagatgtgaaaatgtgtgccttgctttgtgatcgacaacaagacatctgttcgcctgtctgatgtgacataggatattggaccacatgacacgatttgctcattactgatctcctgtattactccgattgtccgtgctcctcatggttccgaagtaacgtctagtgtactcggtggccaatgaactatagcgagatttattgcaccagcataccttgtcatcatgctggggaccctactcagtgttgggcgacgcataggttacgttaaaaactcacgtgtttcgtacaaggttgaattgcccagacacaaccttgggagcatactctaaatatgggtcgtgagatctcaatagggacgaatgtggcacgaacgtgcccctgagggcataggaacctactttgagtcgttgcgtctggccgacagcactcaatgtggattctttgtgccttttagggtgtacttcgcttgaagttacccgggtccaaggggtggagctcgagtctcgtttttcaagtgagtggcctaggaggtgggtccctagtaggtgacctaggaccacttggttgatcttgaccgaccatgttgtcccttaggagtcaagaccccttggggggctatcatgtgtgtcccctttacccctttaggttgctatggttggcacgggcgctctcgagcaagagggctgctgcacggctcacggctcgatgatcaacctgcaatgtattgctgcagagtggtccggaggacggtgccgtggacgctttggtctaccactggaggggtttggtctccgcgttggggagccttggttccccgaattggaggattccccattagtgttggcccagaggttgcccggtcccctcgcctgggttggcacggcctcggcgggtccccgcgggacattggggcccgcccctgttccggcttttggcggcaacatcttctc

SEQ ID NO: 517298 - DNA, 127 bp, Homo sapiens
tgagcttgcgttgtggcatgtgcctattatcccagctactcaaggcaggagagttgcttgaacccgggctgagatatgcaccactgcactccagcctggtgtgacagggcaagactccgtctcaaac

SEQ ID NO: 517299 - DNA, 483 bp, Homo sapiens
  misc_feature (22)..(22): n is a, c, g, or t
  misc_feature (53)..(53): n is a, c, g, or t
  misc_feature (464)..(464): n is a, c, g, or t
  misc_feature (475)..(475): n is a, c, g, or t
ggcggatcacccgaggtcgggngttcgagaccagcctgaccaacacggtgaancctgtctctaaaaaattagccggcgtggtggcacatgcctgtaatcccagctactcgggaggctgaggcaggagaatcgcttgaacccagaggtagaggtcgcggtgagccaatatcgcgccaatgcactccagcctgggccacaagagcgaaactccgtctccaaaaaaaaaaaaaagaaaaaaaggattcatgacctaattacttctacctgcttagccatctgcgtgatccatctttccatcatggtttcaagcaagtcttattattctgttgctttttttcctacagcagtatttcaatgctgtcacacaggttaactctcccagctctatttgggaagtctgtattaggacaggcaacaaggcaacaacagacttattcactggactacattttcccgggtttttnccaggcattanttaaattc

SEQ ID NO: 517300 - DNA, 374 bp, Homo sapiens
  misc_feature (101)..(101): n is a, c, g, or t
  misc_feature (110)..(110): n is a, c, g, or t
  misc_feature (116)..(116): n is a, c, g, or t
  misc_feature (143)..(143): n is a, c, g, or t
  misc_feature (164)..(164): n is a, c, g, or t
  misc_feature (269)..(269): n is a, c, g, or t
  misc_feature (323)..(323): n is a, c, g, or t
  misc_feature (366)..(366): n is a, c, g, or t
aatgaaagtttgcccaaacccaaggttgaaaacatttactgggttaataaagaaaagaaaacccaatagaaaagaataagagcccaggagtggtctctcanacctgtaancctaanactttgggaggccgaggtgggcggatnaccacctgaggtcaggagttnaagaccagcctggccaacatggtgaaaccctgtctctattaaaatacaaaaattagccgggcatgatggcaggtgcctgtaatcccagctactcaggaggctganacgggagaattgcttaaacctggaagacggaggttgcagtgagccaagatcgcntttactacactcccagcctgggtggctgagtgagactctgtcncaaaaaaa

SEQ ID NO: 517301 - DNA, 303 bp, Homo sapiens
gactctaaaggatccctgtgggtacacataaatctgtttccttctttgcttccctgtgtgtaatattactttttgctctggctgctatttaagatttctctcttgctaggcttgaactgtttatgatgtgcattggtgtggtttactttatgtttcgtgtgctagacattgcgttgagcttcttggatctgtgtgcttacagaaatcatcagtttagaaagctctcagccattacttatgtaaatattttttctgcctccttctccttaacatataattatctgcttattagaccattttatg

SEQ ID NO: 517302 - DNA, 173 bp, Homo sapiens
gttatgcccagaaatggggtcatgcatgtggacgagtgtgtggactttcacagattgtggagtgccatgcagtttgtctactgcattcccgtgggacacacgagttcacagtcgagcagtgctttggtaatgggctacactgggctggctgtatgatcatcgcacttcgtggg

SEQ ID NO: 517303 - DNA, 265 bp, Homo sapiens
gctgtgactggtcccagtgacttactacgttattggttgctgtgggtctggtcgggcctggatgctcgaagggagttatattttctctcctattgcatcccaggtggggagggagggaggtttcagactccagtttctcccttgcgcttttattcccacgcctccttggccccagtatgagtgtagggaactctctgccagcttcctgagttctgcctaaagatggcccccagcactggttggggacaagggccaaattggtgac

SEQ ID NO: 517304 - DNA, 868 bp, Homo sapiens
ccggttcggatggtgcccacccccttttatgagtggtctcccccccgccataaaccctttgtgggtgccttcttttcggaagggtgacccccgcgatgttgtcgttagtttggggggctctctcctcgacttatatacagggaggcacggtctccatctctcgtctggttggaccgcccacaatagatttcttggtggttcccgccgcaccccgccttcggtagggagatattgaacgccccctctcgcgggatgagtgatgctttctcgcgggcggaccgtgggttgttcagagccacgccgcggttcgctctcggttcggcacccaccattcagtccccaccccagcgtgggtccccccccgggaggagcctcactagatatcacgcccaccaccccctgtgggcttccccccccagatgacggtgtggctatattcccacagagatggttttgtttttctcccgacttaacccccgcacaggggccacattttttgtctgtcgcccagcagatgtgtttcacaccagccaccacgtgtatagcttgtgtgtggtccacacacatgtgggcctcccctcactacctcgcccccgcgtggacaccgcctgtttggtttgtcccacagttcctcccacagcggggccacacgccacaccacgcggcctgtgtgtgtgaggatcacacccacactggggaagctacaagatgcacacggagctgctttgttaaacttacattttataacgctgtgtacccccgcaggctgtttttcttccgcggaaagttgtgcgacccacgcccctttggggggcggtgggcacccgccccacacatattctgatccgccttcgcggcgatcatgatc

SEQ ID NO: 517305 - DNA, 160 bp, Homo sapiens
cttgctggagctgtcagagggagaggaagatgatggtaatgtaaattacacagaggaggagattgattgactgttgaagggaggatgcccatcatatgagcagtctccttggggaagatcatggtgggacattttgagaagggagaaagagggattaaaa

SEQ ID NO: 517306 - DNA, 143 bp, Homo sapiens
  misc_feature (80)..(80): n is a, c, g, or t
agaaggagacaaaacacctcctctgtaatagtacctcgaatggattcagctttactcctctataactcatcttcacaccngcatatttaaacaaactaacaaaatgaaatactaatagtaaaaaggctgacccatgtggcttt

SEQ ID NO: 517307 - DNA, 405 bp, Homo sapiens
gagagagagagctactctgaagatgacgaagactatttatgcagtgaacaagcatcattagcatgtggcactatgcttctcatcttggccagcccgactattggcttgatggagactctcgaacattgtatcctatgcactaccaatgactgcgaagacaactcggcagactctgatggctgagatgaacgactgtccgggtccatagccctactattgttcccatgaccagcctcttataatctgagccagtccagggagatcaataacactctcaacttgtgtatacgcagagctttcattatgaacaactgagactacctaattcccaattatggaacttcattcgactagaggccctcggaggctgtacttgtacacatatgcacgtcgatgtctggcggc

SEQ ID NO: 517308 - DNA, 311 bp, Homo sapiens
aaaaaagggcatatagtatgctctgttagtaaaagttctatggtttgataacaaataaccaacctcagtgattagttgtgctactaaaaagtaatatagttgagtgtggtggctcacacctgtaatcctaacactttgggaggccgaggcgagaggatcacttgagtccagcagttagagaccagcctgggcaacacagcaagaccccatctctacaagaaatacaaagcttagccaggcctggcagcacatgcctatagtcccagctactctggaggctgaggtaggaagatcacctgaacccagggaag

SEQ ID NO: 517309 - DNA, 200 bp, Homo sapiens
ttttatttatattatgtatatatatttatatatatgtatagatattgtgtacatattttatatatttatatacatatttatgtatatatatatttatatattatgtgtatatatatttatgaatatttatgtatattatgtatatatgtatatatatttatattcttccatctgtattcacttaagtgggtagtcacaga

SEQ ID NO: 517310 - DNA, 112 bp, Homo sapiens
ccccccccgcgggggggggggttttttgggggggggggggggggggggggggtggggttccccccttttttttcccccccccccccccaaaattttttttttggggggccca

SEQ ID NO: 517311 - DNA, 361 bp, Homo sapiens
ggcccttttgaaaaatgaattttttgataaaaagaatttttgttttagccccggtgaggcccataaggggttttcaaatttgggggataaactgggtttaaacctttgggacaaagttgggttcccttccttttctggggaaggtagcttcccctcccttccaggtttttaaaccatttgccctagggaaagcccttttaaaagttccttttgaaattttttccttttcccccagggaaaaaattgtggaataagtagtttttttgaaaactggtggggttttggccttccttggaaattgaaagggggtccccttcctgtccaaaatgttggttttttttaaataaaatggttttgccta

SEQ ID NO: 517312 - DNA, 943 bp, Homo sapiens
  misc_feature (553)..(553): n is a, c, g, or t
  misc_feature (648)..(648): n is a, c, g, or t
  misc_feature (656)..(657): n is a, c, g, or t
  misc_feature (667)..(667): n is a, c, g, or t
  misc_feature (673)..(673): n is a, c, g, or t
  misc_feature (681)..(681): n is a, c, g, or t
  misc_feature (688)..(688): n is a, c, g, or t
  misc_feature (692)..(692): n is a, c, g, or t
  misc_feature (696)..(696): n is a, c, g, or t
  misc_feature (699)..(699): n is a, c, g, or t
  misc_feature (701)..(701): n is a, c, g, or t
cagaagaagggaaggcgcgagtgaggaaaggaggtactgtagctacacttctggaaaattcagtatggacagtctccgacttaggatttttcaactttaggatggtgtgaaagagacacccattcagtagaaactgtacttcgagttttgcattttgatcttttcctggcctagtgataatgtggtacagtacactcttgtgatgctgggcagcggcagcgagccacagctcccagtcacccatgtgatcacgggaatcaacaacccatcctctaccgtgtactgtgttgtcagctttttggatattgtgttttgtgttttcacattccatcatgtctacaaaatgtccatcagtgtctcctgtttctggtgagatgaagaagaggaaggcaattactcttgaaatgaaactcaagataattgcccagcatgaaggtggcaagccagtaatggccattgcacgtgagttaggactttggaatccagatttcaaccatcttaagggataagaagcaaatcagtgatgcagcgaaatcgtcagcatcagttaatncactgtcatcacaaagaaaagggctggacaattgatgatatggaaaaattacttgtatgtggatggaagaacaagatagagaaggtatacattanctactganngatcagctanggcaanaagttttnaatatgntaanagancgngncagtgatcctacttataccaagtttaaagcacgtcagtgatggttcaggggttcaaggcggcttacttcaccagtcacgtgccgcggggcacagtaggagaggcactcaggacagcgataggatagtcaaaatcgcaccggagtgccgcaaaacaggcgagaggaaaacaggcacacaagagggtgacgggccagaaaacagcgcgaagactagaacgctttctccgctcgcacttctagct

SEQ ID NO: 517313 - DNA, 456 bp, Homo sapiens
  misc_feature (44)..(44): n is a, c, g, or t
  misc_feature (374)..(374): n is a, c, g, or t
  misc_feature (399)..(399): n is a, c, g, or t
  misc_feature (403)..(403): n is a, c, g, or t
  misc_feature (430)..(430): n is a, c, g, or t
agtaaataccccgggctcataccgctgtgcctgctccgaagttntcactggtgatggctttacctgctcagatgttgatgagtgtgcagaaaacataaacctctgtgagaacggacagtgccttaatgtcccgggtgcatatcgctgcgagtgtgagatgggcttcactccagcctcagacagcagatcctgccaaggtgggtcaccagggattccaactcattttcaagttggatcaaccacagtaaatgaaaccacaacaagggctggaacaagctccacctgggaaggcaggaattacattaggcacatgcttgcactattaaaagttcatttcgttttaagcgtgggatttttttttggccggaatggantaattgatggatgggcgggttttcntctntttatggaagtttttcccggggcccangagccattagtttgggagttttggat

SEQ ID NO: 517314 - DNA, 623 bp, Homo sapiens
actagataacggatacacagaccgtcctgcaataaacgctataataaaggttgcaacatacatgccgctaatcctgcatcctttcctacaatcattataactcgcctatacaatcctgcttcttataggatgaacacctagcaaaacaatataaatttgctgaaaaacaaaattacaaacaaatgacagaacttaacagaacacacagcattaaaaggactaggaagagcaaggtcttaatacccagtacaataaagccaagaattttctaatgctgaccagtctgaagactgaaattaaatatcagttctttttacttctctaggagtgattctagctcctcttgcacagagctgagttgctccttttctcggtcttcctttagttagagctcatccagtacagcctgaaatctgttcttgagagccagattttccacttacatgatgagatcctcttgtcgtttcgccctgtcctgggtctcttggagcttgccattcatgttgtcaatctgcttctgaattcccataaccagctgattggttccttcattttcctggtgctgttcatctgattcatttagcttgtactgtagctgtctctccagatcttcctccgtgtca

SEQ ID NO: 517315 - DNA, 805 bp, Homo sapiens
ggtcttcgcagatagacggacagaggagtcgtagcggtcgagggttgtgtggctccgagtgtgccggtagagtatgtttatgcataataagtggataattttacatgatacaatgactagatggcgccaattcgtttaagagcgagaagtacataaaacgtttattaaaaatctgtggtatcttgtgacggagcctatccaaagaggagcatgacatattttaacacaagggcgtagatgaacattttccttaatcataataagatgtgaggaatccatgagaagatcaaatgaactttatggacagggcgaagtatgtaatgaaaagaggtagaagggttgtagcttccggttagggaaagtacagaggtatgaagacaacgttgtattattcagatgccatacgagtagactagtgtgagtcagtttagtacttttaatttagctatcaggtgccagcgtgtttatgtataccagatgtcgggaaataatgctaagttaaaggtgggaagatatacattgttgtgtaaaaaattcctgaagtggcctaatgaaactaaaggtaaggtttcaatttcctagttccataaccgggaggacaagtatcaggcacttttatgctcagtttggttaaggaacattgcgaaatacggttatatttaaccggtgattactgaagtgcggccccctttggagtggcaccatagtcacttatccctatagtgaaggggttcacccaaatttgcgcgtttcccctttctggcgaagcctccagcgttacccaattcaaccgccctcaacgagg

SEQ ID NO: 517316 - DNA, 342 bp, Homo sapiens
  misc_feature (76)..(76): n is a, c, g, or t
  misc_feature (112)..(112): n is a, c, g, or t
  misc_feature (151)..(151): n is a, c, g, or t
  misc_feature (173)..(174): n is a, c, g, or t
  misc_feature (336)..(336): n is a, c, g, or t
ccccagaaagcaaaatttaagatgtaccacaccttggaggctggcccgtggcggcttacaccctctaattcccagnacccttgggaggatgaggcgggaggatggcccgaancccaggggtttgagacccagtctgggaaggatggagaanccctgtctctacaaaaaatttnnaagttagccgggcatggtggtgcatgcctatagtcccagctactcgggaggctgaggcaggaggatcacctgagcccaggaattcgaggtggcagtgagctgtgatcttgccaccacactcccactccagcctcagcaacaaagcgagaaagtgagaccctntattaa

SEQ ID NO: 517317 - DNA, 248 bp, Homo sapiens
agaggattcgcatcccggttctgggtattcggggtaagatctgccctcctggcgggcacggtggctgacggctgtaatcccagcactttgggaggcgaggcgcgtggatcacgaggacaggagatcgagaccatcctggctaacatggtgaaaccccgtctccagtaaaatacaaaaaattagcagtgcgtggtggcgggcgcctgtagtctcagctactcgggaagctgaggcagtggaatcgcttg

SEQ ID NO: 517318 - DNA, 523 bp, Homo sapiens
gaggatccatgagtgttcttcagacttgcgtgcttggtctccttcatcctcatcttcacagatatcagtcttttgtcctttatacgtcttctttatcttcttcatcctcatcatcttcatccccttggtcatcactgtcatcgtcatcatcatcgtcataatcacagtatcctcccttccttctacgcttgcatcctggagtgggtgtgccacgggatgctgctctgctcccagatcaatgccaggctgaagtgtctctttagcctgttttcttagcatgaatgattctgagcttgcggagttgaccttctaccatccatttatctctcctcaagtcgtcatataatcaatgtccttgtcgatatcactgagcatacacatgctgcatgccggttcatcgatcaggtacgccaggactgaagcttcctagtgctgacgtgagggcctgaaaagcttgggtctgcagactatcagtaggctcagtttgtccacagtggacttccataaatatctgtaaaatctc

SEQ ID NO: 517319 - DNA, 904 bp, Homo sapiens
gaggtttctcgtgcctgaagaagcgtcatacgagaccggtttgttttcgcgtggcccatgtgtccccggatgcttgtgtgcgagtacatgatgagcaccgtcggtaatgctggtaggcacgctggtacttgacagagaggatggcgctgtcgacctactaggtctcccatgaggaagcagatagagcggaaggctccccgtggcgtttctgaaagcagagtctctcaagctgatgatgaagcgctccagacttcgtcgtggacgaacagagttggtggatttattggtccatcgtgaactgtccgacgtggtttgtccatcgatttagccatagagcagtcctggacaaacgcttgtgcagcagtacgtgtagagtcgttatccacatgagcatgtactggccgtcgcgaaaggtaacttcttaagacagagcagaggttagaagtcatgagaccatattcttgaacaggttatgatgcattcttgagggtgggtaacagatcataatggaccattttttacaacgatctagtcaatatgggattattactagtattggctatcacctaaattgtcgcgtgttaaccaaaatggacttcctttttggaggccaccctacagcccagaaagagatttgaggacacttcgttgggggaccgcccggcccctaatttaaggaaccacatctggggtgacaaatcccctgatgtaccagttaagcaatacccggtgcgcaaatatacattggtgtcgggaggtgttcgaccacaattgaatggaagcccccgggggttagccatcggcgtgtgttttaaaaggaatcgcaaaatgtgagcgccgttaggggctggcaactcggctttttgaaaccacggggtcactgaggggcctgaattgaatttcg

SEQ ID NO: 517320 - DNA, 329 bp, Homo sapiens
ctttgagattgttattctgagattgtgtctttaagaattgagttcttgggccgggcacggtggctcacgcctgtaatcccagcactttgggaggctgaggcgggcggatcacctgaggtcaggagttcgagaccagcctcaacatggggaaaccccgtctctactaaaaaaaccaaattagccgggcatagtggtgcatgcttgtaatctcagctactcgggaggctgaggcaggagaattgcttgaacctgggaggcagaggttgcggtgagccgagatcgagccattggactccagcctgggcaacaagagtgaaactccctccaaa

SEQ ID NO: 517321 - DNA, 590 bp, Homo sapiens
ccttactgataaaagatgttacatctaccagagcgtattgtgaactgttgaatgttagagaatatgaacttaatgtagcaatatcgcatacccacgatttttcattttctacatactttaaaatctccaatggtgttgcacaagggttttaaaatcagctatgagctagcaattatgtctacaatgtcaccctataatcaaacaaaagaaattatattttgtaaaaagaaagtttatagaaatattattactattattattattatgtctttttaaaatgttgtatttaaaaatgtcttcttgacgcaaaatataatttcttttttgggaatgagacatgttcatgattcatgttttttcagtgctgcttttctttccagtcattgtttttattaaatatatgtgattcaaaatggttgtggggaatctgcattgagacattttctcatctccagtgtgatgatttagttggcgtgttctgccactcctgaatgatgggaaattcgtcattatatttgtgtgagtgtgtgtgtgtgtgtgcgaatctgcaaattagtgttttaataaattgtacatttaaggaaaaaaaa

SEQ ID NO: 517322 - DNA, 892 bp, Homo sapiens
  misc_feature (574)..(574): n is a, c, g, or t
  misc_feature (579)..(581): n is a, c, g, or t
  misc_feature (583)..(583): n is a, c, g, or t
  misc_feature (601)..(601): n is a, c, g, or t
  misc_feature (617)..(617): n is a, c, g, or t
  misc_feature (630)..(630): n is a, c, g, or t
  misc_feature (636)..(637): n is a, c, g, or t
  misc_feature (641)..(642): n is a, c, g, or t
  misc_feature (670)..(670): n is a, c, g, or t
  misc_feature (681)..(681): n is a, c, g, or t
  misc_feature (686)..(686): n is a, c, g, or t
ggtcactcatggtgccacctcgtgagatactgaatcccctggtcgaacgttccgtgtatactatgtcacggagcggctagcccgggccagcctgcgaagcctacacccgccaagggtatatcttttcagtcgcttgccggctgtctgatgaagatgcatggcagactggctcgcttccattcggtgtcctcgtacgtagatagaacacaagagtcccagttactgccgaaatgtggtagctattgtaacctgtaaggtctctagcatcaaattcacgctttgccaaaggtacatcattcctgtatgtggaggtccatgcctcttaagaactcttttcgaggaacatatccgcactggaaagatgtccgagcaactgacgaaagacaaggttgcgatttataagagtttccgcccaggtgacattgtcttggccaaagtgatctccttaggtgatgcacagtccaactacctgctaaccaccgccgagaacgagctgggagtggtggtagcccacagtgagtcaggtatccagatggttcccatcagctggtgtgagatgcagtgccctaagacncacannnanagaattccggaaagtagnccgagtacaacccganttcttgcagaccnaagaanncacnntttaccctatggaagggggtaagctgtncctgacgtatnacacnaagatggtgcgatcaggatgcagacacgcgcgcgacgaccgacactcacttacgagaacaatcttcaagtatacgcagtagatggacaggtttatgttatcatagcaatggagtttcattgttcagaatgagaatatcgtatctgatagaagggtacatacaaagagaacatgatggttgtgataagagccgcgtataataatgaa

SEQ ID NO: 517323 - DNA, 353 bp, Homo sapiens
agcgtggggtcaagatggacggcgctcaggttctgcttttacctgcggccagagccccattcatgccccggtgctgagcggcgccgcgagtcggcccgaggcctccggggactgccgtgccgggcgggagaccgccatggcgacctggaaaagctgatgaaggccttcgagtccctcaagtccttccagcagcagcagcagcagcagcagcagcagcagcagcagcagcagcagcagcagcagcagcagcagcagcagcaacagccgccaccgccgccgccgcgccgccgcctcctcagcttcctcagcgccgccgagggacgcgtgcgcctcagcgagcggcgcggcggcgg

SEQ ID NO: 517324 - DNA, 147 bp, Homo sapiens
catctagcgatcccgttacgcagacgtgaagtctgtgcggaggctttagtacaagtgacattgggatgataagttggaatattgagaaccaggagaggaagcacaggacgtatgtctatgtgctcatatgtcactgacagtgctggc

SEQ ID NO: 517325 - DNA, 89 bp, Homo sapiens
ccctgagatgggtagaaaagagaggtgtcgaagagaagtcctgaattacctgagagactgaaaggaaaagggtagagagaaatagtgga

SEQ ID NO: 517326 - DNA, 398 bp, Homo sapiens
cattgttgaaggcagtggcagatgttgcagtgagctgagatcacaccactgcactcgagcctgggagtgagagactgtctctaaaaaaaaaaaaaaaaaaagaaagagaggaatgaaagtccctgaacctcaggaagctcaagtccaaagaggaagaaacttaagtagtaccatttgataagtgaattgggaacgtaagtacttgatattcaaggaatacagagaaagagaatgttatacaaatttggggatggttaggaactgcttcccagaggaaatgatttctcaaacaaagtctgtagtttacatttatggttctctctttgtattgtacattctatggattttgacaaattgttttgatgacacttttccacccttatagtatagaatagtta

SEQ ID NO: 517327 - DNA, 851 bp, Homo sapiens
gacagccattgcagtactattgagctccataaaaactgtgccggggcaagtgacgagccggacgggctgtgagcgactctgtgtcctcgtctgagggaagaaataactagacatggtgcgatgcgagatcctaacgaacgacctgacgaggccaactgtcctcaatatgtcgactttgtgtgtgcaaaacttgtcgggaggagcataagaagaagcacccagatgcttcaggtccaacgttctcagagttttctagccaagtgctcagagaggtggaagacctagtgtcgtgctacgatgagaatgggcaatatttgatacgactcatggcgagaagcgggacaaggcccgttttgtaatagtagacattggcaatacgctatatccactccccaaagggggcagtacatcaaaagaagtgtctataggatcccaaatgtcacccgaagagggctcctttcggtcgcattcgttcctcgttcgtgcgtctgaggtatctgcccagcaagatcatcatgcagaaccatcgcgtggcgcatgttccatatgcgtgatcgttgtgaaggaaactgggagagtatgtggacatacatcactggttgcgagattgacaaagcagggcttatgatagagaaggctgtgaagctgaaggacgatatgcgaaaaggagtataggtagcatatcgagtctacactggaagagcctttagtgcagcaaacacaagggagttgtccatgttgaacaaaaatgcatgattgagaatggagacggacgaagatgaggccagaatgatgaagattgcgtgagggaggaggaagattgaagaagaatgcagatgggataacacgtg

SEQ ID NO: 517328 - DNA, 216 bp, Homo sapiens
gactcataggggctggggactggacggcgacaggcatccggcgtgcggcggcggcgcgtgcttcctgcgagtacgcagatctgcagccctccgctcccgcttgatcttcctcttgctgctccgtgatgccgtacagcaaggcctcggcccccggtggcctccctgtcctgtgcttccccccgggcaccatgcgctcgccccccggctacccgcgag

SEQ ID NO: 517329 - DNA, 896 bp, Homo sapiens
  misc_feature (2)..(2): n is a, c, g, or t
  misc_feature (78)..(78): n is a, c, g, or t
  misc_feature (99)..(99): n is a, c, g, or t
  misc_feature (112)..(112): n is a, c, g, or t
  misc_feature (114)..(114): n is a, c, g, or t
  misc_feature (121)..(121): n is a, c, g, or t
  misc_feature (126)..(126): n is a, c, g, or t
  misc_feature (165)..(165): n is a, c, g, or t
  misc_feature (251)..(251): n is a, c, g, or t
  misc_feature (356)..(356): n is a, c, g, or t
  misc_feature (386)..(386): n is a, c, g, or t
  misc_feature (537)..(537): n is a, c, g, or t
  misc_feature (575)..(575): n is a, c, g, or t
  misc_feature (589)..(589): n is a, c, g, or t
  misc_feature (596)..(596): n is a, c, g, or t
  misc_feature (598)..(599): n is a, c, g, or t
  misc_feature (606)..(606): n is a, c, g, or t
  misc_feature (687)..(687): n is a, c, g, or t
  misc_feature (690)..(690): n is a, c, g, or t
  misc_feature (692)..(692): n is a, c, g, or t
  misc_feature (694)..(694): n is a, c, g, or t
  misc_feature (715)..(715): n is a, c, g, or t
  misc_feature (730)..(731): n is a, c, g, or t
tngagtcacgccttggcccatggcaccagatccccatagccgggaggcccgtcagcagcgctttgcccacttcactgngctggccaatcgtctctgtgngaggagatagttnantttgctnaaacngctaccccggctatcctgcagctcagccggggaggcacncagattgcccctgctgagagaccctctgcgatcgagagtgatgctatctggagacattctcggaaggtacaaccctgggaggtgangaagtttcccctacctcaaggattatcagttataaaccgggaagactttgccaaagcagggctgcaagtggaattcgtcaaccccatcttcgagttctccagggncatgaatgagctgcaactcaatgatgccgngtgtgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccncggatgctaatgaaactggtgagcctccggaccctgancagcgtccactcangagcaantnntttgcantgcgtctgcaggacaataagctcccaccgctgctctctgagatctgggatgtgcacgaatgacgtgtctgtccccatattntcngntnttcttggccggatggctgagncctggtgctgcctcnntagaagtggacagagctgagaagggcgaaacattcctgggagctgggcaaggagatcctcccgctggcattaagacagagagtcaagacgggtaaaacaaagagaagatcaaagataagaatctagaaaataaaatacatacaaaaaaaatacacatccgtgggg

SEQ ID NO: 517330 - DNA, 107 bp, Homo sapiens
gggggcccccgggttttttttcccccccccccccccccccccctggggtttttttttggttttggggggggggggggaataaaaaagggggttttttgcccccggta

SEQ ID NO: 517331 - DNA, 499 bp, Homo sapiens
  misc_feature (2)..(2): n is a, c, g, or t
gntgttcaggaacatagtctgggctagaagttagtgccagtttctcaaaggttctacagatttaaaaagaaaaaaaagggctggttgcagtgcgtcacgccctgtaatcccagcactttggcggccaacgcaggctgatcacctgaggtcaggagttcaaggccagcctgaccaacatggtgaaaccccgtctctactaaaaacacataaattagccgggtgtggtgacgctcgcctgtgatcccagcagtctgggaggccaaggcaaggttgggatcacttgagggtcaggagttccaaggaccagtctggggcaaacattgggtaaaaccccatcgtcaccaaaaaacatagaaaaatgagcccaggcatggtagcatgttgccctatagtcccagctactcgggaggctgaggagggagaatcactgcaacctccgcctcctgggctccagcgatccttccacctcaggctaccaagtagctgggactacaccatg

SEQ ID NO: 517332 - DNA, 769 bp, Homo sapiens
cggtcacgagggctgtgtctcaggtgatacgtcactctgtcggtacctcgtgcaattgcccctcacagcatggctgtcgtgtctacggcaactccacaggacccagtctgcagctccagcaggtggcgctgcagcagcagcagtcaacagcagcagttccagcagcagcagccaggcggcgctacagctagcagctagcagtcagcagcaacagcagcagttccaggctcagcagagtgccattgcagcagcgagttccaatgcagtagtgcagcatgcacgcagcagctccagcagcagcagcagcagcagcagcatctaattaagagttgcatcatcaaaatcagcaactgatacagcagcagcaacagcagcttgcagacgaatagacacagctgcagctccaacaacagcaacagcagtcagcagacagcagcagtcagcagcagcagcaggcttatgcaggcccagccacaattcagcagaccaccgagtgcagcagccacagcctccggcctcccattgcttcatgccccagacagctgcagcagatgcattgacacatagcatgcgaccagcagccgtcaccaacagccccagtcagcctccgattgctcagaatcaatcatcacaactcccgccacagtccgcagacccagcctttggtgtcacgaggcgcaagtctcgctggacatgttgttcccaacacactgagtttgtcgactcgtggtggtgccagcccagtgagccagtcacacagcagacacaa

SEQ ID NO: 517333 - DNA, 200 bp, Homo sapiens
tggattatatacaagatacaactcagtcatccctcccccacgtaccctttggttacagaagcttgtatttaaagtctgtgagtctgttttgtgttgtaaataagcttatttgtggagctcccgtcatggctcggtggttaaagaatccgactaggaaccatgaggttgcaggttcgatccctggccttgctaagtggggt

SEQ ID NO: 517334 - DNA, 357 bp, Homo sapiens
cagccgcggagtctccagcgcccctcagcagatccccgctctcccgggcgccgctactcacacaggcttccagcgccacggggtcctctgtctgctgcagcggcggcggcacagagggaacggcgactgcagcccggccgcgtctcccagctccgtgcccgggacagatcggagaagcaaaggagagagacgccagctaggaggaccgcccggacgctccactccgcgcacgttgcctcggctccccatacggcggccccaggtcctttgctgccacatgatgtcgtatttataatatgtggagttgagaacatcacccagcttccccaggagcttcctcagatgatggctgcagca

SEQ ID NO: 517335 - DNA, 334 bp, Homo sapiens
ggcatcagtaggtattgtttcgatatactagtatggggataaggggtgtaggtgtgcttgtgtagagtgggcagggcattttaatcttagagcgaaagctatatcactgcgcccgttcataaggggatggcatggctaggtttatagatagttgggtggttggtgtaaatgagcgaggcaggagtccgaggaggttagttgtggcaataaaaatgattaaggatcctagcttactacaggagcatcaggttcgtcctttagtgttgtgtatggctatcatttgttttgaggttagtttgattagtcattgttgtgtattgaaccggatagcttg

SEQ ID NO: 517336 - DNA, 912 bp, Homo sapiens
cgcagtggctcacgcctgtaatcccaacactttgggaggccgaggtgggtggatcacctgaggtcaggagctcgagaccagcctggccaacatggtgaagccccatctctatcaaaaatacaaaaatttagctgggcgtggtggtgggcacctgtaatcccaggtatttgggaggctgaggcaggagaatcccttgaacccaggaggcaaaggttgcagttagctgagatcgcaccactgcactccagcctgggcaacaagagcgaaactccgtctcaaaaaaaaaaaaaccttaatgtaaaccatggacttgggggggctaacagatgtctgaatgtgggtccatcacttttaacaagtgtgtaccacttccgggggggatataatatatctggacacatacatataacctggagaaatccttccatttcggataatctaccaaatcacagattctgaacattaagttttcacatacaagggcctataggtaccacacaagatcctctttaaaggaacctactctacggtgcccaaaatggtttcacatttacagcaggtgaacccatccaaaaattacgtacagggtcaagttcccacgaagttgtggacttctcctagaagaacaaggttttatagagcgcagttataagcgtgcggacacatttcttatgagacagaacccacaaagttagtgggactagtgcccactttgtaagtacccaacaagtgaaccggggcagctgaggccaaaatacctagaggaactttacagtcttgaaacacgtccttagagggacataactcccatacaggggctaggggactcatacacctctttgcccaagaaacccctggtaggcttagaattgtcagcgtgacccaccgttagtgtcaaggtggagaaacccc

SEQ ID NO: 517337 - DNA, 349 bp, Homo sapiens
tctacaggatcttaacacgcatctaagaaaagaaactgtagtgggcagtgctcacgctgtatccagagctgaggcaggcggatcacctgaggtcaggggttcgggatcagcctgaacaaatggagaaacctactgcaatacagagttagccaggcatggtggtgcatgcctgtgctcccagctgctcaggagctgcaacaagagcaaactcagctcaaaaaaaaaaaggaaagaaaagaaagctggagctggtggcttaggccatcacccttcccttggttggaactactggacagacccttttgagatgtccctgtggtgctgtggagatgtgtgtaggggcctaagc

SEQ ID NO: 517338 - DNA, 319 bp, Homo sapiens
gctcttacagtgggacacaggaagagactcactctggtgattcacagcaaaccagtaaacaaaaacggaaataaataaagtgatagtaggggtaggggcgtaaacgggagtcatgttccccaaatcagtgcatgacagaggggtaccaaggacctagaagctagggctacacactgactacctcccatacagaacgagagtagctagaggcctaccggaacatggcgagctagtagcacactatagaccacctaacatcctagacgcagccatagcctatacatagctacctagacgcaggatagcacaaagctacaca

SEQ ID NO: 517339 - DNA, 741 bp, Homo sapiens
tgcagaagccggtgtactccgccctgcgtccctgctgcagcaacctggagctggagtcggatccctgaactgcaccctcgccatggactcgtgccctcagactgatcctgcataactggtagtgcctgatggcatgtgctggccccaccagacagcacatactgctgtgcctgcctaatccactgccctgagtggcatcgcgctggcctactggcaagcctcctgcttcataggctgcttgctagcccatacttacttactgtgcgcccgtgcgctacctgtacgctgctgccctgctgtgcgaagaatgcttcagacattgcctgaaacaatcaccagccgggatgcctgacctgcttccccatcatacgcacagctgcacactacttgtgggctctacctacttatttcaaaatattctacccaggagtacatcaacctacctgctgtccatgtatttacttacgtgctgggaatcctggccctgtcccacaccatacagccccttacatgaataagtttttatccagccagctataccaaatctgacagtaccagctgctacatcacacatgggttctggggaaaacaatggacggatgatcatcaattatgaatattgacaccaaggacctggtgtgcctgggcctgagcaagcatctgttggctgtctggtacctgctgaggaggcactggacttgccaacaacctttttggcctggcttctcccttaatggagtc

SEQ ID NO: 517340 - DNA, 149 bp, Homo sapiens
accttaaccttatgcaggaaattattagttcagcataaaaaatctgatgcactgcaagatgagaacaaaaatagagagggacttgcgagatggttattcagtgattcaaggcaattcgtcaaatatcagaactttgtgacttcactttc

SEQ ID NO: 517341 - DNA, 107 bp, Homo sapiens
gtagtctcacattcttctctatctacacatcgcacatactctgaaatcgaccacattatttgacacagactatcttgtaaactaattataataaaaactgaaatcat

SEQ ID NO: 517342 - DNA, 678 bp, Homo sapiens
  misc_feature (304)..(304): n is a, c, g, or t
caagtgacaaaaccttatcgtgtcattaccatttcaacaaaccccagaaagttggtgcttttccaaggagttttatcaacaaacagtcacgccagatccaggtctctatattataagctccccgccaccttcattctagtgagttgtaggaagttgcctccatcaacagttctcttctcgaatgttccttgaagcataccttagattggcagtagcagtggtggtactctccttcgagggatgatccaacgcagcaatctacaagtcgctgttacagtgcagctctcgttatcaaaaagtatcnatgtttctattttcaaagtgttcttaccatgcgtgtcatactagtatagtcacggcatagatgtctaacagatcatgtctgtatcagctttccaccagtctaggttcatacgtttccaagcaatcctgtagcaggctagcaaaacattagtcatgccgtatcccagacttaacttactgtgattcaggttacccttacctgtcgtcagctgtggtattataatcttacatacaagcttgcaagcaaaaatctcaggtatgagactcggcacgctggctatcgtctgtaacgccagcactctggaaggaagatatgtgtagatcacttcaggtcagtcttcaagacaactgtagctaacctcgtgccgaattcct

SEQ ID NO: 517343 - DNA, 321 bp, Homo sapiens
atcagagttcccctctgcgggggttccctgacagatgggtactgggggtgcttcaggcgagctgttaaggtatagtgacaggggccgctggctctgcagcaccacagtcatcgcgccaggccaggctggctcttgcaccccatccctgccggtgtcccgccactggggctccagtgcccactcactcaccctcctcctcaagggccgtggggtccacctccaggtcgtacaggccgagagctgcgccaggcggagcgcacaaagttccctagcagggaccggcagcccctgtctccgaatcttcaccgtgcggctgtagta

SEQ ID NO: 517344 - DNA, 161 bp, Homo sapiens
ggtggatgctgattacaggggagagaatttgactcgggatctctggattgactcgggaagtaattgaaataggaaggacatagaacgccagagaactagagttggcggataaatgtgccccagggaagctccaccatgccaggagtcttagtgtacaacag

SEQ ID NO: 517345 - DNA, 379 bp, Homo sapiens
gctgagattgcaccactacactccagcctggatgacagagtgagacttcatctcaaaaaaaaaaaaaaaaccaaaaaaaaacaacccggtagcattgtcccttccccactgacaaacttatcaaatccagaagctttagagtttcgtctctaattatttttctcctgaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggtcactttcccattacactgattccacaattaaaaaaaa

SEQ ID NO: 517346 - DNA, 928 bp, Homo sapiens
gctagacctagcccacaaacccactccgaccttactaccagacaaccttagccaaaccatgtacctcaaataaagctataggcgatagaaattgaaacctggcgcaatagatatagtaccgcacgggaaagatgaaaccttataaccaagcataatatagcaagtgcctaaccccgtatacctatctgcataatgaccttacctagaaataacttggtcaaggagagccaaagctaagacccccgaaaccagacgagctacctaccgaccagctaaaagagcacacccgtctatgtagcaaaatagtgggaagataaataggtagaggcgacacacctaccgagactggtgatagctggcttgtccaaagatagaatcttagtacacctttacaatttgcccacagaaaccctctaaatcccctatgtcacaattcaacctggttagtaccaaagaggaaccagctctatgggacactaggaaacaaccttggtgcgagcagtaaaaaatataacacccatagtaggcctacaacgcgccacccaagtaagaacaggcgaccaagctccaaacaaccaattagcctaaaacaaacccaaccactactcgatggactcctcacaacccaagtggcacacaacaatcacccgtatacgacgacatacggcagaaaacgtagaagaacaacaatacatcaaccgcataaagccgacgacaacataccaaccgaacctgacaaccaaacgcaaaggaaggagaaacacaccaccggtacaaaaacccccagggcaacccaaacagggcgaaccaaaggagaaggaaaaacaagcacaaacgagcgaactaacccgcgggcacaaagactcccagcaacacagaaagcaacaataccaggacaagaaacaggaggcaacaacagcgagaacca

SEQ ID NO: 517347 - DNA, 1492 bp, Homo sapiens
  misc_feature (1183)..(1183): n is a, c, g, or t
  misc_feature (1247)..(1247): n is a, c, g, or t
ggtcctctgggtgcgatgttccggatatccttggggtcgtgtccgggcggagctgtaatcccttgtgctgacgcgacgggatgccagcaagagctggtataattatcgtcgcgctgaagagggatcgattgggccggctgatgcctacgtatccggctggcgtgggtgatgcgtgtgtactatggatgaatggcccacgagatccaatcacagggaatactagagcctcatgatacagaggtgcatctcacgcagtgggctcagttactgagcaacgaaaagtccagtacccgtatcatatggatgctggtgtaatcctcttatttgggagatgagttactgtcaaggaagtcagtaggtgaaaccaattggaaggtggcgacgccactgaagagggttcgctagacgcgatgtacgacgagactcacgtttacgcacatatgcgatgctagtagtcctgtaccatatggttgagacccctctgggattgagacgattcccaaattagaccgtgggctctagggcaattttagaccaatgggacttggctgcgcagttgataagtaggcgctataattatattgacaatggagggagatctaacaacgcactatctgaaaggtgctgatacaatggaaactcaaaatcttaacaaaagacgatgggatttatgggccacaacatcggagttcaaagaagcggagagttgggcgtgttcgaaccaaggagtagagcggctttttagatttgtgcttcggagtcttcctttggggttaaaagttaccggggcgactctattcttgacacttgtggagcgacttgggagttcacttgaaggatcgtaataccttgtttgggagagagacgggcttttcaaaaaggagggacacaaattaaaccctttcccctttgttggacgccccctttcaacatagggaggggatttgctcctccacaagagaagcagcggttggggacaattttggacaggcaacaaaagaggaaccccacccccaagttttgtggtaacgaacacgggtgggcgcaagatttcgcgttgggccaaccagcggggacacgggagccccaaggagattcaaacacaaggcgacgtttatttaaggaacacagacatttgaaactctagagggtgtgtgttcttacccccagggaaatttaattnttttcacttacacgagccgtggcgtggggtctcaactacaacccacgggttacccgttggtccnctccacagttgtggtatcatccacgatatattaactacacaacaactcgtgcgggggcaccccaagatgtaccagggggctgcgggacaacacgaggcggctataattgaaacagtgctcaagtggtccccaatgacgctgtaaccgcatgaccagcagcggtgttgtgtctcacaaacgggtcggtagtacattgagccggggcccccccattagcggagaccgcataaatactgagagaccag

SEQ ID NO: 517348 - DNA, 391 bp, Homo sapiens
tatttccacaggagggatcagtattcttctgaagcctaaggggtctagaaagacttttttctagaagggaggaaggggtggctattgggatggcctttccggtaatagggtaggtagatcgtttcccactcagggaagatactctccctatccttgggggccaggaggctgggaattatagaacagtcgaggccagcggctctcatccacgggctctttaaacattttcctttcttccggccatcagtatggacacgaatggaagtacagagtttcagccagcagcccatcaggctgacaccacacatatggcttcgtggtactttagccacaccagtgagattggggggggcaatgggcccgggggaaaagtagggtacgagctcgaatt

SEQ ID NO: 517349 - DNA, 1060 bp, Homo sapiens
agcgggtttacactcctgacagcggcggcagcaggaggaggatcgggagtcgcgggaggatgggccgccgctaggctcgcactccggacagcgcctcgcagtgcgcagggtgggtgccccgggcctgcagctgtccgccggggcggcgcggccgggaggtggcgacaggctccgggctcgacagcctcagcccccggtccagcgcgcttaccgacggggggccgggccgaaaccaacacgaccgcccaaggtctctcgcgggcgggcagaacgggaaaaaactcccaagttcctgagttctaaaagttcctgtttgcttcagacaattggatgagcaattcaacacagggacttggcaaggggccacctgttccctcaagtttccaagccacagaaggcttttagaacggagatatgggggctaataataacatttaggccaagcgtttgcggactaggaaggaaggaaccaatgggggccgcgggaccaattttacggtgaacggtttaatacgaaggacagagctggtctactttgggattggagggtaccagagtaaggctttttagaacacacacatgttgccaggactcagtggggatgttaaagtggggactggcccaaaatggcaacggttgcgtgaagtgtgacactcaagacggcacacattaggaatctttcgttagaaggacaagatcgaagcgattcgcagaatgtgttagttaacagatattttagtggcatccaattgtcacttggagagattacatggaacgttaagaacaatgaagtttgtgggggaaaactttaagcacggaaatggcgtgggcaggaacagccataatttcccaagaacagatggcatttcagaaggaccattgtatacgagaaaggacaaacaaagaagggcttaacatttgcctggaagaagaaatgctggtttggggacaggtaattgagtgggtacacaggattttggcacagttgcattgtgggagacccagcattggatatttcgtgcgaagaagtcgatggcaattagagaggagatgtttagac

SEQ ID NO: 517350 - DNA, 542 bp, Homo sapiens
  misc_feature (25)..(25): n is a, c, g, or t
  misc_feature (36)..(36): n is a, c, g, or t
  misc_feature (75)..(75): n is a, c, g, or t
  misc_feature (91)..(91): n is a, c, g, or t
  misc_feature (141)..(141): n is a, c, g, or t
  misc_feature (185)..(185): n is a, c, g, or t
aaaatccttggcccaggaggggatnccagctatctngcttctgaaatttctacctgggatggagtgtttgtgacnccctcagaaaggcttntgagaagccccctgagaaagaaggagggggaggaagagggggagaacccngaagaaccacctcaaggagaagaagaagaaagcatggagactcnggagtgaccttccctttactgtttcctccccaagggaagagagctaagccagccaccatggggctttagatggcggcatttctgtggcattagggagacagcaggaagggaaacaaactgaaaagaaaaaaacgctactgtttcgatagtggccaagcagctagaagtctcccatttgtgactgcgtatgccctctgtccgtctgtgaggaagcagaatgccacacattcccaatatttaaacctaaccactcccaaccaagtactttgtgttgaaatgctgtaaacggtcattgagtatctgggaatttttttttttttttctaagaaaaatgattaaagtacttcctactaggta

SEQ ID NO: 517351 - DNA, 151 bp, Homo sapiens
cccccccccccccccaaacccggggggggccaaaagttttttttttttcccccgggggaaaaacgttggtttttttcccccttccccccggttttttttttaaaaattaaaagggggttttttttttgtttaaaaggggggccctttggga

SEQ ID NO: 517352 - DNA, 658 bp, Homo sapiens
  misc_feature (192)..(192): n is a, c, g, or t
ctcgagagaaggttccctgtgacgcgaccttgtgggacgtgattgccctttctgtgcccacccaccccctcggcagttctgtggggcaggactttggcctatacaaaggatgggggttgtggctgtggagcggaagtgggtctcaaccactataaagcctctctgtgcccgtccggagctggtgaggacagnctgccagagtctggtctctggacactatgggcacacgaattctcccagatctgtgttttgtgctcctcggattgggaattgaggtgcacgggacccaacaggcccagcaagatgagatgcctagaccgagctttctcacccaggtgaaagaatctctctccagatactgggagtcagcaaagacacggcgccacaacctgtacgagaagacatacctgtccgctgtggatgagaaactcaaggacttgtgcacggaaagcacaggggccatgagcacttacacaggcgtttttactggccaaggtctttctgtgctgaagggagaggagtaacaggccgaccccccatcagagggcaaaggggagagagccctactcccctgagcccccagggttagactgagctctccctttccaggagctcttgcattctcctcccaactctagactggattcttttaaataaa

SEQ ID NO: 517353 - DNA, 417 bp, Homo sapiens
  misc_feature (2)..(3): n is a, c, g, or t
  misc_feature (88)..(88): n is a, c, g, or t
  misc_feature (229)..(229): n is a, c, g, or t
  misc_feature (241)..(241): n is a, c, g, or t
  misc_feature (270)..(271): n is a, c, g, or t
  misc_feature (359)..(359): n is a, c, g, or t
  misc_feature (361)..(361): n is a, c, g, or t
gnnttcggcacgagggtctttctgccttgacagccaggtacccctgtgctgtccagatcatcagtgaggagcgcttccggcagctggngaagatcaagacaattggtagcacctacatggctgcctctgggctgaacgccagcacctatgatcaggtgggccgctcccacatcactgccctcgccgactatgccatgcggctcatggagcagatgaagcacatcaatgngcactccttcancaatttccagatgaagatcggtaagaagnnctggatcatggcacgttttcccagggctgttttttggggtgaagctggaggcagcaggctgggggatggtgtatcaggagtcctgttngngggtttcctttttctcctgcttcctatatcatctgatgtaaggatagatccattta

SEQ ID NO: 517354 - DNA, 1192 bp, Homo sapiens
cgccgagctgcgagcggctgcgagcgagagagctgtaagagcaagagagctagagagcgagcaacgggcactcgccccacgcctcccctcagccccacccgcgcgctccgcttgcctctccacccctgcctgatctaccctggcctggtccctgctgctggtgcacagccccagagctctgggtgcggtgcagtgcagcctcgggactcatcctgtgctgcagccgactgcgtacccagacaaaggcttggcactggtggcccctggacctgatgctgcccatcagacatcccctagaacatcacccaaggcatcctatcctcaacgcctcattacacaataaccccagacgcattaggcaatcggagctgccgagcttccagtagcctagggcccgcaacaacgataaacccaggccacaagtgcaaaacagagcagaggaataagagcccatcacacatattcaacgacgaagttggccagacagagacagcttgaaaccaatggcgcggcccaccgacggcctagggccccaggacaagacaacccagggtggggcccaaccgggcaccctacctgcaccagaaccagaaccatatccgaaacaccgacggacgaccaaaggactacacggcaccaagagcaaagacaaagcagaagcacccaacataggaaacacaagcaagcagacccacgcgcggataccaaggcggaacagcgcaaccacaatggccgacgaaccgcaggaggacaacacgcacacggccaccgtggcccacccagagccagggaaacacacaccaaaaaaaaacaacgagcaaagcaaagacgaacaacaccaggacgcgctagagagtcacctgcagtgcacgcacaacgaaaacggccacacagaggcaaaaacagcgccacccggacaaccgccaagaaccgaaacgaacacgagactcgcgtttcggatcgccgcacacatatggtaaagcctggcgcgcattgccgcaccccatccacacagctcaccccacgtccgcctgccgactgccagactccacccttgtaggtgacacccagctcacacaccccaatgatgcactgctcccgcggtgcctgctacactcccgtcgctccgtccacccacggagcccccaacttcgcaggcgccactcctacgtactctctcaatgctccggcc

SEQ ID NO: 517355 - DNA, 391 bp, Homo sapiens
aagaataaagaaataactttaacttatttaaataacaggactcgtacacgaagatgagaattaaagaagtaaaaaaaaaaaaaaaaagtgaatgttagaaaaatctggtcgggtgtagtggctcatgtctgtaatcccagcactttgggagtccgaggcggaccaatcacttgaggtcaggagttcgagaccagcttggccaacatggcgaaaccctgtctctactaaaaatacaaaaaaattagctgggcatggtggcacacacctgtagtcccagctactcgggaggctgaggcagaagaattgcttgaacccaggaggcagaggttgcagtgagccaaggccatgccactgcactccagcctgggtgacagagtgagattctatctca

SEQ ID NO: 517356 - DNA, 301 bp, Homo sapiens
ccctcagtttctttgcctttcataacttttaacaaggatcataatctgtcatcttggatatcctttcccgtggcttcaatcttcttggtccatcgtgtggtctgcccatttagtatcgatgtctgccttctgccaggtcttgtcggacatacttcaggtgggcaatgcgcggagacttgatgatgacatcagtgagctggatgcacttgaaaggcatggcctgtctcctcacttgggtgcaaggtccatcgaccaaagccctgttctgatcaataacatctataatcgccggtcacgagat

SEQ ID NO: 517357 - DNA, 337 bp, Homo sapiens
ccaggattatattatactccactgtatgtatatacagggcattttttttttgcattcacctatcaatggacatttggtttgcttccacctttcggctattgtgaataacgttgctatgaacacaggtgtacaaatatctctttgaaaccctgctttcaattcttttggatatacaccaagaagcagaattgctggatcatatggtgattatatttttaatcttttaagaaatccccatactgtttgtcacagtggctgtaccatttcatattctgaccaacactgcacaagggtttcaatatattcacatccttgccaaccctcgatattttcttgg

SEQ ID NO: 517358 - DNA, 556 bp, Homo sapiens
ccatcttatcatagaagagctctatccagcactacagctacctgagaaagtatacctagctgttgtctcattatatatcttaggtcatgtatattatatgtgccttaggaaggaagtggtatgcccattatacagataggagaatggggaggtgaggggattggcccagaaaaagttactcattcagcaaaaggcttttatgcccttcctctgagctgtcatctctgcatcctccatagtattgagaacaaggcagcagtgagacaggtgtgtgtgtgggtggctttggagtcagtccagcgtagttttgaacctgaatctatcgtgtgccaaccatgtgaccttgacaagtgatatttctccatgtgtaaaacagctgagcctcagtttccccatgtgtaaaacagctgagcctcagtttccccatgtgtaaaacagctgagcctcagtttccccgtgtgtaaaacaaccagtcctgcccctcctttgcccattgctccagctcacttgtgtatggattcgatggcagcacgtcctgaggctcgtggtttcccag

SEQ ID NO: 517359 - DNA, 93 bp, Homo sapiens
  misc_feature (52)..(52): n is a, c, g, or t
gccgctttactgctcagttcggagctaccgcttcgaaagcaacaaaaaagcntttgcaaatgaaacgagattgctgaattgcgtacaccgaga

SEQ ID NO: 517360 - DNA, 318 bp, Homo sapiens
ttttaatttgacacgtttaaatctcatgtgacattattttatacaagtaatattctatacaatcagtcaatattcacagatttacctacatattcatcttgtgtattaccctttatttcagctgtcatctgggattatattcttctgcatgaagaatatcctttagtttagtttttttttttttaaagtataggtcaggccgggtgcagggactcatgcctgtaatcccaacattttgggagactgaggcaggaggattgcctgagcccagggagtttgaggaccagcctggggcaacataggagagactccgtctct

SEQ ID NO: 517361 - DNA, 237 bp, Homo sapiens
ttttgggggccccccccccccccccccccccggggttttttgccccctttttttttaggccccccccggggggggggggcccccttttggggggggggggggggaaaggggttttttttttttttcccccctccgccccccccccccaaaaaaatttttccccccccccctttccccctttttttttttttttgggcccccgggaaagggggtttttttgttaaaggggggggggga

SEQ ID NO: 517362 - DNA, 925 bp, Homo sapiens
ggacagcagggagggagagacgacgatgttagagttcttccactttgggtttcccgtgtcgctccttgttaagttcccgtcgtaagtcccggtcggaccctcctaatccgcccttttccaattgctggcttctccgacttcccgattgtttccccctgtgggttctctgtccagggtttttgcccccggacccgcgtagtggggcacacgacgaagccagacttggggaccacacaaaagacccaaactttcggtacacaccttgtgtcggcctttctcctccgggaggttgtgcggcgcccaatttctcaaggggcccacttggaggacccgaccacggtgtagaatacgggaaaaacccctgggggtccctccaaaagctatgtcagtgctcgggaaaccccggtaagtctttccgctgccccgtaaatctagtagggtactagctcatttccgggactgtccttgcacagacaacgcccgccgaaccctggcgtctttgagcagtgatagcccctggggcgtaggaatcctatctattagtaagagtttcaatagtgttcaccccacacaacgttgtctcctcttccttgagtaccaacctcgaggaaacatttccctttcacaagccagcaaaaaatgttgtccttctgaataaaccccattctgtacacactaaagccaccccataacctgtttgtcttctatgcaccccacctgctgtcaatccatcaccaaccggtttatctcctcacatattcctacgaggcccaaaccactcacatcgtgatatagcacccgccacgcagaaacaccgacacaccacctctagcagtgggaccccaacgatcagacagcccccacgccccggggggaaaccccccaacaccgtggggcgccacacactggaacaccaaaaaaaaca

SEQ ID NO: 517363 - DNA, 148 bp, Homo sapiens
ccgatagatgcgtgagtagcagggggtgttagggtacatacgggccctctttcaacgattaataggggaattacttctaggacgatgggcacgaaactagtggtttgctccactagatttcagagctattgaccgtacgtatacccat

SEQ ID NO: 517364 - DNA, 206 bp, Homo sapiens
  misc_feature (62)..(62): n is a, c, g, or t
  misc_feature (64)..(65): n is a, c, g, or t
  misc_feature (67)..(67): n is a, c, g, or t
  misc_feature (74)..(74): n is a, c, g, or t
  misc_feature (107)..(109): n is a, c, g, or t
  misc_feature (112)..(112): n is a, c, g, or t
  misc_feature (194)..(194): n is a, c, g, or t
  misc_feature (197)..(197): n is a, c, g, or t
tggtgtacatattgtctatggctgctttcatgctacagttagagttgaatagttgcaaccangnntnacatagnctaaaatatttattatatagccctttatagggnnnggngctgatccctccatggaagaaagagttttgagaaccattgtagttaacagttgtttaaaaatcaagtaacaacaaaataaantgnttattaaat

SEQ ID NO: 517365 - DNA, 185 bp, Homo sapiens
catgtagacatacacgtgtacatgtgtgcatcgagagacatgtggaggcatcattttccatttgtgccttatttatgcttatattgggcttctgagctgactctgagctgattctgggaaagcccgggttaaatgccaagtttgcaggcagaaggagcagtgaagcctgaatccaggccaggcag

SEQ ID NO: 517366 - DNA, 337 bp, Homo sapiens
aagatgtataattttttttttcagagatagagtcttgctttgttgctcaggctggagtgtagtggtgcaattatggctcgctctaacctccaactactgagctcaggggatcctttccactcagcctctcgggtagctgggactataggtgtgcgccactacaaatagctaatttttctttaatttttttgtggagacagggtctcactatgttgcccatgctggtgttgaattcctcgggtgatcctcccgccttggccttttgaagtgtttggattgcaggggtgagcccccgtgcctggccccaaaatatttaaaaataaaaatgttcttgaaa

SEQ ID NO: 517367 - DNA, 340 bp, Homo sapiens
cttgttgcccaggctggagtgcaatggcgcaacctcagcccaccgcagcctctgcctcctgggttcaagccatcctcctgcctcagccttccgagcagctgggatcacaggcatgcaccaccacgcccggctaattctgtatttttagtagagacggggtttctccatgttggtcaggctggtctcaaactcccgacctcggtgatccacctgcctcagcctcccaaagtgctgggattacaggcgcgacgactcgggcccacccaaacccccagaagtcccaaccctgtatactaggagaaaagtttgttttgaaaatattatataaacaagagaagca

SEQ ID NO: 517368 - DNA, 186 bp, Homo sapiens
attaataaattatggcagcaatctgttcccctcagcatcctgatttacttttctgttgctttgctttcttctacattaatagttactgaactttatgcatgttgatctatattgactttcactgcaggttggaatgaacaaattatttcagtgtgacagccatgactcaagttccaattagtctga

SEQ ID NO: 517369 - DNA, 1686 bp, Homo sapiens
  misc_feature (380)..(380): n is a, c, g, or t
  misc_feature (723)..(723): n is a, c, g, or t
  misc_feature (1287)..(1287): n is a, c, g, or t
gaccgaggtggagcccgagttcgggaccaaggtggaggcccgagttcgatgaacccagtgggagcctgagtatcgatgacccgagctggaacccggtagtttgagggaacgaggaggagtgagtgcgataagagagacggaggatacgccaacgtggctcgaggctattccctctttcaacaactagtatcagactcttactacaagttgaatcgtttggcggattgtctcgcatgaatacacgccgtcctgaccgaagtaccccgaggcccgaactcaaggcgtacaggcagcggctacattgcgctcaaggcctgtctgcaccgaccaggttcatcgattcagcctcatcagcacagtggacatgggcacccctgggntactgtgcacacagctgaaagaggcgataggggggctcgggtctcgtgtcgcccatttttgatggtgggaatgggcaatactcactgaaccgttggagactccatataggaggcacaagaacgtgctcggtgtaaggacgggctacacgttggctgccataggcttgcccatgttcattcggttgaacgcagcagtggtggatatggcctggctaggattgttgtggaggacgataatgcgcgggacaacgaaggggggaaagcggcgcaggcgccaagtggggtttctacctacacgagtattcacacaagaggccagaagtacatttcccaagttggtggnccaaaaggaaagtaaccacaaaaggagaacgctttaacaaacttgcagcgagaacaacactacatctcagctgccgcacggaagcgggggaagccgttggtgaacaccttggcacgattagggtttgttgggctttccacccctatacctattaagcagattgggggtgtgggcacaccccgcacaaagaaagagctacaattttgaggagcccctttattaacctcggcgcgagagatggttttctacagactgatgccagcaggacaagcagcacaggcacgaagcggtatggcccctacctaaaacaatatcaaccagcagaggagccgattgggccgatcacaatgttaaggaccaggagtggcgaacgaggatcccaacccagcagggggtggctcaacttggtgccaccgctaaaggagatggcacacatctgacgagacgtgggcgtggcattgacatctgggggagaccactaacaataccgttagagcgcccaaaagcgcagttggtggggggaagccagtatattattccacctccgcaggcgaggacggcacnaggcggtgatgcaaaccaccacacaatttagagaatacaggacacgtgtcagacggcgtccgcggcagggcgaacactccacatatatcagctgagtcggggtgcgaacaccaggggtaatcgagtcacaaccaccagtatagatggacacaacatttgttaaacaagaatgccgtctggtcccacaagagacagggaagcgcatgcagaacttacgcagactgtctgccatggaaacgacgcgcgtgactaaaacagacggggcaggtgcatgaaaaagaacacatacacacggtgtgtgacaaagaggttagtcgccttggggagtagcgcccatcatgaggaagaacgaacttcgatcgcagagaccgacagaggggcgaaacacacaatgaaagc

SEQ ID NO: 517370 - DNA, 412 bp, Homo sapiens
gcggccgcctactactactactactaaattcgcggccgcgtcgactcgaattgtgccaacggtatgacacgaaagcccgtgccaggtattgacctggcgaccaactcagcgtcgagccttgaaacgacggctcgaattgccttcccttcgccggactccgcgcaaagaatttcaaccggcgtgctcgcaggcgtgtcgctgaatccgacgatgcgaaccagtccataaagacgcaatgaggttttcaggccgctggggtgaagcgaggtatcgagcgtgcaggcgcaggggataggcacgtccatgggtgaagagcgcatcaaattttacggtccttgtaaatttgcgtcgcgaagaatgccccaagcagaagccgggctcaacaatctttacagcgttttggctggcatcc

SEQ ID NO: 517371 - DNA, 1010 bp, Homo sapiens
gaacgaactataacatgtacatcttctcgaagtcccgggccagcagctccacggggatggtctccctgcctccaggcgcttctcattctcatggatcttctggcccgggacgtccgagaaggaacggataagcatgtacatccttccctgtacattgggagtacggccagctggaccagcatcccattgacgggtaccctctcccacacacgagctgtgtccacgtgcgtgctcccgcttctatcgccctttggagctattgctagacaccccccgctttttcgatgaccttggtgatcctggatcaatgacgaaagtacatcagccctgtgagtgagtgggccggctgctacgggtatcaaagtagaatggatatctgacttaggatcttgttgatctaatactccagcgtcacgttccactatgtacctgagagttcatctcctttaatgcctcccctttgcgtgctctccccgagatggtgtataatccagtgtagaggattggatttggtagggctgcctggaggacaaggtgcgtacctatagggatttcaagatgagataatgtcaaccgtggctaacaatacgagagagttctagatcctatgagagtgcacaattctgtagcttgctaacttataactacttaaaggccgttgccagcacgcagttgatagatcccattgttactcattagcacattcgtagcctagcccatggtctcgataggcacgatggtgtggaccaacggatcttgctgggcgctgcctgtaagcagacatgcagaatgaattcgtttctcgtaagtgtactgttgacattattattacgagacagacttgatgtccatccacgtcagggcctgggctccgatgtgttcccagcgtgctggttgttggcaagggaacacgccaccggttttgtaaggcagtgttggaacaaactgccaggggacaaccgcaacccaaccacatgcgcggacgaaacaaaacgggacatgcaaacacc

SEQ ID NO: 517372 - DNA, 191 bp, Homo sapiens
gctcccaacaagagcaaactccatcttaaaaaaaaaaaaaaaaaagggactctgtttctacaaaaaataaaaaaattagccaattatactgacacattgccttgtaacagccccagctatttgggaggctgaggtgggaggattacttgagccccggaatttggggctacagggagctatgatcactacac

SEQ ID NO: 517373 - DNA, 244 bp, Homo sapiens
cagtccaacatccggtggtgtcagagagagggcagcaaagaaagctggtgaatatttataaggtaagttaggtaatgggggcaggggatgtgggaagaatccatatcacaaatttggaacacaaatgagtccaaatatggccacatttaacggtccggcttctcgggaagaataccaaaatgggtccaaaaggaagaaataagcaagggaccatacgcaggtgtgtgatgccggtgcaatgggc

SEQ ID NO: 517374 - DNA, 378 bp, Homo sapiens
gggaaaaatcaggatggattatcaatacgtatttcacaggagatttgagtttgggccctgacagaaagaacacgtactaacctgaaaaaggctacgttgagattaaagagagaaacagctaaacaccaaatcctggtgagagagacgtcaatttaaaaggccagccactcaactgtagcgttgacaacttcccttcttggggttagccaaggaagcagagcgttgagccaattggcaatggtagcgttgggccaacgaaggtgccaccttccccaaggaagcccaacagcaagcccaagggaaggcctttgggaatcagcttttgccttcagccggctagtcactttcttcattcattccgcgcccaatagtttaatt

SEQ ID NO: 517375 - DNA, 229 bp, Homo sapiens
  misc_feature (65)..(65): n is a, c, g, or t
ccccccccccccctttttttttttcccaaggggggggggggggggtcccccccttttttccccantagtgggggggggggggggccttttttttccccccccgggaaaaaaggtttgggaaaaaatttttttttttcccttttttttttgggggggggggggggtttttttttaaggccctttctggggtttttgggggggcaaaaaacccccggccccccccccccca

SEQ ID NO: 517376 - DNA, 923 bp, Homo sapiens
  misc_feature (214)..(214): n is a, c, g, or t
  misc_feature (224)..(224): n is a, c, g, or t
  misc_feature (269)..(270): n is a, c, g, or t
  misc_feature (295)..(295): n is a, c, g, or t
  misc_feature (297)..(297): n is a, c, g, or t
  misc_feature (313)..(313): n is a, c, g, or t
  misc_feature (339)..(340): n is a, c, g, or t
  misc_feature (344)..(344): n is a, c, g, or t
  misc_feature (348)..(349): n is a, c, g, or t
  misc_feature (357)..(358): n is a, c, g, or t
  misc_feature (368)..(368): n is a, c, g, or t
  misc_feature (379)..(380): n is a, c, g, or t
  misc_feature (382)..(382): n is a, c, g, or t
  misc_feature (393)..(393): n is a, c, g, or t
cggcggcggtggcggagaaggaactcgacacgcagccgacgcccgtcccgttccccagcccgaacgcgtggaagctgtagcccgctctgggccggggccatgggcgccccgcgccgcccgggtcatgaggacggaggcggaggtagcggggacgcgcatcgagcccggggactttgtgcaagctggcgctgtgcccgtcatccagcagctctancacttgggantgtggcctggcctgctccaggatggtgctgcggtacctgggccanntggacgacagtgagtttgagagagncnctgcagaagctgcagntgaccaggagcatctggaccatcganntggnctanntgatgcanncactttggcngtgaggcaccnntnctgtacccagnaccgctgtggtgtcgacaagggctacacagaagcagtccgttctagcaggaagcagcggtttgatctcaggaagagacccgggtgaatcaagctgttgtgcacagagcaaagggcctgcaaggtgctggtggagaaaatgcccagtgagtgtgaatggacagtccaggcgcgacctggcgtcaggggccagtgtgcgccagtccgtgcgtggtagaactcgggggttgctagcactggtgagctgtggctcccaggcccgtgtcacacgtaacaggttgtttcacccgccagtggcacccacgtgtgttcttgccgacacttcctgactaccaggggcacttcatcgtgctggggttggtaacaaccgtggccacgggtggctattctagaagacccagctatttggaccaggaatggtgggtccagctagtgacttgaggaggcaaaaaccctttggcatgagacactcttggctcatggagcgcgccacagaccgggggcgagaacctgagcacatcaacacagggca

SEQ ID NO: 517377 - DNA, 108 bp, Homo sapiens
tgtgtaacttctccagcatttgagccagtacgtgaaagcccacaacacgttcatggtctttagtattacagattatttttgcataaatatttgttgttatctcttgac

SEQ ID NO: 517378 - DNA, 102 bp, Homo sapiens
gatccccactctcgacacgtctggacgatgcctcggccggggcgagggtccgaggttctgtgacgtggtcatacccgctctctctgtcttttgtttcgtgtg

SEQ ID NO: 517379 - DNA, 751 bp, Homo sapiens
tagtcatttaaaatcaggtccttaaaccataacttgcttgtaaaaactggatgttaggcttgtgtcagtcagcttatgcttaagttatgcttcggtaacaaacagcccccccctccaacttcagtggctttgatatcagggtttacattacatgtccgtcacagttccatttcagctctgcttcaggaaatattcattctgggactcagacttttcccccacgtcaataaaggagggccccagtgcttgctaatagtgtcttcctcctttgttcccagttcctcaccctgtagctcttctctcatagacacatatcagttggttctttccttaatttaatgtccctgtaatattattgtcgcttgtgccagggtatctttggactaaaacaatatatttttaaagcatctttgcagccaaaaaaaaaaaaaaaaaaaaaaaacaaaaaactggtgttgcgcgccggccttcggcgccctcaagaaaagccttcttaaagacccatctccggtgggggcgcggcgggcgccccagtagagacacgtgcgacctgggggcaaaagcggtggtcccctaaggagaaagaccccggggcccatcagataggggcgctgggggctccctcacccaataaaaaaaaaccccgggggggacgccaggctcgtctcgacacaacctcacagggggaggcccagagggcccacacgggggctctacaccacgggggcccaaggcaaccccaatacaaccc

SEQ ID NO: 517380 - DNA, 277 bp, Homo sapiens
ctacagtcggatgcagcacccttcaggcacgccatgtcgcattggagcagagtgtataccacaacctgaagaatgtcatcactggagaaatatgggaaagatgccaccaatgtggggtgatgaaggcgggtattgctcccacacatcctggtcgaataaatgaaggcctggagctagctgaagacgtgctatatgggaaatgctggctacactagataatggaggtcatacggcatggatcgtagctggcctccgtgggatcctactagcagtctac

SEQ ID NO: 517381 - DNA, 1083 bp, Homo sapiens
  misc_feature (134)..(134): n is a, c, g, or t
  misc_feature (154)..(154): n is a, c, g, or t
  misc_feature (212)..(212): n is a, c, g, or t
  misc_feature (221)..(221): n is a, c, g, or t
  misc_feature (242)..(242): n is a, c, g, or t
  misc_feature (246)..(246): n is a, c, g, or t
  misc_feature (273)..(273): n is a, c, g, or t
  misc_feature (275)..(275): n is a, c, g, or t
  misc_feature (312)..(312): n is a, c, g, or t
  misc_feature (361)..(361): n is a, c, g, or t
tcgggtacccactgcagagtgctgaagacggggtagccacgaggttgcaaattcgtgaagaatcagcatcatgtttggcagctgagtattggagccaggagcctgccatgaggttttgagaacagagtgctgtnttagagctggcagcagcatntcagcccaagagaaggttatattcccagaggatgtcagtcccaaggaccagtagctgncatcagttnggattctgaaaactaactggnatcnacactgggtgtagaaacatgcttgccntnatgtatcagaggacatgctcagcagatccaagagatntattggcaactttttctagaaaaggcacatgggtatcattcattacatncttgagtttgctgggtttttcttttttgggggaaacagctctgggctgttttgcccaggctgaagtgtgggggcacaatcacagctcaatggccatccgtcaatcacccaggcctaagaaaatcctccccacctgtgtagcggggactacagctcacagcacacggggcataaagatactttgggtctgagacggggatactctaatgtggcccagggggggatctaaggcaccggggctcagagggtcctcctggcctcagttgccaaagggcacaggccaagtgggagctgggccctaggcaatataggcccaaacaagaggttctataccctttgcaatgcgaaaggggacctgcccataaagatgggtaaacggtggggagggcaagaacccattacagcgggggaacatttgggaaggtccctcccgggaaacgtggtttctccccggccaagtcacccgggaccttaatcctacacaactacggggatgggcctgggggtgtccaaaacaacacacacaaacgccacacagccccactccagatacgctacaacacacaaaacaaaggggcgcgcaaaaaacatcccgcaggggacgacgatacgaccaagtgttaaaagggcgcgacagaggatctacacaagacagcggcgacacaacaccagacgacaagacgtgcgattatcaaccaacctctgcgtgcgaggcccaccaat

SEQ ID NO: 517382 - DNA, 120 bp, Homo sapiens
  misc_feature (55)..(55): n is a, c, g, or t
  misc_feature (87)..(87): n is a, c, g, or t
acatcaatgtcagcatggcatgtggtcagcaccagcatcaccatcagcatcagcnatgcatcacacattgccatcagcaccaccatntgcatcatcagcaattgcactgcatcagcagca

SEQ ID NO: 517383 - DNA, 886 bp, Homo sapiens
tgtggtggctcatgcctaatcctagcactttgggaggccaagacaagtggatcacctgaggtcagaagtttgagaccagcctggccaacatggtgaaactctgtctctactgaaaatacaaaaattagctgggcatggtgacagctgcctggaattgcagctactcaggaggctgaggcaggagaatcgctagaacacgggaggcaggggttgcagtgagttgagatgcgccatgtgcactccagcctggtgaaactcagtctcaaaaaaataaataaataaataaggccaggcgcggtggctcatgcctgtaatcccagcacattgggaggcagagggcaggcagatcacctgaggtcaggagtttaagacctgcctgggaaacctgttgaagccccgtctctactaataatagaaaaagtagctgggagcggtggtggctgcagtaatcccagctatcaggtggaggctgaggccagagaatgtgcttgagccagggaggcacaaggtgcagtgacggcaagatcacatcactgtactctagcctggtgacagagctagatctggttccagtaaataagtaaatcctgaggtattaattcttggagcccattagtgtactccttttttacactctcctcttttaaccattttttttttgtacccctttaaaaggagatataccctataaatacctacacacttggtggaaaccccggggtaaaggaaaagcgcggggtgggtctacataaacccgtgaggaggctcgaaggaagcttttcacaaggggatgtccgcgggggagcaacggcagcacaaaaaacgtcgtttgtgcaccacgcgcgcaaaacttgtgtccggagaaataagagaggcggggcaccgt

SEQ ID NO: 517384 - DNA, 932 bp, Homo sapiens
ccgctctttgcgtgtgacgtggggtaggccccgctaggttattgtttcaggcagagtgtaccggggtggtgtccccgcccgggctagcagtgattctgaccctccctggtggccttccctattttgcccgaggatttggcgagaaccagggtccatttttgcccttctctttaatgccttgaccttccccccatagtgtgccccgagatacataggcgtattgatcccttaaagatgcgtgttataaattgaggaggggcttttaaagggtaagcacaccaagaagttgtgaagatcctgtgatgttaagaaggaacgtttggagaccatccctgagaatctgatattgattgaaagtttaaattatagtagtttgggccatattgagtaaaacgcatatgagtaattgaaattgaatattacccggttcttttgcccttttaaaaaggtgaccaatgagaccatgttgaattatatatatattactccatcttaaagtttctattggaccatccctgctcttagaaacttcctctctgtctctctttctctctctccactcttgccggtcttccatttttggcccgctggatagaccggatctggcagaggactatgaagtccaccaggaaatggtccatctttgactacaatggaagaccagatactgtctttcctggattacccattataggaaagctgccttatgacccagggacacctaccatttaactgttttatgtgtgagaaataatttttttgtatgtccagcccctaagatgtgtatggtgtttgtaaccgaagtaattataccctgactaataccaatagtatggggaagagttgagccagattaagatgatccgaatgttaaggtccctaagatagccccatttgtgaagataaggagccgagacctgaagattagtgga

SEQ ID NO: 517385 - DNA, 1181 bp, Homo sapiens
cgtgtggttcggttacattcattacgtgagtttagtgtggggctggcacgctattttaacttaggtcgatggccaaatgtgtcgtgataaagtcagtgtcatgagttttcagatctcatttactcggcttattgtcatgtgttaaaccccggtttctttgatatatattactccgtatattacttatcgtgggctctttgtagtgcgggtggctcgatgagcggttccaagctgtgtcttccgagatgtctgatgttcatcgcagtttcgtccttgaagccgggggaaggacggaggacttgtcaggaatgctctgagtattcctcatcctcgtcactttgcatacctttgggtgccgaccaaggtggtggtaaacgtcgattctgctaacggttcggagcacaatataatggtagcatttgggacctcactagcctatattatctctatggttaaaagagggaccatacggatagctatggtaagataggtatcgtggattgtttctccagagcttactcgagagttaggctgtctacagagatgatatttggatgctggtatttgtatgtggttaagtaaggagttttgccttggtagtataatttatatagagaagggcaggcttaagtgtactagcccggtgtcataaaaagaggagtaccgatacattgcatgcacgatatcctttgactcggcaattgcactggcaggaattctgcggttatcctcacacacatacggctcctaggcactatgtctaaggatcctcattagcagcaatgtctgcaagacttagtcactgggagtggcctgttggtccctcatctaggacactgctgtacaataaagctatggtacagctctataccgtgaattcccactactagacgcatgtaagaaagcaatgtaaggcagggccctatggtgctggtcggctcgatcgcacgtagtaatgaccctagcaactctgggtagagccgagtcgggtgaatacaccctgaggatgcacggcgtttcgagacgacgccgtggccaaacatgatgaaaccaccgtttttactaaaaatactaaaaattagactgggtatggtggcaggcgcctgtagtgcccagctactaggggaggctcgaggccaggagaatcacttgaagcctggagcatagcaggctggcgctga

SEQ ID NO: 517386 - DNA, 886 bp, Homo sapiens
ggcagacactgaccttcagcgcctcggtccagcgccatggcgccctccaggaagttcttcgtgggggaaaactgaaatgaacgggcggaagcagagtctgggggagctcatcgcactctgaacggcggccaaggtgcggcggacaccgaggtgtttttgtgctccccttaatgcttatatcgatttcgccgggaagaagtaagatccaaagatgtgttgtggtgcgcagaaattgttacaagagtgactaatggggctttaaggggggagatcaggcccgtggccattgatcaaaagattggggagccagcgggggggtgtggttcctggggcattcaagagagaggggcaatgtcttgggggaagtccagaatgaggctgttgtggcaggaaggttgggcctgttgtttgtgggaaaggggactgcgggagtaatcagcgtgaatgtgggagagaagctacgtatgaagggaaagttgcatcactgaggagggttgttcggagcagacaagggtcatcgaagatagtgtgaggatgcagcaggttgtcctggcatatgagcctggtgggggccattggtatggcaaggttggaaaccccaaaggcccaggatgtacccgagaagctcgggatggttgaagtccaacgtctctgtgggtggtccgagccccgtatattatgggggtccttgcctgggcacctgcagagtggcagcgctgtatgggtgctcctggggggggtcccaagccgatggggtctttcaggcaagtggcttttttctccttgcgccgggtatgcaagccgttgcttcgctttttgggggtcgctcggccacaggttcgtgtacgggggggccccttggaacgccgggggggggcccgagcct

SEQ ID NO: 517387 - DNA, 164 bp, Homo sapiens
cgaatatagaagtgccagcttaagttctataatacacagaggacttactacatgcgaggcactctttcaaacacgttacatattctcttttagtcttcacagaaacttacccaggacgtttttaatatcatccctacttaacgggtaagaaaactgaggcacag

SEQ ID NO: 517388 - DNA, 441 bp, Homo sapiens
aaaacgagaagacaattctcaacatttagggcaacccgcactgatggctgacatttccagaaagatccaatgtggccagacccatgagaatcaagtagctgacaccatagcatccttgaagatcggtcacaagaatgaggaacagtttcaggcagctctgcccgtcgctttaggagaaaatccccctcttcagggaagcctgaagctgcttccctggggggctgaaggagcggaggggagagggagtgaatgtgctgtgtggtggagagaacactggaacctctaaagcggacagagcaagccctgggtgcacaccgagggaagacgagagacagaggggacctcgtgggctggggacgggagctcaggatggcacggaacaaattcatgggaacagagaccacgtggaagataaatcaaaaggagttccgaagacacagt

SEQ ID NO: 517389 - DNA, 184 bp, Homo sapiens
ggatgtgtatttgcaccacagtacgccagtgatagttgacctcagacgggaggcactgagctcctccatcccaggaagggcctctccagctggggcagcatctacgccactctggccatccactagcccagggggggacgcagaacccacactccatggagtctggaatgcatgggagctgccc

SEQ ID NO: 517390 - DNA, 165 bp, Homo sapiens
ccagtctgatagtgagaggaggcgactaaagcagtctacaggaagaaatgtcctcttcaggcccttcagtgaggaatagcgtctctgagtgtagcagggccaggaagataccccaggaagaagaccagcccttgcctgcccgacggttctcctctgactgcagcg

SEQ ID NO: 517391 - DNA, 83 bp, Homo sapiens
  misc_feature (24)..(24): n is a, c, g, or t
  misc_feature (26)..(26): n is a, c, g, or t
ttggttttttccggtttccataangngaaacttttgtagtatgtatttttctaattgaagagaataaagattaaaacaaagtg

SEQ ID NO: 517392 - DNA, 1768 bp, Homo sapiens
  misc_feature (1581)..(1581): n is a, c, g, or t
gtcacgcgctgggacagtcgtctgagccttaggttcgaggaacaagtagagatagtcgtcattcacgtctcgtactcactctccgttacgtatagcgcgttatgaagagaactatgatcgtatgctgctggctcgattgatatgctgacatcttctgtagacgcgctcaaatagaccgatccgcgccatcataattcacatatgactatgtggccttagtcagcacataacttacgtacataagcacgtcatgctcacaggacaggatgtcggccaaagtcccctagtaactgtctcgatatctaccagaggagcatgaagggcctcagaaagtacgatcagcgagtgaatcgtgcattggctgatcgtcccagattgcctgaagaacgtgaatcgtaccgcgaactagtgaataattcacatgatccaacttggaaatgactgtaatttcttcccgatgagaggacacaacggtgtggactcttcgcgagtcgcaacaactcaaccactgaactcacggtcaaatgcctgtttaaagtttaatatgcgcgttaatccaagtcggcgcttctttggcataacttagcgggctgtcacacgcgaaagagatgtcgaaactaccacccaaacgccgtgaactgtgcaagggcagtgggtaagccccgcacggagaaacgacgatgtggtcaacgacgtgccacgagaaacgccacccgaccatagaaaaagaacaacactggcgcacaccgatacagagtaaagacaagagagtagaaagcgagaagcgcttggacacacacaaccgcgtaaaccacaccgttacccacggaggaatgtccgctggcggctaaagtaccccagggggacccgaagcataaacagaatccccgagtgagtagcaagagccgcaacccaatacgttacgagccgcaaaacatatcaaaagggtacgctaagcgcgtacgtttccataacagtatagcgtaaaggttccgttccgcaccgttgacggcgggggagttaccgtacgctaccacagatatgagttataccgaacgtaactagacaatgacacccagacgaggaatagtcaaaacatgcgagagaagtatcttgacagtaaaatcataggcgcttagccagcaaacaatctacgaatcaaacatgtatatatccacgcaaacggctaaattgggggctgagatgacaaattccaactcaactaggacttttgagtgcggcgaaagtgcattgaccaatgcaaactagagcagttgagaagcaatccatatgaggatagatttaagacgcgctgaagttacgaagcgagccccggacaggtaaaggactgacccaattatccccctctatcgcgtcgagttccggaaagcgcatatttttatgctagcattccagagatactgagcccctaaaggagagacacaaatacagacatcgcaacgaaagcagcggtagccaagcagcgacgtcccaaagagagctatcaaaacacccgtgagagccaacaagccatgcacaaataggacagaatcgtagcacaccaaagcagatggacaacgnacagacaggagcaccaatatagagggagccgcccaatagtccaaaccagtcaggaccgatgtgtacgagcgcccaatagaggaggaagaaactatgcgagaggagtaactaaaggagtggaagcagcagaatgccaaccccgaatacagcgcgaaaggactgcaccactagacacagagaagcaaat

SEQ ID NO: 517393 - DNA, 331 bp, Homo sapiens
ggaatcctcctgctgctcgagctgtatccattgaccttctagctaccattcattttcttcactgttcacgaaagaatgagtgtgaaattcagtgaatgctgttactagtccgtgtgtacgatgatgaatctcatttcaccaaaattaaattatgtaaatccgctaagatgatgcactacaagttgaatacacatcactctgaacatcgtcagacctcaccagttaaggctccacagtggctgacctcaggtgaactctatcagcttatgtctgaaacagtctaagatggagagtgaaccaatgtgtaaatagatctatgcagctggatagc

SEQ ID NO: 517394 - DNA, 347 bp, Homo sapiens
catggctttggaaaggagaatggaaaaatagaagaaggtcggccgggcttggtggcttaagcctgtaaccccagcactttgggaggccgaggtgggcggatcacctgaggtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatcgttgtatgaagga

SEQ ID NO: 517395 - DNA, 241 bp, Homo sapiens
gaaccatatcatattactttcagaatctacaactgcaataatttttctttaaaataaaatagtcttgcttagggtaataggtttttcctacagaaatgtgatttcgtgttttatgacaccgcatcaatacattattttaataaatggctcttggttcaccagcaagtgctgtatttggacaatatcagccaaccttttcattcgtttaagcaggaaaagtagggtgccaaaactaaagcta

SEQ ID NO: 517396 - DNA, 427 bp, Homo sapiens
actcctagatcagtcaccactccttagcagtactccacagctcactaaactaatcatcaacactgattaaacacaaatcagagggtggggtgttcaggattcacgggacatgaatgtaaaggaaaatagtaactttttggaaggtcccagaatggcacagtttaaccatagattttttttttaattaaaaaaaggtgggaaatcagttaaatttgaaggtaaaatgaattctgaagtcagaaatgatcccactgatgattttaagacttgacctgaaaaatggaggcagagtttacatcaagaaatcttcaaatcgcaaagtttagagacataaccactattcatttagttgctaagacgatctgagagttctccctcaaaaatccctccgattcatcccccctttcactgatctataggagtggtg

SEQ ID NO: 517397 - DNA, 252 bp, Homo sapiens
tacatgacgaccggtgaacccggtagagcggtctggaccgaagtccgcaactcatggttcctagttggattcgttaaccactgcgccacgacgggaactcctgatatttaactcatgtaacagcaaaagtgtagtaagggcagaaatttaagttatactggttaactaatctttataaatatatacatccaaatatcagcccccagataaagatatggactattaccagcaatcaattgaacatctagaatt

SEQ ID NO: 517398 - DNA, 1144 bp, Homo sapiens
gtggctggatgactgcctggtgcagctggggggtgcccggggtgccctggtggccctgtgtgatgggtgaacctgcggtgtgcttcctgctggatggtttctggcatgtggcatcctgtgggcctggggtctgctggcctgtggactggtggcctggtggcctgatggcctgctggatgcttctgctggagtgcaatggcctgaggataatggacgtggattgccctgtcaccaagttgggcctgcttggtcaaggacatgaagatcaatgtccctggaggagatctatctcttctccctgcctattaaggaatcacgagatcattgatttcttcctgggggcctctctcaaggattgaggtttttgaacgattatgccagtgcagaagcatgaccctgtgcctggccatgctgcaccaaggttcacaggcacttttgtttgctatctggggactacaatggccacgtcggtcttgggtgttaagtgctccaatggacgtgtggccacctgccatccgtggggccatcatcctgtgcaacgctctccatcgtccccgtgctgcagaggctacttgggggaacaagatcggcaagccccacactgtcccttgcaaggtgacaggcctgtgcggctctgtgctggtacgcctcatccctgcacccagtgggcactggcatcgtctccgcacctgtgcctacgaaggctgtcatgactgggtgggtatcgatgactgtacacctcagccggggctgactgcaccttgggaacttcgccatggcaactttgattgcatttctaagacctacaggtacttgaaccccggaactctgtggacggcgactgggtatccaccaagggttctcctaatcaggagagtcactggccaaccttcgtaagcaccgcaaccagaagttccgcgggcacggtgccacaggcacacgcagttgtgctaaaacacggcgcttaatcacagaacgataagtcgcacagccgtgcgacaaacaccatgtatcataacatgatcacacagcacagcaacaaaccacgacccccattgcttgacatgcgccacgcgatcgtcgatcaccaacctcaatgccgtgctaatattacagcgctgttagtacgtacctagacgcataa

SEQ ID NO: 517399 - DNA, 325 bp, Homo sapiens
gctcgacattcaaaaggtaaattgttacaattaaggttccaattaaaaaagtcccgccatatggctggacgtagtggctcacaactgtaataccagcactttgggaggccaaggcctgtggatcacgaggtcaggagatcgagactatcctggttaacacagtgaaaccccatctctactaaaaatacaaaaaaattagctgtgtgtggtggcacatgcctgtagtcctagctactcgggaggctgaggtaccagaaatgcttgaactggaaggagggatttgccagtgagctgagatcatgttgtcactgcactccagccgtcg

SEQ ID NO: 517400 - DNA, 272 bp, Homo sapiens
cacccaatctgctggcgccaggcgttgctggctacatggctgacatgttgaccctctttggacttaacttattattcaagtgagtaccctttgttggtgtctttgctgaagttaggggaggagtgactgctgagatgcacctcttgttgcaagtcgtgcatattaacaggagggacgtaatatccaggataggagacttgtgtgccgagacgggatgggagaagacaggctctccatgatttgttctggcagaaagcaaggaatgtctgaat

SEQ ID NO: 517401 - DNA, 421 bp, Homo sapiens
  misc_feature (15)..(15): n is a, c, g, or t
  misc_feature (51)..(51): n is a, c, g, or t
ctccctgtgagcccnccaccacttcctccctgtgagctccctgtgaggccnccgaccagtccctccctgtgagcagtaatggcgccactgcactccagcttgggcaacggagtaagaccctgtctcaaaataaataggccgggagtggtggctcacgcctgtaatcccagcacttgggcaagccgaggtgggaggattgcctgaggtcagagtttgagacacagcctggccaatatggcaaaaccatctctactaaaaatacaaaaattagccgggtgtgatggtggcgtgcacctgtaatcccagctactcaggaggctgaggcaggagaactgcttgaaccctggaggcggaggttgcagtgagccgagactgtgccgttgcactccagcctgggcaacagagtgagactctgtcacaa

SEQ ID NO: 517402 - DNA, 169 bp, Homo sapiens
  misc_feature (81)..(81): n is a, c, g, or t
atgcgtctcacactcgacagtgcaatactagtgcaataatcgagggacgggaacagagtcgtgggctttgatctctcaganaaaaggaagacggaagctcagaacaagagacgaggatgaaaagaagagagggagtggtgggacggcgtcatccgctggagagctcagc

SEQ ID NO: 517403 - DNA, 293 bp, Homo sapiens
agaactcctggactcaagcgatcctccagcctcagcctcccgagtagctgggactacaggagaatcgcttgaactcgggaggcagaggttgcagtaagtccagatcgtgccactatactccagcctgggcaacagagtcagaccctgtctcaaaaaaaaaaaaaaagaaaaaaggaaaaaagaaaaaaatagtttctaggagggagaagagaaattcccagaaatataaggggttttttcaggaaattagagaaattggtggtcccaacaaggaaaaggagaatttttcttgg

SEQ ID NO: 517404 - DNA, 97 bp, Homo sapiens
cctatacgaggactttgtttagactgtttattacatattgtcagtagcctcattcattgacttctgcatcttcttgatagctacactgtcagcgcaa

SEQ ID NO: 517405 - DNA, 673 bp, Homo sapiens
  misc_feature (585)..(585): n is a, c, g, or t
gggggccctggtggccctgggatggggaaccgcggtggctccgcggaggtaacggcagtggcataccggggccggggacgcggccgtggacggggccggggccgaggccgtggagctcgcggacgggtatggcggaggataatggagtggatgcccgtcaccaaggttgggccgcttggtcaaggacctgactgatcaagtcgcctggagggagatcaaatctctatctacccttgccttattacgggaatcaagagatcatttgatttcttacctgggggcctctctcaaggatagaggtcttggaacgataaatagccagttgcacggagagcaagaccctgtgccgggccagcgcaaccaggttcaagggcaataggtgtacgcgatcgggggactacaaatgggccacgtacggtctggggtgtaaacagttgctccagagggatggttggccaccccggcacatccggaggggcccatcaatccttggaacaaggcgtactccgatacggtcccctgatgcagcatgaaggcttacgtgtgggggaaccaagattacgggcaaaggccccaagattagtncccttgtgcaaatggtgacgcatgggccggcgtgcgggaccactagtagcatgggtagcgccctaacagtaccctgggcaacccaagg

SEQ ID NO: 517406 - DNA, 1358 bp, Homo sapiens
  misc_feature (374)..(374): n is a, c, g, or t
  misc_feature (497)..(497): n is a, c, g, or t
  misc_feature (937)..(937): n is a, c, g, or t
  misc_feature (1076)..(1076): n is a, c, g, or t
tcccattttactctttttattctgctctttattgttctgaaaaaaaaaaatggggaaaaggggtttccaccacagggtctccaaaaaaccaagagttgcaaattcagctccatttctcacttttcacgtgctcgtgaaaatagggctctctaaaacccaggattacaggggtgtggaagtgtcgcttattatgtggacctcaattgtgcttctccggacctttttccaaagccttttcgtgctccaattgtgtcgcttgaccagaaacgtgattagacacagagcacaacgcgagaagagactcaggggccaacaccacaaccagaaaaacgccccctgttcagaaccttttcacaaaaatataagcgcgtggnttggtctcccattccaaagcgctgtagacgcggggcacggctcttttgagaaacctttcatatttctttctgtataagaattagacgcttcgccattgtgtgtgcattcttctcttctgtacnatatattcctgtggtgggcgacacccaccactctcgaggggggtatagttttttataggcccgggaaaactttttagacacgcgtatgggagagaggcacactctcttctctgtggcttatacccaaccaagaaacttcttttctcaaccagaagcccgagtcatttttggccaaaaatttttggggagagggtcgcctatgttgcctttggcaaccagggctttctctcatccttctcgcctgttggcacacggggggaaaaagcccctttctgttgtcttttgtggcggacacagacaacgctttcttatcagaggcgggtggaaaagacggccacctatgagaggcaaaccccccagagggccagagagcaaggtgttgcgcgtgcgcccccctgtgggcgggggaggaaaggcgcgccaagaagcgctctcttccncccggtagggacacaccccccagataagaacgtatatcgttgaggagcagcgcgcgcccatagtgttgtggcttccgacaacccctggtcttgtgagaacaccaagagagggggcgcccctttaatctctccacaaagnaggcggccctttcgtggtgccctcttcccggtgtaaggaataaggcggaccaagagagggccggcgacacctttatacactcttctgtggcaacgcccccttcccacgagagaggtgtttcccccaggggcttcaagggcgccaagatgcaaaagggcgcccggagaagtatttggccccctattattggggcagccacgaaacggaacatctatcattacaggggaaagcgttcccccgtgtttggcccaacagcgggaaaaacaaacagtacgaaatagt

SEQ ID NO: 517407 - DNA, 213 bp, Homo sapiens
tgacgcgataacaacaatagaaaaaggcagtataacaaacatgaaagtttgttaggcccaaaaaagctctggccaggttaactagtgaaggtcttctcactaatttcggcgctgaagaatacaccaacttaatggaaaaatgcaacagaggagttcaacagcagatcagagcaaacagaataaagattcaacaaattcaatgtcgggttacct

SEQ ID NO: 517408 - DNA, 461 bp, Homo sapiens
cggcaaacgtgggatacactggagtggagtgagaatctgatgttgtaaaaggaattgtcactacttctttacagttcggaagatatctctccagtatgttttatcttatgtctatttagatttgaagatttactaaagactttcacacattttttagattgaatgatttcggtatgtgtagtatatgacagatcggttaagtccattacaacattctttctgcaccttagattcacccacactttcccaattctttctttaattgtatattctcaatgccatatctttcatctgtgctcagtatcactttttgaaatgaatcttttatgccatgctctggcaagaggtcttgggtgaaatgagaagaaacagctgggtgtctggctactgtctcatgtttcttcacattccagggctcattcctttgctctagacaggtgatcaggtctggcttagagaca

SEQ ID NO: 517409 - DNA, 145 bp, Homo sapiens
acatctacatgaaaaacgggggtctccctacctgaactcaccaccctgcactttcccccaccaatgcccaccccccttgaccctgaagagacagcctaccctagcccgagtgggggcaacagtacgtccatctgacccatactat

SEQ ID NO: 517410 - DNA, 286 bp, Homo sapiens
  misc_feature (135)..(135): n is a, c, g, or t
gctcatgcactcaacttccctggtcaagtgattctgtgctcagccacccaagtagttgggattataggtgtgagcaccacgcctggtaatttttgtattttagtagagatgggattctccatgtggccaggctgncgtcaaactcctgaccctaagtgattggcccgccttggcctcccaaagggctgggattacaggagtgagccactgcgcctgacctaaaaattttttcctgaccattgcttgttttctgggaatcttgtgataagtgctttgtctgataatg

SEQ ID NO: 517411 - DNA, 159 bp, Homo sapiens
cgtcgagtacgtcggctcggtaggcggaagtgtgtggagaagtagattacgcgatgatatatagtgaatgatttgcgtaggttgtctagggtgtagctggaataggggaatcagtgaatgaagctcctatgatggcaatacagctcctatttgatagga

SEQ ID NO: 517412 - DNA, 177 bp, Homo sapiens
tagaagcatacatacacgcgtcatttaaaatggcacatcccattctctacactacagaaatatctgcaggagtgaccaaagctatgtgtacacctctggtcgagcttgcagcctcagttataatcctaaaaccatgaaacccaccttatttcaaaaacatcttggtacagaccgtcg

SEQ ID NO: 517413 - DNA, 316 bp, Homo sapiens
tagccggtcccctcgctacattgacacatgagactaagtatgaaaataaaggggcgcatgcagcttgcacgcctccgtgtctggctcctttcattttcgtaatatttcggggactcatttgggactgctgtttgtatcagtagtagctcatgccttttagttactgaacagtactgccttctatgattacaataggctagattctaatacacaccaggcattttcaattcagctgtgagatctgaaaaacaattttaaaaaataaaattgctgtcaatactcagaaacttgtaaacaccaattagaatccaaacag

SEQ ID NO: 517414 - DNA, 128 bp, Homo sapiens
atgatacgaagtcgagctggtacctcccgtatagcccgagaggactttaaggagccgacttaagcaaagaccagggttctcaggtgacttcctccgaaactcccccacccagccatagctgtggacag

SEQ ID NO: 517415 - DNA, 740 bp, Homo sapiens
  misc_feature (15)..(15): n is a, c, g, or t
  misc_feature (76)..(76): n is a, c, g, or t
  misc_feature (96)..(96): n is a, c, g, or t
  misc_feature (102)..(102): n is a, c, g, or t
  misc_feature (107)..(107): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (133)..(133): n is a, c, g, or t
  misc_feature (135)..(135): n is a, c, g, or t
  misc_feature (137)..(139): n is a, c, g, or t
  misc_feature (141)..(141): n is a, c, g, or t
  misc_feature (143)..(144): n is a, c, g, or t
  misc_feature (146)..(146): n is a, c, g, or t
  misc_feature (149)..(150): n is a, c, g, or t
  misc_feature (155)..(155): n is a, c, g, or t
  misc_feature (164)..(164): n is a, c, g, or t
  misc_feature (167)..(167): n is a, c, g, or t
  misc_feature (172)..(172): n is a, c, g, or t
  misc_feature (190)..(190): n is a, c, g, or t
  misc_feature (209)..(211): n is a, c, g, or t
  misc_feature (215)..(215): n is a, c, g, or t
  misc_feature (238)..(238): n is a, c, g, or t
  misc_feature (253)..(253): n is a, c, g, or t
  misc_feature (268)..(268): n is a, c, g, or t
  misc_feature (277)..(278): n is a, c, g, or t
  misc_feature (293)..(293): n is a, c, g, or t
  misc_feature (311)..(311): n is a, c, g, or t
  misc_feature (318)..(318): n is a, c, g, or t
  misc_feature (324)..(324): n is a, c, g, or t
  misc_feature (345)..(345): n is a, c, g, or t
  misc_feature (354)..(354): n is a, c, g, or t
  misc_feature (365)..(365): n is a, c, g, or t
  misc_feature (379)..(379): n is a, c, g, or t
  misc_feature (383)..(383): n is a, c, g, or t
  misc_feature (387)..(387): n is a, c, g, or t
  misc_feature (400)..(401): n is a, c, g, or t
  misc_feature (416)..(416): n is a, c, g, or t
  misc_feature (420)..(420): n is a, c, g, or t
  misc_feature (437)..(437): n is a, c, g, or t
  misc_feature (441)..(441): n is a, c, g, or t
  misc_feature (450)..(450): n is a, c, g, or t
  misc_feature (457)..(457): n is a, c, g, or t
  misc_feature (467)..(467): n is a, c, g, or t
  misc_feature (479)..(479): n is a, c, g, or t
  misc_feature (484)..(484): n is a, c, g, or t
  misc_feature (491)..(491): n is a, c, g, or t
  misc_feature (495)..(495): n is a, c, g, or t
  misc_feature (502)..(502): n is a, c, g, or t
  misc_feature (508)..(508): n is a, c, g, or t
  misc_feature (512)..(512): n is a, c, g, or t
  misc_feature (516)..(516): n is a, c, g, or t
  misc_feature (596)..(596): n is a, c, g, or t
  misc_feature (598)..(598): n is a, c, g, or t
  misc_feature (667)..(667): n is a, c, g, or t
  misc_feature (701)..(701): n is a, c, g, or t
ccaagtcagcctganttgactctcattgttcccctatctacccacagtccccatccaacacgaagaaatatttgcnttcacattacagcataaagnccaccnaaccnttganancngacttgcagtgggacancnannngncnnanggnncagangcattgaancanttggncatccagtaatggctcanccagtcagcccggcctggnnnatgncgttcaaagacttgacggtagtnatatccttctttggntttaggagtgttganggggaattnntgggctgcatttgcnatcattgcatcatcaacntgatgtncaaggngttcgtgtgaaatgttaaacnaggggttgntatttggggtngttgcatcactggngggntctnttggtggcgaggnngtgtgtttgggtgtnaggntgggatggtcaaaggtntttntgagggggngtttttntatcccattntttgggattgtnatttntggtggnaggnggaagtnattggnaggnaatngttgatctagaaatgggactgtcagttcaagaccatgggcagcagttgttcgatctgcgcggagaacatcaaacaaatananttccctcagaagcctctcactctcctcctcggctttttcaggagaaggagccttgtgaaaatatatgtnaccctgcgtaagttcatctgatccttctccaganaagatcaccacgctatctgtgttcttccgaatatacttg

SEQ ID NO: 517416 - DNA, 97 bp, Homo sapiens
cttgaagtttaggcagcccccccccccaactttatttttttatgggttttttgcaacaaatgagggttttgaaaaaaaaggacccatgtttttttta

SEQ ID NO: 517417 - DNA, 179 bp, Homo sapiens
aggttccaggctgttgtcagtggtagaggggatagcctgacttatagcgtctgcccacttccatagtggatgtaaataatcccaccacggttgatttcaagctaccaacaccaggtgactgaatgtggagttgggcagtagcacacctctatattattccctccatacagatacgacaa

SEQ ID NO: 517418 - DNA, 1045 bp, Homo sapiens
  misc_feature (352)..(352): n is a, c, g, or t
gcgaaagccgacaggaaaagcgctccctcataccggggcggtttgaagaagcctcatcgctacaggcccgaagaccgtgggcgcgtttcccagtagattcgtcgttgtcaggaagttcgtagtcgaggctgctcagtccgtgaagctgactcttcccagtagtgttggtgagggacatcgcgcaaggaattctcaaaaaacccgaccctgaggtttcgagtagctgctcagacacggatccggtgctgcttgcgaggaggcgtcagtcgaatgcaggtacgctggatgtggatcgtagatgtcgaatataccaaaaacttgtgtgctcgaatcccaatgcataagtaggagntcgcctatcaatgctcgcaatggaactaatccaatgttagtgcgtcgcgccggtactacgcgcgggagaagagaagctgttagatgtgcaaatgggctagatattattatgggcggtatttaagtggaattagaaatttctgatagatatagtattgttctgggtattaatctggtgggatctatctttggctgtcagagcatagattgtgtttattaggtattgtatcgtaatatatgatcgtataaaaagattccattactcaatcgtatatgcactttcatgtgaattgcatactagcgaaacaaagtgggttggtccacaagtacccgtccagtagagtgttgaatggcactgttagggatccacggagatgatgaagtacgcatatgtattgcgagaaagagggatggtgtagattacctttgttgccttcgtcatggagtgccggtgatcacctagtatagatagagcgaccgccggtatgcgatagcatccttcatccgaaacgaatgaagttcgataagatgtggtcaaggggtcctgttttgcaagcccacaaaagttggatattggcgatggcttaatggagcttcatggggaagggagaaatctggagaaaccactggggacgggagcacgcacgtaaatttagaacgaggctggtggattgaggccccggccagaattgtg

SEQ ID NO: 517419 - DNA, 213 bp, Homo sapiens
gtccatcagttggttggaggcaccttccaggggtatgggagaagacgagtcttcgtcccatcagcaatatcttaaagaacaagaatcatatgataatagattgcttatgggagatgaacgtgtaaagaatggccttaatttcatgtatgaagccccaccaggagctaaaaaagaaaacaaagagaaagaagaaactgatgggagcaagactgg

SEQ ID NO: 517420 - DNA, 268 bp, Homo sapiens
  misc_feature (7)..(7): n is a, c, g, or t
  misc_feature (83)..(83): n is a, c, g, or t
  misc_feature (126)..(126): n is a, c, g, or t
ctgagtngggggtcgtgggccagtccccgaggagctgggccctgcacaggcacacagggccggccacacccagcggccccccnacagccacccgtggggtcatgcccttatgcccggcgccggacncaaactccatgtttggtgtttgtctgtgtttgtttttcaagaaatgattcaaattgctgcttggattttgaaatttactgtaactgtcagtgtacacgtctgggaccccgtttcatttttacaccaatttggtaaaaatgct

SEQ ID NO: 517421 - DNA, 266 bp, Homo sapiens
acggtgggagcactggttgacaaacaccccaatggaagtgcttgatgaaactgtatactgcatttactttttaaggaacccacctgtgttcccaagctgtgcattgtacatcctaaccaccgctaggacctggataaaagggggctaaggcgcagttaaataaaatactgtgagttactgcccatttgcattgggcttttagagggaaaaaatctagccgggtccttgactggatctcccaaagatacttttcaatcatttgaatg

SEQ ID NO: 517422 - DNA, 396 bp, Homo sapiens
aatggaatcaaaggcaatcatggtccaatggaatcaaatggagacaccattgaatagaattgaatggaatcatcacatggaatcgaatggaatcatcgtaaatgcaatcaagtggaatcatcgaatggaatctaagggaatcatcgaatggaactgaatggaatctttgaatggattcgattggaatcatcatcgaatggacttgaattgaattatcgaatggatttgaatggaatcatcatcgaatggaatccaatggaatcatcgaatggaatcgaatggaatcatcattgacttgaattgaatggaatcatcaaatggactcgaatggaatcatcatagaatggaatcgaatgcaattatcgaatggacttgaatgaaatcacctttgaatgg

SEQ ID NO: 517423 - DNA, 499 bp, Homo sapiens
cacgagggcgacgaccagcgccagctccatcggcgccttcagcggcccggtgacgaggaggcccgccgcataggcgccgacgccgaaataggcggcatggccgaaggagacgatgccgccattgccgatgagcaggttcagcgagaaggcggcgagcgcgaagaccatgatctcgatgccgaccttcaccttgtaggtgtcgccgaagaccgggacgagcagcagggcgacggcgaggccgatccacacgagcgtctccgttcgggtgaaggtcttgaggttcaggatgccctccggcagcacggcgcggcccgaggccacctccggcttgccgagcaggccccagggcttcaccaccagcaccaccgccatcagcaggaagaccagcacgagggtgatcttcgggaagatgaggatgccgaaggcctccagcatcttgatgatcagcgccgcgatgaaggcgcccggcaccgagcccatgccgccgatgacggtgacg

SEQ ID NO: 517424 - DNA, 567 bp, Homo sapiens
cagaactttctcttgcatggcaccaagaatgttaccgaattcaagcagtttaagattgccaatgacaaagatagtgatggtggtgcacgaaaaataatcactcgtgaacatataatagactgaggagatatagtcgtgactctagccaaggccactcatgatacatgaaaaacacgaatcaggcgtgccgaagtatagtacaccaaagaatggctacagcagtaatgcgtatgagagaccacatctaacggggatacgtctacgagactggacggccaccacagcacactagacgcacgatcgacgaaggcatgtgagctccagcgagacagcgaaacaaaacattaggccggaacaagacgaccagaccacgacacgacaggaaccgacagacaaacaacgatacaacaagataagagagaggaaacaacgacaacgaaagaaacacaagagcaatatcacgaacacgagagagaacacaaatacgaaagagcacaacaaagaacacagacacaggaacaggggaacacgacaacagagcaacaacagcgaaaagagcaagaaaca

SEQ ID NO: 517425 - DNA, 272 bp, Homo sapiens
gtcgacacacagtaacctcaccatcaccacagcatcaccatcactatcatcacaccattaccacacagtaacctcaccatcaccacaccaacaccacaccatcaccacaccatcaccacaccatcaccacaccatcatcacaccatcaccacaccatcatcacaccatcaccacaccatcagcacaccatcaccacaccatcaccacacagaaacctcaccatcacaacaccatcaccatcactatcatcacaccatcaccacactatcatc

SEQ ID NO: 517426 - DNA, 307 bp, Homo sapiens
  misc_feature (235)..(235): n is a, c, g, or t
  misc_feature (251)..(251): n is a, c, g, or t
  misc_feature (290)..(290): n is a, c, g, or t
gagacggattttgctcttgtcgcccaggctggagtgcaatggcgccatcttggctcactgcaacctccgcctcctgggttcaagcgattctcctgcctcagcctcccgagtagctgggattacaggcatgcaccaccatgcccagctaatttttgtatttttagtagagatggggtttcaccacattggccaggctggtctcaaactcctgacctcaggtgatctgcacccccgnttggcctcccaaagtntgtgagccactgtgcccagcccagagtttctatcttttngatgtatcttttgaaga

SEQ ID NO: 517427 - DNA, 250 bp, Homo sapiens
cttgacgatagctttcaattattcatggcaccatttgttgaattgggtatcctttccccactttataacatcaaacatctttgttgaagatcagtttggctgtaagtattaggggtttttttctgggctctctattctgttccattggtctatgtgcctatctttatgccagtaccatggatgttttggtgactatggccttatcgcatagtttgaaatcaggtaatgtgatgcctccagatttgctctt

SEQ ID NO: 517428 - DNA, 910 bp, Homo sapiens
gtctctcgccaggcgtcctcgtggaagtgacatcgtctttaaaccctgcgtggaaatccctgacgcaccgcggtgatgcccaggaagacagggcgacctggaagtccaagtatcttccttaagatcatccaattatttggatgattctccgaaaatgtgtcatccgtgggagcagacaactgtgggctccaatagcaagtatgcaatgcatgatcccggtagtgtcccgttcggcgagtgaagggactgtggtgctgagtgggcaagtaacaaccagtgatgcgcatagggccatccggagggcacgcgtgggaaagagaaaacccagtcttctggaagaaactggtgcgcatcgattatcgcagggggaaatgttgggctttgttgttcgaccaagggaagtgactctcacgtgagtagtcatgggaacaatgtggctggacactaaggtgcaagctagttgcccgtgctgatggcatgtgccccatgtgacagtctctgtgccagcgccagaatactggtctcgggcgcgaggaagacctcctttgtccaggctttaggtatcaccactaaaatctccaaggggcaccattgtgaaatcctggaggtgatgttgcaggctgatccaaggagttggagacaaaaggtggggagcaagcgaaagccaacgctggcttgaacgattgctcaaaatctacccccttctccttgtgagtggctcatccagcagggtgttcgacaatgggggatctaacaacctgaagggctgaactgacagaggaaatctggatctcgttcctggaggggtcgcatgtgcccatgtcgttgaacggcgtcccacttttttctacccttttataaacgggaaaaaccggcttttggggagtaaccccctgtgaaggagctctgt

SEQ ID NO: 517429 - DNA, 435 bp, Homo sapiens
tcataaagaccggtagatgagttggcttaggtgaccagtgtcctgctcgcggtgatcgatgggctctacaatatgaccccacagcaacagatactggatattttttattttttgagaaggagtcttgccctgtttcccaggctgccgtacagtggtgcagacatggctcactgcaacctgcacctcccaggttcaagcgcttctcctggcttagcctcccgagtagctaggactacaggcacctgccaccacgactggctaatttttgtatttttagtagagatggggtttcagggttgcccaggatagtctcacttctggacccaaccaatattcccgccttgggctcccaaagtgctgggattacaggcattagctagaatgccacacgaattttttttcctaaactacaaccttttttacaacccagagtgt

SEQ ID NO: 517430 - DNA, 101 bp, Homo sapiens
tggttgaaacatgagcctgtttggctacgactaccagcgagagatgaagtggccacctggggcgccgcgactttcctatcaactgacttataccatgttag

SEQ ID NO: 517431 - DNA, 322 bp, Homo sapiens
tatcccccttcgtgcttgcatctcgtacgtaagccacactttattagacggccaaggagaaggggtgggccagcggcgttttatcctccaagatggtcttccgcctgcccccattgacatcgatgcttgagatggagtgaagtttggagtcaacccagtagaggcggccactgaggagatctagacacacaagtggataaggagaggtcacgtgctgatgccagtcccagaggggcctgagggcctggccacgctgctccgggcaggaagaccccctgccagggacctagcagaaaagcaccctgtagaggcagctccaacc

SEQ ID NO: 517432 - DNA, 436 bp, Homo sapiens
cctacatataaataccactgtcatctcctcccaatttactgaattgatctggaaacacctcactcatttctttgaaaaatgtagtaagaaacgcagtatgttgtattcagacatagggatcataggtccaaaagagtccaactagtatagtctactgtcacatgtgagtccggaggactctctgatctataccccaagatagtgtatgcccaggtgtatcaaattctggcgatgactcgaatcccactgtaatcaggcatattcaatcaccatacggacatcatttgttgtataaactatgagacaaagaatcgctccctcaatagctaaactcaggagaagtgatgctctgatatgggaaacacgggccataccgtatcccggcgagtgaagaacataaaactgcactaacaagccatgggccaatcaagctaga

SEQ ID NO: 517433 - DNA, 410 bp, Homo sapiens
  misc_feature (232)..(232): n is a, c, g, or t
agccagtgggcccgaggatattggtttgtgcccccccccttctccccgaggtagaacccaaacccctggggaaaaatttccaaacccggtgttttatgcttacgaaaccccccaaaaatcaggtttttgtgcttgccaacccaaaaaagaagctcccaagttgctgaagacttgaaattgtaaagaaaaaaaaatttccccacgccttctgtctgtcaggccctgaaacttntaaacccaaaaagtgttaaaaacctggctagtgtggaagcatagtgacccccccgattgggtagggtttaatgttccccccccctttttttaaaaaaacccagttttaaaaatttggtttcaaggggccctgggtgaaaccaatattggatcccccccaagtgacccctgttttttta

SEQ ID NO: 517434 - DNA, 490 bp, Homo sapiens
gaatcgcttgaaatccgagagcagaggttgcagtgagccaagatcgcaccactccattctagcctgggcgaaagagtgagactctatttataaaaaagaaaaaaaaaaatccttgtattatgcttaaagcaaaaacctaacatgaaagtgttctaacattcaaagttgatgaatcaggaagtggctgctattaaagtgtagcaaacctgtctaactgactcttagaagttgatcactttatcaaaactggtgttttacatataaaacaaattatatctctatggagttctcaaaaatacatggtggtacttgtagaaattcacccacagcccaaatgcaacaaaatttcttctacagaacctatacagatgtatcttgctttatacaaagtacatattccagaagctgtgtggattatatgttaaggctatgtatggactgaggatcacattacgttgtgttaatgagagtcattgtacctctccactgt

SEQ ID NO: 517435 - DNA, 122 bp, Homo sapiens
caaagacccactgtatgcacacaactgttcttgctggtttgggataggctgccatgcttttttaatgttagtacagcctgtatattcattacggaattcagataaaatttccttatgttaaa

SEQ ID NO: 517436 - DNA, 385 bp, Homo sapiens
cgtgtccgtatagcgacattctatccagtctgcgacatgctaggcagaatgatgaagtctgtgaattgagtataggctcccataccctcaggctgtcattgatcagtgacaactttataaaaacaaactgcaaagtctgtggctcgtggatgcctgcttcctagaagtagcccattaaggttaaactctgtggtcggtatttgcaagcgccgggcgtggtggctcacgcctgtaatcctagcaccttgggaagccaaggcaggcggatcacccgaggtcaggagtttgaggatttgcaagcaaaaggtcctctcctgagtctttcccagatacccagcagtgcagaggctagctgtggaaggttgcagtgggacacgaatgttca

SEQ ID NO: 517437 - DNA, 867 bp, Homo sapiens
catcatagttaagtgaatgtgtcgtgtaaacttgacagtatgtaatgccttttaaaagatcattatgcaggctgggcacggtggctcgcgcgtgtaatcccagcactttgggaggccaggacgggcagatcgcttgagcccaggagttcgagaccagcctggccaacatggcgaaaccccatctctactaaaaacgacaacaaaaagaaaaattagccgggcatggtggcacgtgcctttagtcccagatactcaggaggctgaggcaggagaatcacttgagcccagaaggcagaggtttcagtgagccgagatcgcaccactgcactcaagcctgggtgacacagtgagaccatgtctcaaagaataagatacattttgcatgcccagcttacgtgcagttcaattaccggaaccagcgatagccgtgtgattggtgagggggaataaggggagttaaatcttctaggtacgcacagttctgggtcatgatgggcaagaaccacagtgtttgacgaaagatccaaccttttggaagtatgctggatggaaggccatgtgttgacttctttgacaaggaaaatgttcaagcaatttttccctgtgtggtgatgtggtgccttgtcaggccccggctcatcggggaggctgacgccggaggtgtcatcgaaccaggggtcaaggttgcagtgagccaggaacaggccattaactccagctgggtggagaagaccccctttaaaagaagaaaaagggaagaaactgtggggcccgcccccaaaattcaaacactgtggggggccagagaacagtcaaaggcccgaaaacgcagaggggttcccaaaacggggcgggttaaacaggtgg

SEQ ID NO: 517438 - DNA, 427 bp, Homo sapiens
  misc_feature (320)..(320): n is a, c, g, or t
  misc_feature (419)..(419): n is a, c, g, or t
cgcaggaatttggatgagggatggggccccagttcttgggggaagctgattcatggactgggatgggctggttgggactcaaactttgttgcattcttggagtagaagacctcctggaatggggacagccacctttctccatgtacccagggatgagagaaagctggtttccgaaaagaagaatgaaatagaattgcagagagaagcagagataagatctgtggtgcacacaagttacatacactaccttggttctgcatgtcttcctggttcctggttctgatcccttatcacctccagctgtacttcctgcccttggnttccatgaagtagcctcattcctttccagttcagtttcctttttatgttttaagccagttttcagtggggtgtctgtttcttacaaccaaatgtttccnttgttgaa

SEQ ID NO: 517439 - DNA, 233 bp, Homo sapiens
aatacataggtatcgtctgagctatgatatcaattggcttcctagaggtttatcgtagtgagcccaccatatatttacagtagaatagtactgactcactagcattttcacctccgctaccattatcatcgctctccccaccggcgctccaagtatttagctgacctcgccccactccacggaagctatatgaaatgatctgctgcattgctcttagtccctatgattcatct

SEQ ID NO: 517440 - DNA, 431 bp, Homo sapiens
aaatgtactctttcatcactactttaaagtaaaagatccaatggagtgatggtgtaccgttctgtcacgtatatgtgccctgtgtactttttctatagtcaatctgagtttagtgtccttcttgggtttacactaactgttgtaagctgtgttggcattgttcttaggacaatggttttaatacaggttaaggctgcattcaggagacgtttccaaaccatcctggaatcacctgagtttggtaagtcgccctcttataccatccctaaggctaactaagttagatgttactcattagaacacacaaataatcacagattttcctgaagatgttgagccagctatgaaagttatcccctccacccaattttggtcctaacaagtgttctgaacccgatttccaaagacataacggtcatatatgaactaca

SEQ ID NO: 517441 - DNA, 232 bp, Homo sapiens
aaatgtccacggaggactgtgtgtcataggtggacctgctgccgtgttgcaggcgctcctgtggtgaggcccagacatctgccaaagtgtctgagcgagcacgagtgttggggacgacggacccactctggccacacggcgaccgagtgacagatgggtgcctgtgtcccataggcttgcctgaaggtgggtagggcgtgctgcggcatagtggggtggctgtgggctccca

SEQ ID NO: 517442 - DNA, 175 bp, Homo sapiens
cccatttttgaaaaagtttttttccaaattttaaaaaaaaaccccttttttttttttaacccccagggttttctttcccccaaaatttggaaaaccggttgattttgggcccccccccaaaaaaggaaaaaaggcctttttttttttttaaaaatggggaattgggagggcccca

SEQ ID NO: 517443 - DNA, 885 bp, Homo sapiens
  misc_feature (76)..(76): n is a, c, g, or t
  misc_feature (106)..(106): n is a, c, g, or t
  misc_feature (237)..(237): n is a, c, g, or t
  misc_feature (495)..(495): n is a, c, g, or t
cggacgcgatcgggcgttttattaataggaccttagagaatagactcatcaggggattctttcttcattttttcanttggggtgggggtggtgtgtgctacttaanaataccaaaaataaatcactcatctcccactttgcctgttcaaccttgttaacttccttgggaacagtgaaaaaatgagggagggccttggagagttaatttggctctgtgacactaaaatgggggggagngaaaatgtgggcctggaaataccaaacctgtcgtctgcaaaatgaaagaagcctgagagaacacagctttcaggaacaagcagttgaatgcaaaaaccacacattttttaaaatgacaagacccagagccccagaacatagggctctctccatcctccatcgctttctcatgggaggccaagggcagccacctgacagggcttttagaaggggggctgggatcctaccacaggccagcacttcctcagactggcacanactctgctttgggcttaaatgtaaagggctcttcactcctccactggaggggagcagttctgtggtggggcagttgggttccattggatcacgtagctggccggaaccataataaactggtggagggggtaaatgggagacccctttgggctcgggcttgcggtgggtggggatggtaaaaggggacccggagcgggggctcgggatgatgggggtggggcgatggaagctccgttcggggatcaacgaggggggtggggtgggggtggtataaaagacggggtggggaagagtgtggaaaagtggtgggacattaacggaaggcgctggcgggggagagagggggccgggggggccggcatagccttgagagagtggccgcgggggggg

SEQ ID NO: 517444 - DNA, 203 bp, Homo sapiens
gaggggctgctggcataggtctaccgactggtttgcgtgcacgcgctactgctatacacgacatagacatcatgctatagcgtgggatcaaacacgattgtaggcgaccacggatactctctgggcacacagcgacctctggacatataaggccctatgtgccataagatgcatgcaagcacatacatcggactggggtacaa

SEQ ID NO: 517445 - DNA, 266 bp, Homo sapiens
tgaatgaattcgcgcgaaggattgatgcggtcgggagcaaacgcacgatgcagcgcctgctcgacttttttggcatccggcacattgcatggcatagacacaatcgaagggaagcggaaccgcgctgctgctccccagggatgcgatgcgctcgcccgcatccgaagcccgcgtcataccgatcttgacgataccgggcatggccggattcgtaagcacgtagaccgtctgaagttcctgctgtaagtgcgcgtcgtccatttttt

SEQ ID NO: 517446 - DNA, 899 bp, Homo sapiens
  misc_feature (46)..(46): n is a, c, g, or t
  misc_feature (254)..(254): n is a, c, g, or t
  misc_feature (369)..(369): n is a, c, g, or t
  misc_feature (482)..(482): n is a, c, g, or t
  misc_feature (492)..(492): n is a, c, g, or t
  misc_feature (501)..(502): n is a, c, g, or t
  misc_feature (508)..(508): n is a, c, g, or t
  misc_feature (513)..(513): n is a, c, g, or t
  misc_feature (518)..(518): n is a, c, g, or t
  misc_feature (523)..(524): n is a, c, g, or t
  misc_feature (549)..(549): n is a, c, g, or t
  misc_feature (553)..(553): n is a, c, g, or t
  misc_feature (557)..(557): n is a, c, g, or t
  misc_feature (583)..(583): n is a, c, g, or t
  misc_feature (586)..(586): n is a, c, g, or t
  misc_feature (588)..(588): n is a, c, g, or t
  misc_feature (603)..(603): n is a, c, g, or t
  misc_feature (605)..(605): n is a, c, g, or t
  misc_feature (618)..(619): n is a, c, g, or t
  misc_feature (635)..(635): n is a, c, g, or t
  misc_feature (665)..(665): n is a, c, g, or t
  misc_feature (685)..(685): n is a, c, g, or t
  misc_feature (687)..(687): n is a, c, g, or t
  misc_feature (699)..(699): n is a, c, g, or t
  misc_feature (707)..(707): n is a, c, g, or t
  misc_feature (751)..(751): n is a, c, g, or t
  misc_feature (756)..(756): n is a, c, g, or t
  misc_feature (758)..(758): n is a, c, g, or t
  misc_feature (782)..(782): n is a, c, g, or t
  misc_feature (794)..(795): n is a, c, g, or t
  misc_feature (806)..(806): n is a, c, g, or t
  misc_feature (811)..(811): n is a, c, g, or t
  misc_feature (816)..(816): n is a, c, g, or t
  misc_feature (818)..(818): n is a, c, g, or t
  misc_feature (822)..(822): n is a, c, g, or t
  misc_feature (833)..(833): n is a, c, g, or t
  misc_feature (891)..(891): n is a, c, g, or t
ctcgacatgttggcctatgggcaaaggctggaagcagagcgaatgngagcagagcacacagagccgtggagcgagagatgccggccctgggctgggccgtggctgccatcctgatgctgcagacggccatggcggacctccccggggactctgcccaggaaggcaggggtgttttcagacctaagcaaccaagagctgaaggcagtgcacagcttcctctggtccaagaaggagctgaggctgcagccctccantaccaccaccatggccaagaacaccgtgtttctcatcgagatgctgctgcccaagaagtaccatgtgctgaggtttctggataaaggtgaaaggcatcctgtgcgggaagcccgntgccgtcatcttctttggtgaccaggagcatcccaatgtcaccgagtttgctgtggtgcccctgctcagggccctgctacatgcgagcactgtcccccaggcctgggtaccantcctcctggncatcgatgnncatctncacancagantatgnnctcctctaccacaccctgcaggaanccancaancccctgcatcagttcttcctcaatancanangcttctcattccaanantgccatgacaaanncctggccttcaccgangtggccccccggggtgtggcttctggccancgccgcagttggcttatcananaacgctatgtanaaagctantttctgcaccccactgggctggagctcctcgtggatcatgggancacanangctgggcactgggccgtggagcangtgtggtacaannggaaattctangggancccanangaantggctcggaantatgcagatggagaagtggacgtggtggtcctggaggacccgctgcctggggggcaangggcatga

SEQ ID NO: 517447 - DNA, 964 bp, Homo sapiens
tcgtgccactacactccaacctaggtgatgggaacgagactccatctgaaaaaaaaaaaaaaagaaaaaaaggaagaaacaatattccttaccaaatccagggtcttaaactcacttgggagtggctggtttgtaaatggtggtggttggtggatgtggtggctctacaaatatgttttgacgcttcggcttcattcacccaacccaccatccaattcacgctagccgttattaatcaccttataggtgggtccagaccctctgggagagcattgggcaaccacctggcttggggggcagcatccatgttggggttacaacggagcaaggagttgaagtgggtttgcacacccgggggcggcgccacaggggtttggaagtaacacctggtggtcactttggcaatttagagagatgacaatctccggctattggaaggaaattagagccttagcccgggagtataggaaattcgaacccacttcagagggtcccaatcaaggtcgcatggtctgggagacgaattaccggcacagaaccgctcctagaagagccaggaagaagggaacccagtctggtgtttggggcaaccacttttcggtcggagacaccttacacttggggtgaaagtccagacccaacgttacatcagcggcgcggcaccaacacttactcggtgtcgacaaactaacttatcctgaaaaaggggtgacacaatggggaggactggagaagccggcactggctttaaaccacagggcttggcccctgttcaacattggggtggggcgaagatcacctatacctgtcccacgttgtttcccccccggaagagggttaccaacggcttatgggcaagtcgggggatcacatgacaacttggccgttccactatggcacacagctggacggcaccggtgcgcaccacggcatcccagtgttcgcatcaacatagacattacgc

SEQ ID NO: 517448 - DNA, 1107 bp, Homo sapiens
agcgagcgagcctatatctgtgcccaccctctggtacattgtgacatgctgcaggcacgcgcgacaggtgtcccctgtctaccgcgccgcccctacccatgggcccgattgactgagatgatcgtgattactcgttgtgtcttcacgtaacggtgcttcgcggtaagtctactccacatgggttacacgtccgttttatgttgccccgttggcttgcatccctgcagatgtggtgtggtctgccactgggccatgccgggaggagtcccatcattacctatggcgtatttgactcgtgcatggacagttgcatcctcttagacacgggagccgatctcacagtgttctcgacacgtggagtccgagataaagcatggtagcacatggaacttgcatttgagcccactgggaaacttggacgtgcgatatgtcatgcggtcaattagtagggacgtaccatcctagtagttcgtgaagaactgcgggcataatgcgtgacttgcctccaggtgctgtgagagtggtctgaggggaccttgtgtcagcgttgctcggatatgaccactatctcctgtcttcgagaccagcatcgattcctccgtacaggaaagcgagccttggaataagacctcctgtacatgaagtgctagtttcatcttagatactaggaggagacaagtacaggccactttcaataaacatgattactcaagggacacccatttgtataccacaatgaattatcaatgagtgtcccccaaatactggtgggtcctggtttggcctttttgcttgtccctttgtgcaacatctggtacctctttatgcaaacctaggccttctagatagtgcgttgaccagtcggggaaccccttgaggaatcggcccctttttgggttgatccggcccgccggagatcccccttttgttcactcaccccctgtcaagcagggcatggcctccaagaatggctaaaaggaatcacagaacacaacaggttgccatgccaaaaatccccttgggggttcttgacgcccctttagtttttcaatccattctcaaggaagatgataggggaagctgtcttcacgttgaagaagttcccag

SEQ ID NO: 517449 - DNA, 165 bp, Homo sapiens
tagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaat

SEQ ID NO: 517450 - DNA, 152 bp, Homo sapiens
aaaaaattttggggtttttttccccaaccccccttttgggggggaaccaaaaaaaattcttttttcggggtttttggggccccccttggggtttaaggcttttttttttggggttaaaggggttcccttaaaacctttttttttttttttta

SEQ ID NO: 517451 - DNA, 369 bp, Homo sapiens
agagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaaggttaatagagagcaatt

SEQ ID NO: 517452 - DNA, 114 bp, Homo sapiens
ggcggcccgattatcaatactccactttctgtcataaaacattgagagaatatggtaaggaaacagaagactagaaggcagtaaaaaaacaattatttttaataaggatcccct

SEQ ID NO: 517453 - DNA, 1003 bp, Homo sapiens
  misc_feature (469)..(469): n is a, c, g, or t
  misc_feature (494)..(494): n is a, c, g, or t
  misc_feature (762)..(762): n is a, c, g, or t
  misc_feature (971)..(971): n is a, c, g, or t
agcgggcggacgggtccggaggtgacgcttgatcgggcccgagttttctcgtgtggtgctaccgaggtgtccagccaggacaggtccccctcgccgggtcctgtctctcctctgtggctacgaggtgccgctctcgcgtcggtaggcgctcgtcgcggatctgagtatcggaggggctgtttggtgatggccatggctgcagtggcatgggggtgcgttagccggttgaattgggatgctgtgagcggcgtgcatgttctccatgactgactacgattgagttacctggagcaatatcaacagctgtgaatctgcttgcaaagcacaaatgtgccttacaaccgaagacgtggagaatgcacatttgaatgcgcgcacagcgagggcaagtgcttaccgcagtggttccaggcctcatgagcggtgcatgggggatattagagaaacgtgaaaattgttagaatcgtgntgattgaacgcagttataatggtancttcctaggacatggaatttgtcaattgaaagatcaagagggggaagagtctaggacagtgtaggcaagaaactcttgtccttgtagagtcattactcattcgagggttggaatgatgggagcattttaggagatgcaaggagggaaggaaaccagttttgttttccttcacgtaagttccatggatggacaaagtactttgacctgggttatccaagggaaaatctcagcgtgtagatttccgtaaaaaatcacgatgtggtatacngcgaggttaagccacaggacacacgagtatttcaaggcccacaccacaagttttgttgagggaattgtgattcggctataatcagagggcaaccttttgggaaaaagacccattgggcgttcttttcaacattttaatgaaggacgataggttaaaatcacaaactcccaacatgggtaaaacgcacaaacgcaacggccgtgaatacnacagtgaggaacagattgttgtttcccccccg

SEQ ID NO: 517454 - DNA, 448 bp, Homo sapiens
  misc_feature (115)..(115): n is a, c, g, or t
ttgtgcctatcgtgagacgtagatggtcagttgcatcagactcaagtgctccgcttcattgtagatagatgtacggaagagctaggatttcacgtctgctagtccttcgagaccnctaaggtcggatctcagagccatgtgtgtgcaggactgcactagccttgtcaatacgataatatacatatccgtacatagccccgttagtgcgcatagcctgcagcaacgcaagtgtccactcatggatgaatgcataaacttgtgatacatcatgcgaaaaggcgttggatccttcataaactgtgcatcttctagcatatgcgttcaacatagtcgcatctcgagcacccctgtgctcaaatcattaagcctgtcacgtgcagcgtcatgcttcgtgacgcaagtggcattgagtgcttggcatagcctcccgaacagggtcatacagtag

SEQ ID NO: 517455 - DNA, 512 bp, Homo sapiens
  misc_feature (504)..(504): n is a, c, g, or t
  misc_feature (507)..(507): n is a, c, g, or t
ggaagaattatagacttatgattttaaacctttgtgaaatcttagaaatcatctaacctagtcctttttgtttcattttttatattgagatgaaattcacataaagttagtcatttgaaaatgaacaatatcaatacttcattttttatggctaaaattccatttcatatatatatatcatatgttatatatatatttataaaatatatcccataatctgtttattcattcacctcttcatgaacatttaggttgtttttaccttttggctgtagttactagtgctgctatgaaaacacgtatgtacacgggtacctgttttcaattcttttgggtatatcctaagaggagaattgttagaaagtatggtaatactatgtttacctttctgaagaacagccaaattgtttccaacagtggctgaaccattttacactcccaccagcaatgtatgagggctccaactttttcatatgcttgctatcacttcttgttttctttaanaanaaaaa

SEQ ID NO: 517456 - DNA, 183 bp, Homo sapiens
tgtcatcgatgacatggaggacgtctctgccctggaccctcagatcgtgtgccagaccgttccctgcaaacagagctgtccgtggcacagtgcacgcagcggaccgtggacatcgtcttcctgctgtacggctccgatgcggctgggtgagcagaacttccacaaggcccggcgcttctgtgt

SEQ ID NO: 517457 - DNA, 367 bp, Homo sapiens
tcatagtccaaacagtgccaggctgtgttttattaaagggtaggcgatggctggacgcagtggctcacgcctgtgatcccagcattttgggaggccgaggcgggtggatcatgaggtcaagagatcgagaccatcctggccaacatggtgaaaccccgtgtctactaaaaatacaaaaattagctgggtgtggtggcgcctgtggtcccagctactcgggaggctgaagcaggagaatcacttgaacccgggaggcagaggttgcaataagccgagatggcgccactgcactgtagcctggtgacagagtgagactccgtcaagaaagaaaagaaaggaaggaaggaaggaacgaagggagggaggg

SEQ ID NO: 517458 - DNA, 867 bp, Homo sapiens
ctccagctggccctccccagtgttgtatccctggggtgcctccccctcggcgttcttcttcttagggcttttttggggccattcttgggccctccagggccctaggttcttcctgggtattctttgtaccttgtttgcggtttctagtctccctgcctccatctccttttcccggcgttctccccctcatttgcgatctcggagggatcttagaccaattctgttccgagtccttgcgtccctgtctttaaccctccgggactccctggagacccttggtcccgagcatatgcttcttataccaggcccctgccccttcttgcaccagcctcctatatcctgcccggccaacaccattgtagtcttctgggtacctcctccagcgtcccgcgcccgctcttgtcttgagcaacccctgctatctgttgcgtcccttccctcgtttgtgcttaggtgtttctcttccatgggctacatcatctccctctgacaacgatacgatccccccactgggctatccatcccccaggacattcccaacaatacccctgggcactctcgtgtgtgacatcacccccattcccattgacccatagatcgtgtgtttgggatctgttcttctccccaattatttgtgagccccttggccagataggggtggcacatttgtgtgttgtgcacatctgtgtacatatctgtgatggattcgcttgtttggtatatcgtgctgtgactgttacctttaactgtattggtatatatgttttgtatttttatcacgtaatccaccattatgtggcagccttttagctatagtttaccatggtccaaagttgaacccacccaaccaacctacaaattaaatta

SEQ ID NO: 517459 - DNA, 114 bp, Homo sapiens
agacttgccaccaatcttcatcctcattcattgtctatgatgccccagacaagaggacctaggagcgtgcaagatctctgaagtcctggggagcggtggagcaagggtaccgag

SEQ ID NO: 517460 - DNA, 418 bp, Homo sapiens
  misc_feature (47)..(47): n is a, c, g, or t
  misc_feature (97)..(97): n is a, c, g, or t
  misc_feature (103)..(103): n is a, c, g, or t
  misc_feature (112)..(112): n is a, c, g, or t
  misc_feature (125)..(125): n is a, c, g, or t
  misc_feature (129)..(129): n is a, c, g, or t
  misc_feature (135)..(135): n is a, c, g, or t
  misc_feature (138)..(138): n is a, c, g, or t
  misc_feature (157)..(157): n is a, c, g, or t
  misc_feature (169)..(169): n is a, c, g, or t
  misc_feature (177)..(177): n is a, c, g, or t
  misc_feature (181)..(181): n is a, c, g, or t
  misc_feature (183)..(183): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (233)..(233): n is a, c, g, or t
  misc_feature (238)..(238): n is a, c, g, or t
  misc_feature (250)..(250): n is a, c, g, or t
  misc_feature (254)..(254): n is a, c, g, or t
  misc_feature (257)..(257): n is a, c, g, or t
  misc_feature (265)..(265): n is a, c, g, or t
  misc_feature (278)..(278): n is a, c, g, or t
  misc_feature (280)..(280): n is a, c, g, or t
  misc_feature (293)..(293): n is a, c, g, or t
  misc_feature (307)..(307): n is a, c, g, or t
  misc_feature (311)..(311): n is a, c, g, or t
  misc_feature (316)..(316): n is a, c, g, or t
  misc_feature (354)..(358): n is a, c, g, or t
  misc_feature (375)..(375): n is a, c, g, or t
  misc_feature (379)..(379): n is a, c, g, or t
  misc_feature (383)..(383): n is a, c, g, or t
  misc_feature (392)..(392): n is a, c, g, or t
  misc_feature (398)..(399): n is a, c, g, or t
ggtccttcttgacacagcaccatcattcagaaatgttaaaaaaaaanacttctctcctttctatcttccattagcaaaatagaatcaagggcaaatncatggncgccttgtntcctggttacgangggngagggnggnctcctgggggggtgaggtnagggctcctgcngggcggcnttangnttccaagagtctgcncntncatgccacacactattatgaggcacagattnaagtnacatttacatantagngtncacgtgtnacctacccaaaancngggccatttcgcnaaacatatacaggnggtnaaatncgaacaagtgaggttctgggaacacaaatttttttgcnnnnngggttctgtttctttcngctnttgncaagccgtnatatannacattttgccactcgggat

SEQ ID NO: 517461 - DNA, 407 bp, Homo sapiens
cccacccagagcctacaaaaaagagctgggtagcaattcctactgaaacccatttccaaaaaaattggaggggaagggaattcctctcctaactcattcctacaaagccagcatcaccctgatacccaagactgagcaaatacacaacaacaaaaaagaaaacaatagcccaatacccctgatgaacatagacacaaaaatcctcaagaaaatactaacaaaccatatccagtatcacatcgacaagttaattcaccatgatcaagtaggcttcattcctgggatgcaaggttggttcaacataggcaaatcaataactgtgattcaccacataagcagaattaaaaaccaaaaccatatgatcatctcaatagatgtggaaaaagctttcggtaaaatacaacatc

SEQ ID NO: 517462 - DNA, 165 bp, Homo sapiens
gcttaagatgagggctccactttgttaaataaccttggatgattggaaaaataggactgacgaaaaggggaactatttaagctagtgaagtggttcgaattaagggttgaaaactaaacctctgagaataaggcataggtggtcgagatgaatatggggagggaa

SEQ ID NO: 517463 - DNA, 221 bp, Homo sapiens
ggatcctaactttcttactgaaggaagttcttcacaagtacccatctgccttcagggaagaaaacataactcattttggtctttcaaattcagttctcaaaaccaaatcctgttgtcagcaatctgtgtcccaacgcctttttcagccacagccttttccccggggaaataaggttcccaatgtaaatttctcaaataaccccctgaagattaaaaggaaa

SEQ ID NO: 517464 - DNA, 1436 bp, Homo sapiens
ctttttcctcacttatatataacgtcacgtgttttcttttatctctctctgcattgtttttttattccgcccggtggcgcggtatttatatattttttttcttcatctcgtgctatcttgttttctccttacttaccttcccttattttgttgtctgctttcataattttttataacagattttttgtttgttctacaactaataacatatcttgttttgtttgtcttttttcctcctttatttttatgctgcgcgtaaagttgttttgttcttcggcaatacacatacatttctttttcttcttcctacttttctttgcttgggtctggctatttgtgtgtttctggctgtctcgtgcggctggctgcgctcttgtttttttttttttgtttttttttttttgttgtctggcgcctccgctctcctctgtagcgttcccatcttgttgtgttttttttctttcttctctctttccttttttttttttttttttttttttcttttgtttttgttttgttctctttttctctctcttcttttttttttttttgttttgtgtcgttcctcgatttgtttgttttgtttgtttgcctcttctcctcccgctgtcttgcttctcttctcttctcgtcgtgttgagttagtttttattttttttttttctttttttatcattcttttgtgtttttttcttttcttcttcttctttttttttgttctctctcttgtttgtgtgttatttctctccccctctcttctctctttctttttctctctctcttcattataatatattatctctcttattttgtctccctctcttctctcttgatatttattttggttttcttttttcctctctcgcttgttttctcctcgtctcgtctcccgttgctttttatgttaacctcctccgccctcgtcttcttgtttatatattatttatttcctctcccccgcttggcgtctcctctcccactctattattctctttcgcgtgtgtgttgttctcctctttttctcctcctctcacttcttctttctcttttttttgctccctctctctcccccgtcggcggggcgctcccctcgctcctcttttttctccccccctcgcggcggagggggagagagcgctctcctccccacctctctctctttttccgcgtgcggcggcctccccccccttcggagagttttttctgttattatatatatgtagagagagaaaaacacactccgctgtgctctttctccccgctctcttcgttttaagataaaacaatttttttattttccccccccccccccccccgtgtggggggggcgcgcctcttctcttttgtgtggtggggcaccctctcccccctgtgtgtgtgtgtccctctcttgtttttgtgtgtgtttgggtgcgcccacccacccccccaccaga

SEQ ID NO: 517465 - DNA, 198 bp, Homo sapiens
gatctgtaatgatcaagtcagggtatttagaatgaaagagctactggaaccagttaacaagctggacactataaataagtgaggcccttgtttgctgggaccctctagagcttaagtcagcaatccagaggcaaaaatagcatctccctccaagctccttaagtgaagtgcatacggcttccccatgtctcctagatc

SEQ ID NO: 517466 - DNA, 135 bp, Homo sapiens
tgcgcgctcgcttttatacaccattacatgacactggctttatgttactcttgcaagatctttttgtttctaccacatgtcatgcaagccttcttcatccaacatattcacaacaatcatagcaaacaaacatgc

SEQ ID NO: 517467 - DNA, 142 bp, Homo sapiens
cgaactgggcctttgcagcttcttccagagcttccttataccatatctgcagtgactttaacatctgttgcactgtttgttgctcattttagctgtcttctaacaacgatctcacgctctggcgaatgtcagacagcagcta

SEQ ID NO: 517468 - DNA, 274 bp, Homo sapiens
tcttcagggatagaaggcaggagtagacaagatccaaaatacgtgcatagtggggtgtcacgagttatagagatggacagatactaattattagtcagaaaaaggatttcgctaagagtgctgtaaacttgaagatggtactccacagagagatgcagagaaagtaagcaatgaaggttgttttataaaggtgatgaccattatagagtcagaaatgggagtcgttgcaggaatttccttgggagtcgcttgcttccaagacatttagggtccc

SEQ ID NO: 517469 - DNA, 252 bp, Homo sapiens
ccccttctgtgctcccgcccttccccggcgagatagccttcggcctgtgctgctgcttccaccctcgccgttcctttgtaagcttttggtctgttatccggcgtctgtccctcttgtccctgaactcttcatccggacttgatacctgtccttgctgggaccccgtccacctgggagggccagtcccatgctcttcaagtcccaggcccttggcctcttgctcctcaagattccaagttgttattcttcttt

SEQ ID NO: 517470 - DNA, 163 bp, Homo sapiens
ctcagagatgctttcctgatatacccactgttcagaaagttatattatattcttcataagcctatatatattacttttatatattattatttttttggagatgaattcaccctctatggcccaggtgggattgcggggaattgattggggaccagtgaaacgg

SEQ ID NO: 517471 - DNA, 141 bp, Homo sapiens
gcaatcacaattacaatatatacaccaacgaacaatgttcaaccagtaactactactaatcaacggccatgatcatacaaaggcaaggcacttattcagtgaacactatcagaagaaatcttcctttatataattcctaaa

SEQ ID NO: 517472 - DNA, 759 bp, Homo sapiens
  misc_feature (207)..(207): n is a, c, g, or t
agcggagtggcgcgcatcgtaaactgcagagtctaggcactacggtcgctcagcaagcgtggtggcgagtctcgcttctaacctgaggttgcattccatgaacgcagtctctgccgagtgttaggcagcatcgcgcgtgatgctttgctgatgccctgggtcaggggcaggttcagtcgtcaccctgtgggttatgcctctctccgntcgccacgtcccggcgggggtcccatagtcccatcgaagcgctcatgagtgatggctgtgtctggaccagcggtccgtggtgcctggtgggtgcacgcggaggctcggagttccagagcttcgctaggcctcggacgagagcgagaacagcgtatttacttatgggatgtaagaaggcagaaaatcatttttgacttccttgagttctattacagtagctgtcaacctaaggcgcattagtcacgccgcaagattgtgaatgctctgaacgagtcaagtggagcaaacttgaccttaacatctagagctttctataataacgtacttggtgaatatgaggagtatattactaaacttatcaactagcacaagagttcttcctatgaatacaggagtcggaggcgtggataggactgcctgtaaaactagctcgtaagtggggctataccggtgaagggcattcagaaatacaaagcaaaccattgtgtttgcagtctggggaacttctggggtagggacgttgtcctagctatctccaggttccacagaacc

SEQ ID NO: 517473 - DNA, 216 bp, Homo sapiens
acagttaaaacaacggactatcaggaaacttttggatgtactctactgtctctgaaaaagagagaggtgtctaggacacgagcttaacccaagggcattgcattgttattgtgctgggattacgggcgtgagccaccgtgcccggcggcttcttttaatcttttatgcatcagtattagatggctcaattaatcactgagacacggtcgagccgag

SEQ ID NO: 517474 - DNA, 102 bp, Homo sapiens
gaattccacttcaaccgctacctgacacggcgccgccgcatcgagatcgccaacgcgctttgcctgaccgagcgacagagcaagatatggttccaaaacccc

SEQ ID NO: 517475 - DNA, 385 bp, Homo sapiens
aatagcaagatctcatcaagttcacatgtctttaaagataaatggaaaaaaatattcatctattttaagagtcaaagagatgagaactccaatgcagtgatgagcccgaataggtcctgccatttcccatcaacagactgaggcatcaggctatgtgggctctgtgcccgcccgtaaaggccatgccttgttttccttctaaaagctgtgcataatgactacaatatagggttcagtgaattccagctgggcccatgagaggaatccagtgaacaacccagcaaacattttaattaactgggacaggactggtcttccttctgtgggtgtatatattttaacctttggaaaatttagagttaaataaagaaaagcaaaagagaaa

SEQ ID NO: 517476 - DNA, 120 bp, Homo sapiens
gactgtaggtgctgcagtagtgaggcgacaagtggaaggctggagggtggagtgtttgctgcaggcaagggtagggaagatggatggggctcattgtttggcattgatgatgtccacgaa

SEQ ID NO: 517477 - DNA, 159 bp, Homo sapiens
cctgagaggtgggacacgggtctgtgctgcagagcctgtgccacatggaagacggggtcgagctcctgggcctgcactccgaggtgggcgcagggccagtctgtacccccgcagggcctgcgagggcccccttccagacaacgaccgaccgtgcgtcag

SEQ ID NO: 517478 - DNA, 395 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggccacctctggttctgccgctcaccgtctgcacgccccgccagctcgcactgtacag

SEQ ID NO: 517479 - DNA, 3165 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517480 - DNA, 3547 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcaggggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517481 - DNA, 1736 bp, Homo sapiens
gacacgtggatgatggggtcagagatcactgagctgcccctcaagggggcctggaaggagggtggtgcctaggcggtcgatggctgtcgttgtgctggcttccatctgatgagaggctcatcttcatggaggctcagagaaccaatgtaaagctgacaatagaagcgtctgatggcttccaacagtgaataccaaagagataagagaatacaacaacagaaagacgaacgacggacagaagacaacaaccaggtgttatccaccgagcagggggtgcgggacggcatacgcagaggagccctcccccgcaggagggcgcgcacccagccgacagagccaccgccgaccatactagcagcggcacaccaggaggcgcgccagacccaaagaagcgagagaagactcgcgagaaaaagaaagaaagagggcaagagcgagagagacaacgcacgccgaatcaaacaggagagggacggcgagggcgagcacacacacagaagagagagaggggaaccgaccagcagaagcggacagcacagcagcagcgaacataccacaggcctgccggcgcggcgaggacagcgaggaagatggggagagaacagcgaggaccacacccaaagacgaggactacaacgcacgcgcacgacacggcgggcggccgacacaggagcacacaccccgcgacgaagggaggagatcgattagagtgcgtgagagcaaacgaacagaggccgagggacaattccaaacccggagagaaccggcgcagaacacaactgaagaagggagcagagaggcaggcgggcgagagccgtctgcagacacgcggcgggaaatgagaccggagaactgacaataagagagagaggaggagccggagagctgaggaggcacacgaagcaccgcccatcggcacgagaggaggtgaaaagagcagcgcacgctcgagggggcagcggccgcacaggggggacggaccgagccgcggggagaagagaggagaagataacaacgagacgggaggcagagaccagagaacacggaggcgtgaagagaacgagaagcgggagaggaaggaagagaaggaagaaaagagagagagcagaagaaggaagacaaggagaagagataacgacaagacgacggagaagcgagcagagagagagacgagacagcgacagcgcgagaggagggagagagggcagcagagaagagaggagagagaggaaggaagaaggagagcaagaaagagaagacaggcacggagagagaaggaggccgcgagcggcgcgcagccgcgtggagagagcagcggagagggctggagcagagggggagcggcacacgacagaggaagagacgaggagtgagggaaggcaagagtggagggcaaaggggagcaggacagcgacggagcgcagggagagcgcgcggagacgaagaggacgcggagacgagggacacgccgcgcgacgaacgggacgcgacggcgcacggaccgagcgcggccagaggcggacgaggcagacacgagagacgagacggagaggagaagtagagaagaaacagggagaagcgaggcagagcgacgggagaccagagcgagcgcgacgcgaccagagcacaaggaggaaaggcggagcggaggaggcagggcgcgcaagagaagcagcggacgagggccaggagggacacgcagaggccgcgcgggcgcgaaagagagcagcgcgcca

SEQ ID NO: 517482 - DNA, 103 bp, Homo sapiens
catcgagctcggtaccgctctggaggcagtgcctccgctcgccgcccgctgctcctcacccctgcctgcaccatcctccctcctgagagctcattcactccgc

SEQ ID NO: 517483 - DNA, 3520 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcaggggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517484 - DNA, 879 bp, Homo sapiens
  misc_feature (306)..(306): n is a, c, g, or t
  misc_feature (308)..(309): n is a, c, g, or t
  misc_feature (311)..(311): n is a, c, g, or t
  misc_feature (313)..(313): n is a, c, g, or t
  misc_feature (318)..(318): n is a, c, g, or t
  misc_feature (384)..(384): n is a, c, g, or t
  misc_feature (544)..(544): n is a, c, g, or t
  misc_feature (553)..(553): n is a, c, g, or t
  misc_feature (592)..(592): n is a, c, g, or t
  misc_feature (603)..(603): n is a, c, g, or t
  misc_feature (606)..(606): n is a, c, g, or t
  misc_feature (612)..(612): n is a, c, g, or t
  misc_feature (627)..(627): n is a, c, g, or t
  misc_feature (646)..(646): n is a, c, g, or t
  misc_feature (657)..(657): n is a, c, g, or t
  misc_feature (670)..(670): n is a, c, g, or t
  misc_feature (681)..(681): n is a, c, g, or t
  misc_feature (702)..(703): n is a, c, g, or t
  misc_feature (714)..(714): n is a, c, g, or t
  misc_feature (719)..(719): n is a, c, g, or t
  misc_feature (721)..(721): n is a, c, g, or t
ctgacctgcgacagtgaatcgacaatgccgtcttctgtctcgtggagcatcctcctgctgacaggcctgtgctgcctgctgcctgtcttcctggctgatgatcctcatggagatgctgcccagcagacagatacatcctaccatgatcaggagcacccaaccttcatcaagatcacccccaacctggctgagttcgccttcagcctataccgccagctgtcacaccagtccatcagaaccaatatcttcttctccccagagagcatcgctacagactttgcaatgctctccctggggaccaacgcngnnantnacgangaaatcctggagggcctgaatttcaacctcacggagattccggaggctcagatccatgaaggcttncaggaactcctccgtaccctcaaccagccagacagacagctccagctgaccaccggcaatggcctgttcctcagcgagggcctgaagctagtggataagtctttggaggatgtgagttgtaccactcagaagccttcactgtcaacttcggggacaccgnagaggccangaaacagatcaacgattacgtggagaagggtactcaagnaacatcttctntanaggcanatgggagagaccctntgaagtcaatgacaccgangaagaggactnccacgtggaccangtgaccaccgngaaggtgcctatgatggcgtnnatgcatgtttnacatncnccactgtcagaagctgtgcagctgagtgctgctgatgtacctgcgcaatgcgactgtcatcgtattcctgcctgatgatgggatactacggcacctggtgtctgccagcttacatttacccagactgctcattactggaacctatgatctgggcgtcc

SEQ ID NO: 517485 - DNA, 331 bp, Homo sapiens
ttcttgtagtatttagttcagtagatttaaaaaaaaatgtatcctttgctttggaagcctacaaaacaaccctaacgctgttttactctattaatatgcatggacatctctccctttggagtgacgcactttgcgcatcaaattctagggagaaactccatagaaaccaatgaacatactttcttccttaagtctgctcgtatacttcctctgcccctcacataaatataaaccaccagattggatcccttaacaatgcaaatcatattcatttcactctctacatcgtaactgtgcaccagaactgtcagtcatcactaacattctacga

SEQ ID NO: 517486 - DNA, 3138 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517487 - DNA, 937 bp, Homo sapiens
  misc_feature (306)..(306): n is a, c, g, or t
  misc_feature (308)..(309): n is a, c, g, or t
  misc_feature (311)..(311): n is a, c, g, or t
  misc_feature (313)..(313): n is a, c, g, or t
  misc_feature (318)..(318): n is a, c, g, or t
  misc_feature (384)..(384): n is a, c, g, or t
  misc_feature (544)..(544): n is a, c, g, or t
  misc_feature (553)..(553): n is a, c, g, or t
  misc_feature (592)..(592): n is a, c, g, or t
  misc_feature (661)..(661): n is a, c, g, or t
  misc_feature (664)..(664): n is a, c, g, or t
  misc_feature (670)..(670): n is a, c, g, or t
  misc_feature (685)..(685): n is a, c, g, or t
  misc_feature (704)..(704): n is a, c, g, or t
  misc_feature (715)..(715): n is a, c, g, or t
  misc_feature (728)..(728): n is a, c, g, or t
  misc_feature (739)..(739): n is a, c, g, or t
  misc_feature (760)..(761): n is a, c, g, or t
  misc_feature (772)..(772): n is a, c, g, or t
  misc_feature (777)..(777): n is a, c, g, or t
  misc_feature (779)..(779): n is a, c, g, or t
ctgacctgcgacagtgaatcgacaatgccgtcttctgtctcgtggagcatcctcctgctgacaggcctgtgctgcctgctgcctgtcttcctggctgatgatcctcatggagatgctgcccagcagacagatacatcctaccatgatcaggagcacccaaccttcatcaagatcacccccaacctggctgagttcgccttcagcctataccgccagctgtcacaccagtccatcagaaccaatatcttcttctccccagagagcatcgctacagactttgcaatgctctccctggggaccaacgcngnnantnacgangaaatcctggagggcctgaatttcaacctcacggagattccggaggctcagatccatgaaggcttncaggaactcctccgtaccctcaaccagccagacagacagctccagctgaccaccggcaatggcctgttcctcagcgagggcctgaagctagtggataagtctttggaggatgtgagttgtaccactcagaagccttcactgtcaacttcggggacaccgnagaggccangaaacagatcaacgattacgtggagaagggtactcaagnatgggttgcggatcaggtcaaggagcttgacagagacacagtttctgctctggtgaattacatcttctntanaggcanatgggagagaccctntgaagtcaatgacaccgangaagaggactnccacgtggaccangtgaccaccgngaaggtgcctatgatggcgtnnatgcatgtttnacatncnccactgtcagaagctgtgcagctgagtgctgctgatgtacctgcgcaatgcgactgtcatcgtattcctgcctgatgatgggatactacggcacctggtgtctgccagcttacatttacccagactgctcattactggaacctatgatctgggcgtcc

SEQ ID NO: 517488 - DNA, 215 bp, Homo sapiens
atgtcaccgagtcgaaacatgtttaaccggggagacaggttacacgcgtcgagaggagatcagatcgggaagtctttatgtccgtggggtcgtgtgactgtcaggcagaagctagtactgagtgacaggtgatagatccgagaataattgccatatgtgttaacatttttccattgctaaaccatccttagagaaaatcatatatggggtcacac

SEQ ID NO: 517489 - DNA, 208 bp, Homo sapiens
ttaaactctgtgagtagaacgcacacatcccacagcagtttctgagaaagattctgtcagtttttataggaaaatatttccttttctcttttggcctcaaagcgcttgaaatctccacttgcaaattccacaaaaagagactttcaaatctgctctgtctaaaggaaggttcaactctgtcagttgaatacacacaacacatagaaga

SEQ ID NO: 517490 - DNA, 2531 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517491 - DNA, 858 bp, Homo sapiens
cataagagcatcacgcctgtaatcgcagcaagtaggtaggccaagatggtggatcatccgtgacgtcagaaaattctagacctgactggtcgactcggtggtgaaaccgtctcatacataagaaatacagagaaaattgatctgtggctgtggtggctggcgacgctcggtgtgtatcgcgcagctcactcgggaggtctgatgcggaaacagagaaattcgctgtggaacctcggagtagtgcttggatggttgctgtgaagctgagatcgtgcaattgcactccagcctgggcaacaagagtgaaactccatctcaaacaaacaaacaaacaaaaagaatatatccatattagtaaaaactctttccccctttttactaacctactcccaaaacagggataacctaagctcaataaaataaaggagcctactatcagtgggtttacctcaaggggtttaatcattgtcctggtaaaaagctcttctgtgcttcccaaataagatctggctagatatacagattcagggccccattcaagagatggtatttcagtgggtctcaagtcaggttcctagaaatgactatttttaacacgtgtaccaggtgctgcttggttatggtagttatcacaggccatttctactctttacctgtcagtttaatttggtccaactctgagataggtttctaatagcatgtgtcgaaataaaagtatccagcctggtggattatcagttgaacaaaacacaaatgagcaccaataagttaagtgttcattaggtaatacgcagatgtccttggtcccagtgattcgtacaggagcatctgtctgggagggtacacttcaaaagaatg

SEQ ID NO: 517492 - DNA, 3141 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagccagggtgtcggcgccgagctgatggggctgcaggtggactactggacggcagcacagcctgcggacaggaagagggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517493 - DNA, 243 bp, Homo sapiens
cacgaggccagctctattcttggaataaaggcttctccggatcagtacatgcatgtcacattttcacacacacacacacatatgtgcatacacacacatgctcaatcagtgtgtgttggaatgacatacctgggctcaggggaagcacgggggcttatcatttgtggggtattcccataaggatggcagttaagacccagagcctcattaccactgccaatgtggatttagcaggggagggga

SEQ ID NO: 517494 - DNA, 311 bp, Homo sapiens
ccgcggcgggtggctgacgagacgacgcacatggccgcacgaaagacgagcgttctcccgacgcgaatctggaagtttcctgcccgcgtcgcgcaggcaggcgagccgcgcgtgcgcgatctcctcctggcgtgcagccgctactacaatcgactcgtggccatcgaggcggagcgggtcgcccagttcaacgagatccggcgccgccacgttcccgagctcgcggaagccgagtcgaggcgcgcggcgctgcaagcgcagatcgacgccgtgtaccgcaagatcaggcagcagcggcaagagcgcttctc

SEQ ID NO: 517495 - DNA, 797 bp, Homo sapiens
  misc_feature (2)..(2): n is a, c, g, or t
  misc_feature (5)..(5): n is a, c, g, or t
  misc_feature (8)..(8): n is a, c, g, or t
  misc_feature (12)..(12): n is a, c, g, or t
  misc_feature (22)..(23): n is a, c, g, or t
  misc_feature (31)..(31): n is a, c, g, or t
  misc_feature (42)..(42): n is a, c, g, or t
  misc_feature (47)..(48): n is a, c, g, or t
  misc_feature (51)..(51): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (65)..(65): n is a, c, g, or t
  misc_feature (67)..(68): n is a, c, g, or t
  misc_feature (80)..(80): n is a, c, g, or t
  misc_feature (82)..(82): n is a, c, g, or t
  misc_feature (85)..(85): n is a, c, g, or t
  misc_feature (95)..(95): n is a, c, g, or t
  misc_feature (98)..(98): n is a, c, g, or t
  misc_feature (103)..(103): n is a, c, g, or t
  misc_feature (112)..(112): n is a, c, g, or t
  misc_feature (115)..(116): n is a, c, g, or t
  misc_feature (123)..(123): n is a, c, g, or t
  misc_feature (148)..(148): n is a, c, g, or t
  misc_feature (164)..(165): n is a, c, g, or t
  misc_feature (177)..(177): n is a, c, g, or t
  misc_feature (189)..(191): n is a, c, g, or t
  misc_feature (195)..(195): n is a, c, g, or t
  misc_feature (208)..(208): n is a, c, g, or t
  misc_feature (210)..(210): n is a, c, g, or t
  misc_feature (213)..(213): n is a, c, g, or t
  misc_feature (216)..(216): n is a, c, g, or t
  misc_feature (220)..(220): n is a, c, g, or t
  misc_feature (222)..(222): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (278)..(278): n is a, c, g, or t
  misc_feature (281)..(281): n is a, c, g, or t
  misc_feature (289)..(289): n is a, c, g, or t
  misc_feature (292)..(295): n is a, c, g, or t
  misc_feature (304)..(312): n is a, c, g, or t
  misc_feature (314)..(314): n is a, c, g, or t
  misc_feature (317)..(317): n is a, c, g, or t
  misc_feature (326)..(326): n is a, c, g, or t
  misc_feature (331)..(332): n is a, c, g, or t
  misc_feature (334)..(335): n is a, c, g, or t
  misc_feature (339)..(339): n is a, c, g, or t
  misc_feature (341)..(342): n is a, c, g, or t
  misc_feature (347)..(347): n is a, c, g, or t
  misc_feature (353)..(353): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (386)..(387): n is a, c, g, or t
  misc_feature (393)..(394): n is a, c, g, or t
  misc_feature (406)..(406): n is a, c, g, or t
  misc_feature (417)..(417): n is a, c, g, or t
  misc_feature (435)..(435): n is a, c, g, or t
  misc_feature (452)..(453): n is a, c, g, or t
  misc_feature (466)..(467): n is a, c, g, or t
  misc_feature (478)..(479): n is a, c, g, or t
  misc_feature (482)..(482): n is a, c, g, or t
  misc_feature (490)..(490): n is a, c, g, or t
  misc_feature (498)..(498): n is a, c, g, or t
  misc_feature (513)..(513): n is a, c, g, or t
  misc_feature (518)..(518): n is a, c, g, or t
  misc_feature (556)..(556): n is a, c, g, or t
  misc_feature (560)..(560): n is a, c, g, or t
  misc_feature (564)..(564): n is a, c, g, or t
  misc_feature (590)..(590): n is a, c, g, or t
  misc_feature (615)..(615): n is a, c, g, or t
  misc_feature (623)..(623): n is a, c, g, or t
  misc_feature (646)..(646): n is a, c, g, or t
  misc_feature (698)..(698): n is a, c, g, or t
  misc_feature (731)..(731): n is a, c, g, or t
  misc_feature (736)..(736): n is a, c, g, or t
  misc_feature (773)..(773): n is a, c, g, or t
tnagnacncaangaattgcctnnatttcggnatgcccccccnttccnnccntcngnggncccgancnnccagtggaaagncnccnccattcgccnggngggcnagccccccnatnncgggganccgccgtcccccccgggtccccccntaacccccgccgaggnncctgggaagccnccgccgcccccnnncccnggcctgccccggntnccnggncccntntgtccccgtcgncagacncccnnccagccccccatggattcccaggccgccccaanganaccccccnccnnnnccccccccnnnnnnnnnanccnaagccgtcnccggnnanncaancnntcccnagggcncccgtgtcccncccngnccccccccgcggcccnncccccnntccccccccccnggcccccgcgngccggccggcccgagtcnccccggggcccatcccnnccccccccccccnncccgagccaannacnatgcatcngccgacgncagccgagggtggcngggcngaggacccaatattcatttcccaggctggtggagagtnagtnagtntggttccaaaactaaacaagggaggncagaggctctttccaaccttacctnatggcttntggccaaagcaaggaagtttcanggaaggtgttgggtggtgacggtgcaaaaaggaacttgaggaggagggaganaaagcagcccccctcgataaaggtgggggaganaaganatggggaaagccctgaattcctcaccgaaggccaatntcagaggggactggaggggttaca

SEQ ID NO: 517496 - DNA, 3210 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttaaaacacaaagagaaacagtcttaagtatgaatgtgctcacaacgtggaaactaacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcagatatttttaatgcttttcaatacatgttctaatgtagctgccaaaa

SEQ ID NO: 517497 - DNA, 140 bp, Homo sapiens
gcacgaggtgtgtgtttgtagtcctagcaacttgataggctgatgcaggatgattatttaagcctaggagttcaaggctgcagtaagctatgtttgcaccactgcactccagtctgggcagcagcaagaccctgtccctt

SEQ ID NO: 517498 - DNA, 3111 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggcgactcggacgacgcggccccctcgggctctggcacgctctcctccaccccgccgtccgcatctcctgcggccaaggaggcctcacccaccccgccctcctccccgtcggtgagcggaggcctgtcctcccccagccagggtgtcggcgccgagctgatggggctgcaggtggactactggacggcagcacagcctgcggacaggaagagggacgccgagaagaaggacctgcctgtcaccaaaaacacgctcaagtgcactttccggtccctccaggtcagcaggctgcccagcagcggcgaggctgcagccacgcccaccatgtccatgaccgtggtcaccaaggagaagaacaagaaggtgatgtttctgcccaagaaagcgaaggacaaggacgtggagtctaagagccagtgcattgagggcatcagccggctcatctgcactgccaggcagcagcagaacatgctgcgggtcctcatcgacggcgtggagtgcagcgacgtcaagttcttccagctggccgcgcagtggtcctcgcacgtgaagcacttccccatctgcatcttcggacactccaaggccaccttctagccccacccaccagggggcccacctcctgccccatgctgtgaggggcccagctgcatttctgttaacatttcagtttactacagagacagacgcttacgggggagctcctgccaggagccgaataactgctctgcttattaacccgaacgttcggcccggggctgggaagccagaaggacgatgctgagccatggatcgcggaaggcgtcctctggcctcaggagccacccagagcctcacaggctgagttcttgcctctgtgtcctgtccttcctggaagtcaggactctgcttcctcagggagcccggggaaggcggagctcagtggccacaggccgagggccatggggccgctcagtcccgttggggttgtcctgagttgagcctgggggggccgtcctgcccgcctaagagatgcccccagcaccgcacactcgtggttcccaataaactcctgcctgcggcggaggttttatagcagcaga

SEQ ID NO: 517499 - DNA, 172 bp, Homo sapiens
tttttggggggggggggggggggggccccccccccccccctttttgtaaaaccccgggggggggttttttttcccccttttttttttttaaaaagggcccccccccgggggaaaaggggaccctttttttttttgttttttttcccaaaagggggggttttttttgggggga

SEQ ID NO: 517500 - DNA, 2684 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcaggtaaccccgtcccaccctgaggccttgtgagtggcccgtgggtgggctgcaggagcacggtcattcgagtcctgcagaccagatcaacctttcagggcctgagagccgccacgtcccagtcttgctgtggtgcttctgtcctgcggggggttcatcctccaaggactgctgtcacaaagccccacatcaaggctggcaggggttgtcttccaaaaaccgaggagaatccgagaccctcccgtctctcacaggccactggggactcccaccctgcccacccccaggagctgcctggcctggccacatcctggtccggagggcctggtggcacccgggcagagcagcaggtgggctcagcctgccctgtgactcctccccaaaggcgactcggacgacgcggccccctcgggctctggcacgctctcctccaccccgccgtccgcatctcctgcggccaaggaggcctcacccaccccgccctcctccccgtcggtgagcggaggcctgtcctcccccaggtaaaggtgcctcacggctcagcacgtttcacttacccgccccaccacatgctgcctgattcagtcatcctcccctatgtcacatccacctcccagggcacctggcctgtcagccacgaaggcggaggggctctgc

SEQ ID NO: 517501 - DNA, 881 bp, Homo sapiens
  misc_feature (211)..(211): n is a, c, g, or t
tacatctgcacggccccctcagtgctgataagtctactcaatgggtcactcataatctattcatctgtatcttaatggcccaggcatctgctctggaaactattgagcttgctgtacttgaaggatggatgagtcagacacgattgagaactgacaaaggagcctgataaatacttgaccctcctgtgaccaacctgtggaattcagaaantttaaacaaaaaaaaaaaaaaaaaacacaccccttgggtaccatttcgtgtggattttcaaaaaccgtgttttagttttacttggtaccatttcttattggttaaaattcacctaaaattcttcagaacttttatagcaggactttggttgttccaggttaagggagagattggccaagccagggacaattggtctattagaaaacccgccctaagaagattcttgggtgttgggccactttagggtcatcgtggggcagaagtttagcattaatagtggtcctgaaacgtgttttatcaggtttagagcccatgtggagtctcctttccatgggtttccataaatattttaaccctattgttagcgaggtttggtcgttaaagtaaaggttacctcttgatgatttccataaataatctttctaacaattggtttgtcgaccattccttgctgatccagaaataatgctagggcatatgcttttcggcacattttgttttgtccgcagtatttgggaccttaacactgttctcaccagggacaatgacacagtgagggggggggggaaaaggcactacaccgggcatttgacacaccggtacaatccggtgtctaaaaccagcgccgaatgggtcccctaaatcacatatcccccgaacttccatcaag

SEQ ID NO: 517502 - DNA, 904 bp, Homo sapiens
agcggagtcctccggccgggcggtccggaacagtgcgacggcagactccggcccgctgagccacccgaggggtcccgtggcctccgcggacccggaatctgggccctcgcggacccgggccctcgtgcagacggccgccgagggctggcgcactacgaccacggagtgaatgtcaggcgcaggccatggcgtgggaggagacttagccgtcataccgggagaaggtggccaggagatgtgtcgggaccgtggtgacgagggtgaaggcagagacggaccgatcggcccacgggccaccggaacgcgtgcggaggtcagccccggcggagccattagcctgcacgggacaccctggagttcacgtgggagcccacggcatccatgcactgcacagacgtacccagcacatgagagctgttgggccatggccagtcatgctaggaacggcctccatgcgacgtggcctatgcccatgtccatcagaaggagtaccccgccgaacttcgtgagatggcatcgcccatcccaattccgcaggtctttacttccaggcaatgcgagaatcactggaattcttcccttcaatggtggcccacgggggtggatctagcctgaaatgattgtccgaggctgcgctgctcccgcgtgccgaaaggggcaagcattgacctcaattcaagcgagcctgctatcatcttcctgcagcgaccaccaagtgcgtgggcaccaggcttgcaaggcccgcggggcggggtggtcattacctggggtccgaaggaccgtccagaagacggcctgcaaagccacctgggatatgaccccacaggcggggcagaagtccttgctttgcagcagagcgtccaggagggtcaggcgcctggggccaaggctccgacgggaacgt

SEQ ID NO: 517503 - DNA, 275 bp, Homo sapiens
tggagaacaagtaatgaacaaatatgtatgatcacatctgttagagacagctaggcacaaacaatcttgcaggcacaatgacctcattccacacgtagcacccttcagcaggaccctatgaaactttcctccagcccttgcctctttgcaggttgccccttctctgctgagctgcccactgcaacatattttcacaatttctctaataaatctgcccttctttacctacaactatcttggtaaatggctttaccacctgcaaaactgaccctagg

SEQ ID NO: 517504 - DNA, 1581 bp, Homo sapiens
  misc_feature (429)..(429): n is a, c, g, or t
  misc_feature (1097)..(1097): n is a, c, g, or t
  misc_feature (1374)..(1374): n is a, c, g, or t
tgtgtgcggggttgtgttggttgggtgatgacggacgcgcggcaggcgggacgtcgttgctggtgttgtgtgtgtagtacgtatcgtcgttgtggttgtgagttagctctgtcgccgttggtggctccttcatttgtgattcgctgcgctgctgctgttcgtcggtgggtgcgccgctcgtggggtggcctccatagcgggtggggtcttgctgctgtgggtgcctgtgggcgggcccactgttgttgtgtgccccgccgggtgttagttgtgtgggcccctcgttatttggccccccgatgtgttctccaggcctcccgggcgccagagagggagttgcttcgtcggtgagtttcttcctggccgccctcctggtgctgtggttgatttagcgtgggggggggtgtgcccgggggtccgcacggtgcncgcctgggcctgcgccgctcctccgtgggtttgcgcgttgtattatggcgcttggtcgatgggaaaccgtggtggtgtcgccggcaccgttggtgcccggcgtcgcgcccccagaccggggggaatactcttctgcgcccccagtgttggtgtggctctggctgggggggaagaaagtcgtgggttttcggcggtatttggtgtcttggggggtttattgttggccaccttggttgcggcggtgttttgcacctgggggccggagcctttttgtgtggttgcgaacaaagcccgggcccccaggtgttttgccggccccacgcacgtggtggagaccgcccctgggagatgggaggggccactatttgtcggagggggccttgcattaacgtggggccacgccccctgtgaggagaattgtggcgcaacgggggcgtcccccagcccactgtcctgggacgccggagtctctctcggggcatatatgggggataaggcctgacgccaccccctggcgttgggttcacccctggcggtggtggtgtcaccccgcgggctctctgacgggcagtcgccctggtgcagccacgctggatggcctatcgaggcccacgagttcccgcgggccacttgaggagcctgtttcccaccgcgaaggtttgggcccnccaagaatgtctcccggtgttgccgcgctggggcccactaaagtgccctggaggcccacgcgtctccgcgagcgaggacctcgtgaagaattgtgtggcctctctcggagttcgaaagtttgtcaccacttgggctcgttacaccacgtgggcgcacggaggttgttgggctctcttgcttctcccttctcgaagggcgaggttgtccacgggctcgctaacccccttggaatgggcacactcttgtgccaaaggcctgcacgccccttggcgcatnccacaggaagcttctcaagccacccgtcaccccactgaactcgctgagttcttcctaagaagtatcctgctgggtttctcacagttccacgttcccactcctttgagttgatcactctccctgacagtccccctgtatcgactttgtcacccaatgctgtcttctctttcccccatccacgaaataataatccctcgagtttaccca

SEQ ID NO: 517505 - DNA, 504 bp, Homo sapiens
  misc_feature (455)..(455): n is a, c, g, or t
  misc_feature (482)..(482): n is a, c, g, or t
agatgcggaggagggtgacgcactagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtgggagctcatgaaggacttcagcatttggggtccttttgggcaacatccccaacatcgtgggcagagtttgacttggagacaacattcctaaggattttagttgaggatcaaggggtancccagacccttccaaattcctgtctgntggcaggatgatggatgtctgt

SEQ ID NO: 517506 - DNA, 419 bp, Homo sapiens
  misc_feature (12)..(12): n is a, c, g, or t
ggtgctaacagntcgtgacagaagacagacattaaacattgcacatgaaggccaggaattggtggtgcacacctagtaatcccagcactttggaaggctgagactccagtgaattgcttgacgccaggagttcgagaccagcctggacaacatagtgagatctcatctcaaacaaacatgcacaaacacacgtgaacataaaacaatacttcaataagagcaacgacagtgtgctatgagcttgaccagctggaggctcggcacgtgatatttagccatgatctcaagactaaattgagacttagcagacgaagggagattccggacctagggggaaagagtacctttgcagaggagacaaatacttaataacagccaagactatacgtacttctcaggaaacactgataccgcaaagg

SEQ ID NO: 517507 - DNA, 199 bp, Homo sapiens
  misc_feature (110)..(110): n is a, c, g, or t
tcgcgctcggtgatgtttcatgagtatcagtcaggtcccggccagccacggatccatactgcaggatggcttgggggagggcttacccctcgtacataggcacagtgtgntgtgaccccgtcaccggcagtccatcacagtatgccagtaggtacggtcgaaaggcgtacagggtatagcacaggccctggcagtagca

SEQ ID NO: 517508 - DNA, 316 bp, Homo sapiens
agtcccaagaattctgaatgtttcataggtagcaatgataactggtgagaatttagaggtgctattgataagtaagcaccaaaaccaccagtattacacagttaaaagcttcactattttgagtcacttaaattagacttcagaatgtgttgtaaaattatcttcaacagcaggtttgtgcttttcaggtgacatcagcaatggcaaaattagtcgccttcgtcgagagtgcccttctgatgaatgtggtgctggggtgatttatggccagtcactttgacagcacattattgtggcaactgttgtctgacttcac

SEQ ID NO: 517509 - DNA, 112 bp, Homo sapiens
aacaagaggttatttgggtgatccagtgcatggctgagtctttgtgatttaagtattttcaatttttttagtggaccatctagtattccttttctgccttgttagtctggcc

SEQ ID NO: 517510 - DNA, 984 bp, Homo sapiens
  misc_feature (981)..(981): n is a, c, g, or t
taccgcgagacggtcagtgaagagtcgaacgtgctctgccttctccaaggtcccccaatcaaagcacaatcggctgtacatgaaggcgcggcccttccccgacggccatggccgaggacgtcgataaaggcgaggtgtccgccccgtcaggagctcaagcgagcgggcgcgctactggccgagaagtacgaggtgggacgtggctgaggcccgcgagatctggtgcttgggcccgacggctccggccccaacatcctcaccgacatcaccaagggtgtgcagtaactcaatccgcagatcaaggacagtgtggtggccggcttccagtgggcccaccaaggagggcgcactgtgttgaggatgaagcatgcgtgggtgtgcgctttgacgtccacgaagtcagcctgtacgccgaggccatccaccggtgaggggcagatcatcccccttggcccttgtgctgcctctactccagtgtgctgaccgaccagccacgcctcatggacgcccatttaccttgtggacgatcgggtgtccagagcatggtggtctgggtggtactttaacgggggttcgaagcaggaaggcgggggcctgtgttcgagggactcccgggtggccggcaccgcaagtgtggtcaaagcctttctgccgtcgagtgtgcttggtataccgtgacctgaggtccaacaccggcggcctgcgtcccccatgtgtgtttgcctctgcagttctggcggacccttcgaaaagtaggcggtcctgcagtggtgggtggcccgtaggcggtctcaaaatggctccctgccttgggactcctcggcaagggggggcctctgaagccgcgcccgggttccgcccactctcgtttagagctgggagcagagcccaagttggcgtgtccacagtggccctttacacgcgacactagagcggggggcgccagtacatattgcctttgtgtctgtcttgcttccaggnggg

SEQ ID NO: 517511 - DNA, 978 bp, Homo sapiens
ataccaacatgtgctgtgatgactgccgtgtgcaagctgtatgtggtggccctgtgatggccctggttgccctgggatgtgggaacctgtggatggcttccgcggagtgtttctggcagtgtgcattctggggcctggggccgaggccagcggagctcgccggagtgcaaggccgaggataagtgagtggattgccctgtcaccacagttggtgcctgcttggtcaaggacatgaagatcaagtccctggatggagatctatctcttctccctgcccattcaaggaatcagagatcatttgatttcttcctggtgggcctctctcaaggatgagggtcgaagattatgccagtgcagaagcagaccctgtgccggccagccgcaccaggttccaaggcatatgtagctatcgggggactacaagtgtgccacgtcgggtctgggtgtcaaggtgctccagtggaggtggccaccgccatacctgtgtgggccattcatcctgtgccaaggctctccatcgtcccctgtgctgcagaaggcttacttgggtgtgaccaatgatcgggaatggcccagatgtggtcaccctttgcaaggttgacatggcctgctcggggtcgtgttgctggtaacgcctcatcgcttgcgacccagggggcacttggcatcgtcatccggcaacctgttgccttaaagaagcttgattcaatgatgggctgggaatcgattgactgctacacctcaaggcccggggctgcaactgaccaaccctttgtggtctaaactgtcggccacacaggggcgaaccattggggattgcccgggtatggctagaggagtcatacgacggattacggcttaagcacccgtgaagcctcatgggcagcggttgaaccttgataatgtcagcgcagggtttaccccgaagtacagggaagtatgcagtgtgacaccacaccattcggtgtgcaggaacgt

SEQ ID NO: 517512 - DNA, 1006 bp, Homo sapiens
gctcatgcttctctccgggtctcccgcgtccagggtccagccccaccggccggtcccgcacggctcgggtagccatggaggacgcagcggcgctggagctttcgtcggacgaggcggggaggtgaggaggttatgaggagtcccgcgcagaggtatcaagcgcagggcctgggcgcgtggacgattcaagaaggccttctccagggagaagatggagaagaccaaggtgcgtacccgcgagaacctggagaagacgcgcctcaagaccaagggaaaacctggagaagacgcggacacccctggagaaggcgcatgaacaagctgggcacgcgcgtggtgcccgccgagcggcgcgagaaactgaacgacgtcgcgggacaaccgttgcgcaaaatccttcaggcccgacacgttgttgtacgcgcgctccaagaccgcggtctacaaggtgccaccttcaaccttcacggtcaagaagatccgcgagggccaggtggaatgtggctcaggccaccgagatggtgcacggtgggcgccgaagacgtagaggggcggccgcggaacctgcgggagggccggtgacctgggcgggggggaacaacccgaggtgccacgcctgctggggatacccgaggattcggcacgcgtgtggtggaacatgagcgacagcgcctgacgcgcccagttgcaccctacccgatttcttgggtcttcggactccctcgtttcgattctttttggctcgacctgatggacgttctctaacttggaaaccctgcccccttccaacttctggagtccatccagttagaggtgtacgcccgttggtctgcccccgttagacaccctgtgcagcgccgtgagtggtgcatgtccccggctgtgcaactgttcacggatgcgtgcccgtgcctgggtgttctatttccccacgtgtcccgtcttctcggtcgtacgccagtctggcgcctccagtgtgccacaggggctgtgtgttgttttgtgt

SEQ ID NO: 517513 - DNA, 872 bp, Homo sapiens
  misc_feature (154)..(154): n is a, c, g, or t
  misc_feature (429)..(429): n is a, c, g, or t
  misc_feature (840)..(840): n is a, c, g, or t
  misc_feature (867)..(867): n is a, c, g, or t
cagaccagcctggccaacatggcgaaatcctatctctactaaaaacactaaaaaagagccgggcgtggtgacgggcacctgtaattccagctacttgggaggctgaggcaggagaattgcatgggcctgggaggtggaggttgcagtgagccgngatcgcaccactgcactccagcgtgcatgacgagagcgagactaccacctagaaaaaaacaagatgtgttttggacttttccggtgatacgttcaaaaaattattggcagggtgcggtggctcacgcctgtcaccccagcactattgggaggccaagtagggaggattgcgttgaggcccggagttctagaccagcgctaggcaacatagagagaccccgtttctacaaaaaattaaaaaaagattcaggccgggcactgtggttcatgcctgtnatcccagcattttgggaggctgagagcaggcagcatcaccagaggtcaggagtttgagaccagccatggccaacatggtgaaacctcatctctactaaaaaaaaatatttcataaattagccaagcgacgctggtgcatgtcgtggaatactcaactgacttggggggaccaaagcaggaagattgcctgagcccgggaggttgaggctgcagtgagtggagatggcgccactgcactccagcctgagtgacagagtgagaccctgtctctaaaaaaaaagtaaaataatttttttttgagacggggtttctcttgttgcccaggctggagtgcaatggcgcgatctcagctcactgcaacctccgcctccagcgttcaagcgattctcctgcctcagcctccacagtagntgggattacaggccccaccaccgcgcntggct

SEQ ID NO: 517514 - DNA, 441 bp, Homo sapiens
  misc_feature (173)..(173): n is a, c, g, or t
  misc_feature (262)..(262): n is a, c, g, or t
  misc_feature (313)..(313): n is a, c, g, or t
  misc_feature (364)..(365): n is a, c, g, or t
  misc_feature (378)..(378): n is a, c, g, or t
tatgaatcccccggcttctcaaaatgtagggattatatgcgtgagccactgtgctggcatgacttgtattttaaaaagcaaaagtgttttgcgtgtgtgtgtgtgagtttaagatggagagatgttctggagagacgtgtcagtctcgtgctctgctcttagcaatgcaggtncagtgagttcaggaattaagagactctgggtgactcgcatgcccatcccacaggagactgacgtcaatttactcatttacaatgaaagnataataccccgtcagctgagcacacatccttcctgctggaagtcgcggccnaggctgaatgtgcagggcaccagtcattgggaaggctcagtctgaagggtnnactcaagcctgtngggccccacagtaagtccttcctaatgcctggaataacacacaatccccagagcagcatctcc

SEQ ID NO: 517515 - DNA, 301 bp, Homo sapiens
acccactactggctctgtcaagtgtctatggccaatcaattgtccttctaatcactggaggggcagactctgtcagacagcaccaagtcactggcatcccaaacttttcaatgataccaggcctttaacaactcccctccacctccaaaccctctctcaccagattgtgtaatttctttgtttactgctggcttcatcatgcacttttccttcatagcctattttaagaagttgatttgctgaactgctttttagccaagctatttgtaaatcaagctacacaaagtatgtggccagtagt

SEQ ID NO: 517516 - DNA, 922 bp, Homo sapiens
  misc_feature (44)..(44): n is a, c, g, or t
ggactctctgatgatttcgccctccgccgttgatgagtgttttncgagccggttgtgtcttcccgctcattggtggcttcgtcgttctgtatccatccggagtttggtcgattgtgtgtgctcgtagcggttggtttgcttatcaccgtttccctgtgggtgcaccagtgtgctcgtttcgtagacaccgggtcgtttgtttcgttcggtcacccccccaatagtgggtcatcttgttgcttttggagtgtgcactctttgtcgccgtggatcgtggtgccacactttgtgttggaacaagggtcgggttcctcttgttccaccacaaaagtgtggagaccgccaccatgccgtcgcgactcttgatgttgtgggagaaaagttctctgtcccggcgagagtagtcggttcaccaccaacgagggtggtgttgttgcacaaaggtggttgcttcggcctagctgtgtggaatgatattccttgcttttttttagaacaaataatgattgtgtgtaaacacccaattctggtgtgtcatcaagttctcgtcccggtccgctgtgttagttaactcactgccgtctcaccacacggtgagagatcttgcgggccggctcccgtctctttttgtatcgctcagagtgtggataccttggctcgcgaccaccaggtggtggagaaaatatgtgccgcgagagttcttgtgtgcccagaaatattgttgtggctccctgaatgcacgggtgtgtttttgaagaagtgagttaccaccacgtgtgttggtgtgttgaatatcattagcggaagactgttttatcgagacatatattaggtgcccgcgtccaataaaccggaattgtgggggaacccaaaaataaaacggggtataaccccctttttttttaaacccactaatatatat

SEQ ID NO: 517517 - DNA, 228 bp, Homo sapiens
tcagctcggaccatcccaacacagatatatgccaggagtgggattgctaggtacttcatgtatagttttctgaggaatctccatactgttttccatagtggttgtaccaatttacattcctaccaacagtgtaggaggggtcccttttctccacaccctctccagtatttgctatttgtagacttattaatgatggtcattctgactggtgtgaggtagtaactaatt

SEQ ID NO: 517518 - DNA, 112 bp, Homo sapiens
acaagagtgcctcgtcggaagtcgccccagctgcaggagagcaggagccagggctgactggggccctggagagctggaccgagcccacgagcacgagggacaccaggaccat

SEQ ID NO: 517519 - DNA, 911 bp, Homo sapiens
  misc_feature (618)..(618): n is a, c, g, or t
  misc_feature (730)..(730): n is a, c, g, or t
accacagcctaattattagcatcatccctctactattgtttagaccaaatcaacaacaagctatttagctgttccccaaccttttccgtccgaccccctaaggaagcccccctcctaatactagctacctgactcctacccctcgacaatcagtggcaagccgaatcgccacttgatccagtgaaggactatcacgaaaaaaaactctgacctctctatactaatctcgcctacaaaagtctccttaatgataatcatgtcagcagccacggaagctaatgcatattttatatcttcttcgaaacgcacacgttatcgcccaccttggctatcatgcacccgatgaggcagaccagcgcaggaacgcgctgaacgcaggcgacgatacttcctattctagcaccctagtaggcctcgccttcccctactgcatcgcactaatttacagtcacgacaccctaggcgtcactaaacattctactactcattctcactgcccaagaactatcaaagtcctgagccagcaattaatatgactagcttacacaatagcttttatagtaaagatacctcgttagggactccagtgattgactccctaaagcccatgtgcgaagnccccatcgctgggtcaatagtacttggcggagtactcttaaaactaggcgggtatggtattagtacgctgggatcattttcaaaccgtgaaagaaataggctacccgttctngtttatctatgagtcatttacagtcctttgtgagaaaaggctaatggcatgtattcttagaagccatagctcgggtaaaggattcataaccgagtcgggggattcataccgggacgcaaaatggtggaaaaaagggacgggatttcccggaaccacatgggcgacggccccaatagggggc

SEQ ID NO: 517520 - DNA, 687 bp, Homo sapiens
  misc_feature (488)..(488): n is a, c, g, or t
acatattaaatttatgaaaattataaaatacaacacttacaaggatatagtggagaagtatacagtgacagtgtaaattagtacatttgctggaacattgtctgataatctgtaataataaacataaaatcgtcatattcttttatctaaaaattccaattctgacagtttcttaaaaacaaaacaaaacagaggcaggagaattgcctgaggccaggagtttgagaccagcctgggcaacatagcaagacctgtactctacaaaaaattttataattagctgggcatagtggcacacacctgtagtcctagcttacttaagcagctgaggcaggtcacttgagcccagagttcaaggttacagtgagctatgatcaggccactgcactccagcatgggtgagagagcgagaccctgtctctgaaacaaacaaatctatttttaagccaaaacagtacaggttgtttgaagtgtttgtagagcaatgntacaaaggggttaaaagaatataccccaaacaagcaaggctaatggccacagtttatcaattttcatgcatattatagaggtatttaaatgattaatcttggaaaagccgacataaaaactggtgtgctaacaatttacaggcgtattaaatatatttccacttaatgttgtgcggataagctggaatgaatttttaat

SEQ ID NO: 517521 - DNA, 914 bp, Homo sapiens
  misc_feature (450)..(450): n is a, c, g, or t
  misc_feature (636)..(636): n is a, c, g, or t
gtgggaaatgggttatacgtacagcttaatcttgcttggtttatctgtgacaagtggttctcttcctctggtcccttctgggggactctgtttccccatttacttgctgctgttgtcctcgtcaccatgttccttgcaggattccttcgtgttctagatgccgcttgtaatcataatcatattgtcgctttgtgaaggacctcaccagtgtggctgctagctcctggccggttctctctttgccctgccaaggccgtgagactcaagtgattgtcatctccgaagctcgctctgccatgttttgtggcctcacttcgagtagcttggttggcgtcaagactagttagctctgggcagagccaggggtgatgggagaaggctctgtggagcacagcgtcgggatggcgcgcaccgtgtggctgtcaggctgggctactgtacggcgccggntcgtaccctgtagggaacccaattggggccctcggtgctggcctgctaccaggtagttgtactgtttcaagtcgcttggttaccttgtgttgccttagttgctgattgctgctgttgtaattgcgtccttgtagaactacgacgtttcggcgaggcgaaaagcaggatagaactctagtaattcangtttggcccggcacttggtacggatagggttcgcctgggaccctcccgctggttgttccccagtctttgtgactcgggagcgtcttctgcaagtccgttggttcttgtgggtaacccgctagggattgcgcctttgtgatccgtactgagggggctggcccggagtcgctgcatggtttgcccctggtggatggtttcctgacatgccccaggggctggggccttgctggggtcgcaatttggccccattcgcgggtctttgaggttccttcccttcg

SEQ ID NO: 517522 - DNA, 197 bp, Homo sapiens
gcgaggttaatgcggggagacgaagtggaggaagaagcgaatgcgcagcgtgaagcgcaaaagaagaaagatgaggcagaggtccaatgtaaaccgctagcttgtttgcaccgtggagtgccgcatggagcatgaaaacatgtgaatggccatgacgctggtgagatgctgtgtacaaggttgtgtggacttgcatt

SEQ ID NO: 517523 - DNA, 151 bp, Homo sapiens
gggtagaaaggcaagatgaagtcgacttatcaaaggggtacacggaatttccaggcatcagttcaaggggaggcctcccttcttcaggggacataagggtagccagttggccttctatcatctctccatcaatcccggaagggagcccaaa

SEQ ID NO: 517524 - DNA, 452 bp, Homo sapiens
ggctcgaccgcccacagcgcgctgccgtccttgcgcaggtaacgtttttcaaaagtgacgcttgaacactggccctggatcagcctgggtatttcgtcccggccagcctgaaggtcgtccgggtgggtcagttgctggaacgaggtaccgcgcactctgtcttcggtgtagccgagcatccggcagagcatcgggttcgcggcaatccattcgccgctcaggtatgcaacggccaggccgttgccgctggaatcgaaggcgaggcgatagtcttgctcggcggggcccagcggtaatccttcggttttgtcagggccttgcgtgggagcgagctctgcagtaacggctgagtccattcgcctttctcccggttattttgcctggagcatagcgcaacgcccagcgctatgcacacctgttcggtctggggcgtgaggtcgttgatccgtatc

SEQ ID NO: 517525 - DNA, 252 bp, Homo sapiens
catcataaatcctctctcaggacttcaaactctactcccagtaagtagcttgttgatgacttgcatagcaagcctcgcgtaacctcgccttaccccccactattaaactacggggagaactctctgtgctagtaaccacgttctcctgatcaaagtatcactctcctacttacaggactcaacatactagtcatagctgtatcctgcctctacatatttaccacaacacaatggggctcactcacccaccct

SEQ ID NO: 517526 - DNA, 191 bp, Homo sapiens
cgcagttgcaatagaattgcgtcatcatatttgtaacagcaacacaaccgcttcacgctctggcaacactttactgggtttgggcgttggtaaggtctcagtcaaacccgtcacgccaggctacacaacctgtcttgcaatgggcatgattaaaccatgctgtgcctgcaaccgtggtgcatacgctgtag

SEQ ID NO: 517527 - DNA, 119 bp, Homo sapiens
cgttatctctcacgggcagttttgtgatgttttgtctttttccaggtcttcattatgatactgtaattccagcattttgggaggacaagacaggagtttgagaccaacctgggcaacat

SEQ ID NO: 517528 - DNA, 1300 bp, Homo sapiens
tggggctagaggttggggcttaattggcagcgggggttaaaaggaaacaaaacacagtaattctgaagaagccacagggcaccaggcagccgaggcaccagccgtggcccatctccaggccagcagtgcacctgaacatgctgattctgtccaagggaggcgtgcgtgctagtggtgctacacacggggaggcaagctcttggggcgcacgtggaggccctcttggcgacacaacagagggcaaacacgtgctcaggcctcagaaagctccaagggaaccgtggtggggccaaggttagatccctgtgcagaaccccgcaagtgtgaaaggcgagaaacacgtggacatagcgacacgggccctttcagaccgtccgaagaaattgggggtgcacagatcaaaggtgaacatccagaagtgaaaccacgaggaaccccgcgacgaacaagggacaacaagacacgcagacacacgtcacatcacacatgtggcgccccacgaccaggtggagacacctcaaatcacccgcagaaaaccgagacgaagaacacaccgttggaaaaacacgcgggcgaccggagaaaccccatatacgtggacatggtggcacataaacaaagaaccacaaacaaacgcgccaccacgaaagcagtacccaatcaaggcaagactgaacactccaattcaacacaacggccctatgaggcagagacacgcacagagcaacggtgacgaacgaaaacgccaccgagggagagctcaccccggaaagaacccacccacgagaagtcccggagcccaaaaaccccagagggagcatcaaccatagggatctccacaaacaaaacacccactcagtgagcaaactgctaccacaaacctgacgaagtagaacacccagaccggaaattggcacacgtggcacacgctccaacgagcacccatttggagaaaagcgcacaaaaaacacggtggcacaccaccccaggaaccaaacccactgcatatgccccacccccacagagaaaagtgcacccacaaaacggagcaccaaacaggcccccgaccaccgacaacagtggccctaagtagcccccacagtgcgcaagtgaaacatagggcccacaaaacaccccccgatatgaaaccacgccacagacaacacgcgatggagacgtgcgaccaaccaaacagtatactacaaaccatatcactaagacaaaaaaaacatataaacaaccaagcaacggaaagagataacacaaacaaaacaagacaaactcaaaacaaacgatcacc

SEQ ID NO: 517529 - DNA, 180 bp, Homo sapiens
cgtggaaccatacagaagtaactttcgagctatacagaagtggtgactactgaagaaaatattcctgacgtggtcccgggctgtcatcttactccattagagagagagagttcttcacctattaagtagttaaccagctctgaacctggacagcatcgcttattcactcgttatcaactc

SEQ ID NO: 517530 - DNA, 1241 bp, Homo sapiens
agcgggcgcgcgccccgcgcctccagcccagcgctcggagccgctttcgctgccactgtctgctcccccgggccgcagcggcggactcctggactgacttgcgggcgcttcctccaatgctcttcccatggcacctgcggcgcgaggcgtcggtgagctaggcgagggactatcttgatccgcgatccggtaacagtttcgagcgcatacttacaaggctgctgctgactcctggtcacggctacaacaggatcatcactcacgaaggaattaccaagcgacgcagagaatacccggcgccacaacaccggccgcccagaccccacacaacaacgaacgagcgtaagagaccacagcggagcaccacgacctctgcgcaaccccacagtcatctccagccgggcgtacacactgacccataacaccgtagcgacgcagaacaaaacacggaccccaaaatcacccctctgcttttatgtacgcggttggaatgactaactccttggggcttctttctctggcacctactccaatcgctccctcgacatcgcacgactttctgccagcccacactcggtccccttcctcacggtaacacgatctacgatctggctaccacattcgttccagctctcatactctcgtaaacccctcttctaataactctcaagaacttttcgctgctaccacctctagcgtagcgacggactcacccgcattattttcctcgcttcattccctcctgtgacactatcttcgtcctcactctcctctgaatgcaccaacagcacaacatggcgcacttgttctcagaggctcttccgtatccttcgttactctagcgcactacaccccgattaattatcaccatctcccgatcaccgccagtgtttggctgtgtggtcccatgtggcagccagccctcttccttctcgctcggcatgctgaacgctaggcccttccgccgcgcacgtgcctgcgctggtgtcgcgcgagccatcagtccccaggccgcaccgccaccccgacgccatctggcgcgcgcgccagcgcggcagcagcccaaccagcgcaggccacagaagagcgaccgagcctagctgcgacgaagcgacggacagcgaaaccaacccgccacacgaggagcccaccaaagcgacagcacacagaagaagcgacgacacgacagcacgcaaacccagagagcgaccagaggaaaacacacagagcaaccagccgac

SEQ ID NO: 517531 - DNA, 453 bp, Homo sapiens
attcgcggccgcgtcgacttttttttgagatggagtctccctctgtcacccaggctggagtgcagtggcacgatataggctcactgcaagctccgcctcccggattcctgccattcccctgcctcagcctcccgagtagctgggactacaggcgcccgccaccacacctggctaagttttttttttttttttttttttgaatttttagcagagacggggtttcactgtgtgttagccaggatggtctcgatctcctgacctcgtgatcaacccgcctcagcctcccaaagtgctgggattacaggcgtgagctaccgcgcccggcctttcttttttttgaaaagactattcttttcccattgaattaccttggcacctttgttgaaaatcagttaccacataaataatacctaaccaagtttatttgtcgacgcggccgtgaatttagtagta

SEQ ID NO: 517532 - DNA, 703 bp, Homo sapiens
agcgggcgcgcgccccgcgcctccagcccagcgctcggagccgctttcgctgccactgtctgctcccccgggccgtccgccgcctccccccgcaggcccggggctctgtccgtctgggcccgttgctgctcgccccgggccaggagaacgagctcgaggaggatgcctgggacccggtgcaaggttccccctctctcccgcagctgtggagaggacggaagcggaactagagatgcccatctggagtgagtgcaggaccaggtcccgcgcggacccgggtgaggcacgacccgcgcgcccgaccggcgccatgggaaggagcgggcgccgttgcttgaccccggcggtgcgcgcacgacttgagacctgccacgggcagtgcccgtgccgcgggtcccgagtgacgctggtggcacctgaggagatgtggcgcgggtcctcggggaccacgctgccggagcccagtgtccagtgcaagcgtcttgagtgaccctgacgcccgtgccgtcgccatggtgatgtcccagggcaccttacacgtttcctcacgtgctacgccggctgctggctcatctggggtctcatcgtcctgctctgctgccttctgcagacttcctgagccgaccgcactcaaacgcgccaggaggagcgacttgcgcgagcaggaacctgagcgccctagagctggagccctcggaactcg

SEQ ID NO: 517533 - DNA, 276 bp, Homo sapiens
gcagtaccgcacttaggtgcttctacgctcttcctgctggaggaggcggtggtggtgtacttagatgtgtggaactgccgactccaacagagctagaggccaaccccaatggctctgccaatgatggaactgaagccaactccaacgccaagaacactgccataggagtagctgcttcctccacccaggcctaagccacagacgacaccactggaaccgccatagccactggagacggaggactgaaccaaagagatgtagcctttcggagaagat

SEQ ID NO: 517534 - DNA, 329 bp, Homo sapiens
gatagaatcacatggagcacagtggtactaacacaaggctaactgtctacatctgtcacatactgcaagggtctacaatataagctaacctcaacagtacagtggactcacagactatgcaagttaccggctaatgcgcaaattcgacagcaaaataaagttaagtaacgtactacaaacatatacccacgagatattcttggggggaacaaagcaaacaaacaaagtcgtgcagaagtcacagctatgcatgcatatgtgtagtcagataacattcacacacagccaatcctgcaacagggaggtccatatatatcgtcacataaaca

SEQ ID NO: 517535 - DNA, 304 bp, Homo sapiens
gattttttgaaaaataacttttttttaaccgcaaaaatgggttttcccttcatttttcagtaaaaacaacttatttggaaatcagggtttcatcccttgataaaaccagtggaggatttggatagtaaccaactggttttgaattgcttgaaaagaatcttgtaaatttgtagtccaaagggaattttgcgattgcttcaaaacttggaattgcaaaagtgctgtaaggactgattttcttacaagaccatggataaaccaaggagttttttggattttccagtccccaaactggatccatgga

SEQ ID NO: 517536 - DNA, 139 bp, Homo sapiens
gagtgagaccctgttcccccccctctctcccccaaaaaaaagataaagaaaaaagaaggaagaggaaaggatgaaggtgaaccggaggaaaaggaagggtttaaagccaaagatgatggccatgacaggggagttgggt

SEQ ID NO: 517537 - DNA, 183 bp, Homo sapiens
ttgctgcagtttgaacgtgggaccctcagttcccagaccacggattgcacctcggctgcagatggtgagggtgccgagccctaaccactagaccaccaaggaactccctctgaatgtccttttgacttttggttttcccatatgaacaaaggaagggtgcttagagactaatactcttgcatc

SEQ ID NO: 517538 - DNA, 851 bp, Homo sapiens
  misc_feature (204)..(204): n is a, c, g, or t
  misc_feature (210)..(210): n is a, c, g, or t
  misc_feature (229)..(229): n is a, c, g, or t
  misc_feature (240)..(245): n is a, c, g, or t
  misc_feature (247)..(247): n is a, c, g, or t
  misc_feature (250)..(251): n is a, c, g, or t
gtccatatgtgactagacgaaaacagcttgaagaccgaatcgcctccagaggattatagactatcttatttctgtgttgggggaggcatgtccagtgcggatgggggtgactgaatcagttgaatgacttatggaacacagatctggcaggctcacttggagtgacgcacttttgaagaactcaagaaacatgaagattctgcnattccncggaggctagagtgtctanaagaagacttnnnnnncnacnngaaagagaaaaggaacttcaacatagatatgctgatttgctgctggagaaagagactttaaagtcaaaattctgaagtacagtttatattctgtcacaggattaattaattgccggttttcatactctagaaggctgaaactgatgttatcttcattgacaaatttacccaccatctgtggtttttcagttgtttattttaaatgatatcgatcttacacattctgagtataaagaccttaactccaccaggacggacattttagagggtaaattctcaaggctatcattcttttagaaatgtcatatttgcaaacttttctacctttggcctttcaatcaaaatgcctaaattcaaagtgccgcctgtgagtaaccttctgactcaatcaaatttacaaaaaaaaaaaatatggcctggttgatctcattggggggagcttatgcggccctttacttttaccaggggataacacatgatcctggattaatcgcctcgatgcgctctgagattccgtatgctgataacggtataatcatactctcaggcggatatcccgttctccccagaatcaggagaacacagggaacgacctctgaa

SEQ ID NO: 517539 - DNA, 1566 bp, Homo sapiens
tccaaatggagtctcactctgtcatactcagggctgggatgtggcaggggcgtgtggatttgggtgtttattggcgaacctctggtcttcctgggtgttcaaggcgagattcctcctggcctcaagcctcccagatgtacgccggggtattacagggctctgtggccaccaaggcccaggctaatttttgtgtattttttaaggataagaagacgggggttttcaccatatattgggccagggcttgggctcttcaaactctcctgtgacctgtgtggttgactcacacccacctctcagcactgtggagagggccagagggccgggcaagatcactctgagagggtacagagatattccgggagaaccacatctctgtggcccaacctattgtgtgtgagaaatctcccatctcttctaatcttaaaatataaccaaaatatgtggcggccggggctatgagatggcgcaggtggcgcctgtgtaatatcccccaaaaaaaaaaacacaacaacacaaaacactctccgagaggggggtatctctctatgtggcgcgggggggcgcggagagacaacagagcaggtgtatatggagacaaagtgggggcccatatgtggggcacacaaaaccgcgtggtgtccctcgtgagagcccacaggttttttctcctgtgcgtccaccccaaccggggggcgcagagaaacctctcgcgcgcgagaggctacctccccccaaataatataagagaggggaggcgcgcgaggaaaataataaaatctcttcgcgagaaaataaaccgcccgaggcgtgtttaaccgcaccgggcgcactttaatgactgccgcttggtgtccgtacgcgacgaagacaacacgacgccaactaacgagcacgaataacagcacaaaagcagccacaggctacaacaagcaacgaccacaacgacacaacacacaacacgaacaaaacgaacaggagggacacaacaaacacaaacacacacaaccgtagactcacaccaaaaccaaacaacaaacgaagcatagacaaacaacgacagaaaaagacaaacgacaacagcacaacacacgctacagaaacctgaatataactactcacacacaacacacaccaccacaacacaccagaagcaacacaacaaccacgaatacagcaaccagacatacaacagcccaatctaaacaaccaagaagcaaaagcagaaaaagaggagaacgagcgaggcagatgcataccagaggcagagagtaacaataaaggacgcgctagacaacgaagaacaacgatcgtgaggcagcggcgggagcgagcggaaccgtgtccaggcaagataccagtacacgtggaagtagcgacgcgagcagcagagcggagaggagaggagagacaaagcggagaaaccggagctagaagacgcaggaggaggtagatgaagacggagcgggcggcgagagcgacaggaagcagcacgacggcagtatatggatgagaagagaacacacagataaggacggaagagagcagggcgtgaagaagggatca

SEQ ID NO: 517540 - DNA, 357 bp, Homo sapiens
gacaaaagatacatatacgaatcgagtctcggtacctggttacgggagtggcgggatctcggctccactgcaacctccgtcacctggtctcacgtgattctcctgccttagcctcccaagtagctgggactacaggcatgtgccactacgtgtggctattttttttttttttttttttttttgggatttttattaaaaatgggtgtccaccattgttgggccaggtttgtctcaaactcttgacctcggtgtctctgtccacctctgcctcccaaatgtgtggggataacagggctgtgacccaccgtgcctgggcccatttcttttttttccttttctttctcttctcctcttttt

SEQ ID NO: 517541 - DNA, 259 bp, Homo sapiens
cgaatcatggtggctagcatcaaactactatctaatcatttactgtcattaccagtatgcactcacaggagaaaacgccatcattatcactatactgaatgtcctcgttgaagcagatagaactattaactgtattagatcttgattgtgaagtacacatctttgtagtactctataggatgaaatggaaagtgcataaaaagcactcatactgcataccaaagtacaatggttgttttgaggggaaaagaccctgtgt

SEQ ID NO: 517542 - DNA, 1174 bp, Homo sapiens
ggggaggcccgggtgtcccggtgcgaacagaggctgcgggtgggagccttcgcgggcgctgcagagcgggcctggtggtgagtgccgggatggagcccctgcggagtggacttgacgcctgcagggtgctgagctagaccggctcctgcagccatctccagcgggatccatgacgacctcctggtggactgctgtgcggacgggtcttgtatgtgctggctgctggcacatggcatcaccatcctggggatttgcgcacaccacgcacatctacgacgtggaccccatgacggacgctcttacaaccaacgacgtcgaacctgcgatatgtgccaatggtgctacgattttggcgagagtgtactaccaacggtgcattcgagtagaccacgacaacagtgacggctggtggccagtcaacgactcagtcgaccctgcgcggactgtgccgaaggactgacgatcgagtgaccatacacagacatgtgcgcatcacctggtccttcagttcacgtgccgacccagccccctagcatacacgcacgactacatttggcactcactaccgtaacagatgcaccaacgctcatggactcgatccatggcagtacgctggcgcggcgcgctcacgcacgtggaccttcgcttaacatcaggatcccttggcagcgagaccatactatgccacggatcctgcagaggaccattctgcacgggcctaggattatactgactccgaaacgcccgatccaccgagacatcgacgctgccaacgtggctcactcctcgggacccagggcgacgatgacgcttcggggcacatacgggcgacaccacggcacggtcacacacacgcagaatacccaggaaaccatacgagggcacccgcatccgggcatagcccctgaggacaccaacgcactcggcccacgcactcacggcgctaccctcgagaccctgcgggcacccaggggcacagacgtgtgcacagggggacgccgcccgagccctgacgcgcaccacaaggagggtacgggacgcggagtcgcaggagcagcccgcaacaagtgggacaggcaagaaggcgatacagagaccaggagaccgcgacaaaacccgccacggccgagcaaagcagcataagacgacacagcggggacaaccacccacgaag

SEQ ID NO: 517543 - DNA, 636 bp, Homo sapiens
agcggattggcggcgagacctccgagtcgtccgtgcggcttgctgtcgcccgttgctagacagccggggccttcgtgagaccggtgcaggccatggggtagtctcctgtctggacagagaagagatcaatgccggacactggctcagtagatgcctttgcaatgagtacaggctttaggcatacgcagtcactggttgcttctggtgggatctttggctatgtgaaacgccggcagtgttgccgtccctgggctgcagggctgctcttgtggacagtctagccggcctgggtgcttaccatgcgtgtctcatggatccaaggaacgttcgggttttcctaggctacatctggtaccttggctggccttctgggaatgaggttctaccactctggacagttcatgcctgcaggtttacttgcagggtgccatgctactgctcgatggtctgccaaagtccggagctaagtatgttcaacagaacccgatcaggagaagtcacggttccagcttagactgatgacacgacatttggatatctgccatctgccagcttattttcaatagtattcagagagactacagtgcagcagttttggcagtctgagcattttacctaataaacatgatgacacga

SEQ ID NO: 517544 - DNA, 234 bp, Homo sapiens
gacgtgtaacccactacacccagctgcttttttattttttaagaggtggtggtcctgggagtcttgccatgttgtccaggctggtctcaaactcttgtcctcctgtctcagcctcccaaagtgctgggtttaacaggtgtgagccactgcgccctgcctgggttcatattttttaagcaacagtcatgaatgttaagtctcctggcctacttgagttacatatgaagctattga

SEQ ID NO: 517545 - DNA, 407 bp, Homo sapiens
  misc_feature (130)..(130): n is a, c, g, or t
atctcgccgacgacgaaccctgccaccagaaccggctcgtcgcatggggctgtgcgatgctcggcgcgcagttgccgccgttgcaaacgttggacgaggccgggctgtccccggctgcacgcgcattatngcgccgaaaaccgccgcgtcgcgaacggccgggcgaaacgattactggactggacgccgcgctatccgagttttcgcgagggtctggccgcctgccgttagagcagcacgtcgaccgtgtagatcagcacgccaaccagcccgccaaccaacgttccgttgatgcggatatattgcaggtcgtcgccgaccgcattttccagccggtcggtgatcgtcttggcatcccagctgcggatcgtgtccgacaccagtttgagtgcagtctcgccatggct

SEQ ID NO: 517546 - DNA, 417 bp, Homo sapiens
ttctttttttttgagacggagtcttgctctgtcccccaggctggagtgcagtggcgcagtttccgctcactgcaagctccgcctcctgggttcactccattctcctgcttcggcctcccaagtggctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttgttttttgagatggagtttcgctcttgttgcccaggctggagtgcaacggtgccattttggcccactg

SEQ ID NO: 517547 - DNA, 879 bp, Homo sapiens
  misc_feature (305)..(305): n is a, c, g, or t
tgggctctaaagggggtaaagggggtgctatagggtaaataggggccctatttcaaaaattttaagggaaattaattctaggacgatgggcttgaaactgtggttggcccccacagatttcagaagcattgcaccgtagttatcacccccggttcgtgtagcggttgaaaggtggtttgggttatagacgtctccgggaaattgtgctatctgtttttataacccctaagtgtggggcacagcctcagtgagtgcaagaacgttctgggtgatgtatttattatacaaagtggggggctttcaangctcgggggagtatacataacctcgaatgtgtggtcaacgcgtctcaagggagtctcgcaggtctcgcccgtggatctcatagggaacatataatggtggggggcaagtatattgttagtgagtttgacaaattatagtctccgccgcgatagactcgggtgtatacctcgatagggtttccaagatcaccatgtgtggggtggcccaattgtgattggagtggttaaggggagggactcggtgtgaccctcgttcgtggttattgttaaaggattgcgttagggatatggggagggcaaatgaagacacataggagtgaatgtgggggggacaggtatagttcacaagaaagggggttcataaatatcccctgaagacgtttttaaaaatttgttaggaatattagataaacaattagggtggagaaagttgttttgggaaaacagggccacccacggggacattaggaaagcccgatttatggggaaaagactattaaggaggggggatcacaatgaaaggggtgtaaacccttttataaagagaggagaaaactgtgtgttacaccctgag

SEQ ID NO: 517548 - DNA, 410 bp, Homo sapiens
  misc_feature (59)..(59): n is a, c, g, or t
gaggcggagtattgctctgtcgcccagactggagtgcagtggcacgattcttggctgantgcaacctccacctcctgggttcatacaacttcttattttaaacgcaaaaaaacaaaaataataatactgatataattatcagatgccaaagtgatctatcatatacttgttagtatcttcaagaaagccgaattacaaagaataaaaccatagttcgtgtatatttctactggaaacgaagatagtgaaactttatttgctttttaaaaaattcctctgtgtataaaacagcaggtggtgatatttttcaggatggccaccagactggcaagacagaggaaaatgtaagtaaaccgtaagaatcagattatcaaaaaagtctggcaaaacaaaaaaaaagttggcggccg

SEQ ID NO: 517549 - DNA, 415 bp, Homo sapiens
ccggatatgggctgtgctcccattctggtattctcgggctgcggagatttgaattctccctgagatggagtgccccgggggaggggtgggctgccatatttgatgttttggcgacttagccattcgaacctttgggctttgaggagtcccagctgacttagggtggatatagcccaccagcacagcacggctgctgtacaaaagcatagccagactgcttctttgggcaggtcccggattcatgcctcctcactgtttgggacttcccaactggggcctccagccacccccactggtgttctcctgctgacagtgatttcagttttttcttgactggagctccctgatggaggggcaggccatcctgtttgctgtttttgcaacttaaccacttcagccttcagtctttggagtg

SEQ ID NO: 517550 - DNA, 1230 bp, Homo sapiens
  misc_feature (918)..(918): n is a, c, g, or t
tctcttgaccaaaaaaagattggttatacctaccatttcatgggtagtttggcccagggtgaccattttttgtggtgtgtgtgtacaggcggtcttatagggctttggcctttaaaggatctctatacgggtaaagaaaacacaattaaaaacaaactggtccgggctacgggacatgtgtggtacttttaccaagatcatcactagccagaagtgttcagttgtgccacattggagttcctttagtgaaatctcataaataagagaaatgtgtccttcctttgggggatttatacactaagagtttcaagaaatgtgtccaaagttcctgtgtaaagtgtttcatcttaaatatcaagccccctttataaaattcttaaatcgtgttgggcgtgataacaccctctttggacaatctagtgaatttaatttttaaacagtgggcgataaactccccgaacttcaatttccaggggaaaaagtggccaaagaaagggttatttctccctttgtgaggcgaggaaaaactgtgggggtggcccttctatataacgagggtggataaaaatttatttgactccacattccctattatatcacccttttgtggcataaaataactcatagtggggaccagaaaaactttgatcacacaatttaattcccccttgtggtgacagaagcggcacaatatttgttagagacaaagagggaagatattgaacacaactcccgatataaacagaacagccagggggtcccccccaggaggggatacatctcaagaacaacataaaaacaacacaagacaactcagaacaacagacggcgggtgacacacaccagagaaactagcccgagtgaggcacccgcggaaagtaaaacagaacaagaagacgaagaagaactacaaacaanagagggggcgggcggacgcaccgcggcactaccaaaagatagaagaaagataccatcccgccaccgatagcaggaggtggggcggcccacccacagagcgctatgaagaagcgagggatatccacaccagaaggaatttatcactgatggacataacaacaataggggggtgggccccaccgaaaaaagaaaggataacgaccgcaggagtaaaaacaaagaaaaacacatacacaggacataccgtgtggcccgcagcaagggagataaaaacacaaaaggaggtgcagacgcaaacggggagaacaataa

SEQ ID NO: 517551 - DNA, 381 bp, Homo sapiens
caggaaagagatgtcactatgatgtctacttcactcgggagacataagatataatcaggacacgttattcacgtccgcttcattcttattgagaagatacgtggttcacaaggtcaacataaggctcacagcgagtacatgctgtcactgctccaatgattttttgggttatcaaaagcctatgctctagcatatcactcaggaaggactcacaggaataggatttcatatggttatcatagtgtatatcatgtcagttaggctcactgcactgcattgtctgctggtgtatataattgctatcaaaaagaatgactccattctgatatggtttcacagcttggatttattcatttgaaagtggggactaaataccctggg

SEQ ID NO: 517552 - DNA, 1394 bp, Homo sapiens
  misc_feature (155)..(155): n is a, c, g, or t
  misc_feature (279)..(279): n is a, c, g, or t
cttcttccccgttctgttggcacccctggtatcggctcttttcgcctgttggtcgccctcttttggcgggagggaacatcctttcttctgtctgtattttgtctcctcgcatcagcgatggagttggtttttgccgcccaccccacgtcttggtnggggtgtgggctcgtctcttccggtcagacaacacagtgtctctccgctagtaagctcggcttgcgtcgcttcaagcatgctcatcttgttggtgtgttgctacatacccccctcttcggtcgngggggcggcctctgtgtttgctgacgaaacgacgacccctccctctcgggttgatgagacctctccttgttgtttctgcttgctcgtcgacaatatgtttttcgtgtgctcctctccgtggtccgtttttttgtgctacgaggaaacgcatcgtcgttggttcgcaactcttatggccctctcgttcttgttgcaagagctcgtctcttcgtcctccgcttggtacatctgttgcgggcgcgcatctttttttgccgtctcccgcgcccggcggtgtgtgcgtgaggttggtctttttgggttggttgttttccacacgcgtcctccgtcgttgttgttgcgtgaacacccctcctgttgtgttgcagcaccctcttcgcgcgtggtgatatcttctccaacgcaggcctcttttgttgtggcatccgagtggcgcctcgtatcgttgttggtctctatactttgtggagacccacgctctcttctctccgcgccgcgttgttgtgtgagttcgggaggacatctgcgtgggttcccgcaccttctgttttgtgtcggttattctctcttctttctctctgtgattgccctcgctggagggggggtaccccacccctcctttttatactccccgacgcgctgtcgctctgtgggggtctttggcaccagccatagacacactctgttttgtggcgccctatggtgcacacacccgctgtctcgccgagtggccctcgctccctccctccctgtgattttttgtgcgccgcccgtgtgggtccaccacaatttgtgtgttctcttggcgcttcgtggggtgtatactgctgagggcgccactattatagggtgattagggacttgtcacgggtaggggggccaaacacaactcttctccttgtgccgccctttattccctggtgtgtccggttcccactcctctgggagcgggacttcacattgtgcgggtgggggcacactagtgtgcccccctggggcccccccacataccccgggggtttcgccccccgtgttttcaattttggggcctaaaattgtggtgaaaagggtggtatgttattaaaaaataaagggaaaatttttttcaacccaca

SEQ ID NO: 517553 - DNA, 1493 bp, Homo sapiens
ttttaatttattatttttatttttgggttgagcacagggtacttatattggatggaacatgacaaggtgcggttccctaggcccctaccctctcttcaagggtgtactacataggcaatctgtgtagagtgacggggaaatatcagtggtagcgggggagaactagagtagtaggacaggaatctaccccagcaagtagaggtgtctactctactatcctactatgtgcttcttagcgggggcatgggtggcgtccaagagggctcttatacctcctttgagaaggccaatgtggggccacttgaaggtccacacacccttgattacgcttgtaagcacaaattctctgttggtctataccagggaaatgtgacgcttggacacaaggtggggcacagtatggacgcgcgcaaatcgcccagcccaccaaggggtcaccacagggttgcgacggatgttgggcggagtaccgctggtgaagacagctcaagaagcaaccaccacacccttggagggccaaccaagaggtcaaggcccccacgggaatgccccttatggagaggggggcccccccagcaggacaggcccgtgacttgtgacctacacacatttacatgagaaagtgcttcactcaaatattttttgagccacagggatatattcctatacaaacacgtgaccatgggacacaagggttccccactcaagagggacaccaaggagtatgcagcaagtttgggagagaacacaagcgagaaaagggcaacaatgcccaagatggaccgctatctcccccggtagacaaaacctcgacggggtgatgtgaaccctctgtgccccaagcatggctccatgggtggcaagcgcccacgagatagcaaaaaggcagcaggtgccatatgactagcgaacctggcacaagaaaccccccgtgcggggtccactcatgcccgcagaaggatatcccacggaaaaagggcaacaatacacaacaagacccctacaaggagtagagagactaagcatcggcatacggcactcggagtgtcaactaagaaatacccatattcacgaagaaatacgccaaacaaatgagaaacgtaggcaactagacacctagcgactaacacaggagaagtggcaaaataaaagtaaggcgatacataccaaaaaagtgacaatgtccataatcaacaaacttagcaaggggtgctagaagaacacataaagaagggaccaacaaccaccatgtacataaccagtggtgtgcaaacaaacacagcgaggtgagacaatagcagagaaccacccttatagatgcccccggacagaagagatcgcacgacaccatcaaagaagagataagcaaactaggacggcaccctgacaatatcagtgacagatcagcacccgcaccagaatcagatgtggacgcagacgatacagcaaaatatctgaaaaataacttcataatacctgacactgaactacac

SEQ ID NO: 517554 - DNA, 104 bp, Homo sapiens
taggtggtccaactttgtgaacgtcctaaaaaccctgggaccagtgtcccctttgggtgaattatatggtctgtgaatatcccaataaaactgtttaaaaagta

SEQ ID NO: 517555 - DNA, 487 bp, Homo sapiens
atcactgtagctcagtgaggcaggtgcctcttctaccacgagtcccaggtaccctctgcccgagctgtgacagctcacttgggcctggacatccatcctgctgtagcatcctggtcatcttgtagctcctcctcctcgggtgaacctgggaccagcagggtgctccaagctgtccatgtactgtgcagtatggggactacccagtgtgctatggacaggctatggtccttgcttgtcgcatgaggcttgctccacgtccacgcaggtccatggttgctgaagggacggcaggcgcatacatgaagaaggggtgcaccccccaacctgtggggtgctaagggtcgcggtgcgggggatccgaggccccaaagcttgtcctgttcaccaacccgaccacgaaaagcccacctcgtggggccgagtcctgcttgcctatacatagcgagcgggcatcgggagataaaccccctggtggcagaaactccca

SEQ ID NO: 517556 - DNA, 919 bp, Homo sapiens
  misc_feature (772)..(772): n is a, c, g, or t
gttgagaccaatgtttcctccccccggtaatatatgttttagtgcatttttcaccaggcagaatcttgagaaactttaaaggtggggaccacctctacccccggtctgagagcccaagccgggtccccgagaacacccaccgtggcgcccgagggcaatgtccctttgacccgcgtgcccacattttattatgaaccttctttccagtgaggttatcttaaacccttgccaacagcaccgcgactttgcggcaactttgacccagcgttccacaaggagggtccggacccgcacgcccaacgaccctcttggggcaccccaaacggcggtggaccccccccccccactcttttaacaaaaacaagccctttttattaccgtccccatagaacagggctgagaacccttctaatacatggctcccaggcgtgacttcccttaattatgcccgacacaaagcgagctaaccaaggtcacttccttaaatggcgccccccctccctttcctagtctttgagaacaagttccccatctttctttacgattaaccatagcttcttccctatgttaggaccaattaatataagaccggcccgccccccccttcccaacgctgttatattccacctgcgcgtctgtcgacaacgtttcttaaacaagactctcctaatataaaagccaccacttctttcgacgcccccttttggtgacacactcacagacagcatttcttcccccctagtatccttgtcccaagtaagcaaccaccagngggtcctcatctcaaaaaacactgtgaaccaaacactctcacttcttctccagactccgcatccaatagacgtcacacaatacaccccccgggtagaactaaagaatctcctgtgcaatccctgtaaaaacgtcccttgcagctaca

SEQ ID NO: 517557 - DNA, 1498 bp, Homo sapiens
atggtttgcatgcctgtgatgcctgcccatgcatcacctgagatgcctagttcctgtgccatgtggtctgcccctgtgcaaaccactgatgcccatgccaactcatgctgcccctgtgaccttgcaccatgatgccactgtgctctgtgccagaacgatgcacattgatctgtacttgtgctcaccctcactgatgatgtgactgatccatatcaaaactaacttgccactgcaactggacgtgccttgcattgcatgccgtgctgcttcttttgcaacacgcacactcgacacctgggacttgtggagactgtgttgtgcttgtgatgctctgtgactctcctaattgccccatgacacctttccaaattcaccaaattcactttatcccatgaaacactcacacaattcagccatggtggctacacacctctgacatggtgaccccattgcctgaaaccctttatcaatgctaagtcccttgacccctgaggttctttggtatctttggtgctttacctcaatacttgaaatgttcccacttcattggaactgtcctcaatgaactaactcatggttggtgcactttggaactcgacacataacgaacatcgcctatgagcacacagcgcccctgcgccaaaggaaccccctttttggtttggtaacttcattctcgccaaatagcatatcacccgcacacctttggcacagcattgggggtatcacttgtggagatagtacaccgcattgggcccccaatttctccctcggacaacatgtagtggctattggagatatttgtgaatagcctggactcggttgggtcacaaataactcgtggcctgcaccagatctttggcgctataaccacacactctaatccatgccgtttgccacaaccttggataattgtcgaacccacaaatggagtgtagcacccggttatccctggggaaacgctaacccgacactggtgccagagttagccatatgcaccccaaactacgaacccgacccttgcagctgggcgcacacagtgagagctatccgcgattgaggttgccgtacattccgattggcacaacgctggtcagccttcaccaagcgcgggtggggaacccacttgacatagatttggatcacacttccaccattagggaccaaaagttctcacggaatcgtttgcgcactcttcttttggcacttctaaccctggttgagcggacttcatcccacatcggttcttacgaaggaaaagcccgtccagtatcttgggatcacctaaactaagcgccacgtcttgtggcgaacacagccgtctccatgctaagagaaccggcgcccggtaactctccagaactttacctttggcaaatgagcagcttggagataagcaaaatcctgcagcccgctcggacctaacaaccaaatcgagcaggcagcacttagatcatctccccgccgcgcacatcactattagctcaccaatagcgag

SEQ ID NO: 517558 - DNA, 1284 bp, Homo sapiens
ctgtcgcttacagcttaggagattctcaacttagacttgagcgctctgagctaaatctagccccaaacccacgtccaccgttactaccagacgaaccattagcgcaatagccgattgtacccaaagtaagagtataggcgatagaacattggaaagctggtcgcaatagatatagtaccgcaagtggctaggatgtaaaaagttcatagcctaagcgataatatagcaaggcactaactcgccatatacctttctgcataatgaattaactagaaataactttgcaatggagagccgaagagcttaggacccctcgaaaccgagtacgtaagcatacgctaagaagcagtctcaaatagcagctagcagacctgtctcactgtagcgagacatagtgcggaagatcgataggtcgaaggcgacaaatctaccgagcctggtgatacgctggtcgtccagagagtagaatcttcagtgcagatctttagagatttgcccagcagaaccctctgaaatccccttgtaaaatgtgaactgtatagtgccaaagaggagacaggtcttgggagcacttaggaaataagcctaggtagcagacgagtagcaacatttaacaccggatagttaaggcctttaaaagcaggcacgcagtatcagaaacgcgtgcaagctcaatgagccacatactctaatcaagatcccgagagatttaattgaacttcctcagacccaacttgggaagcaactctaattcaaccttagtagaaagaaactaaatgtccagcattaggttaccattgcagagcatttgtccctctgcataaagcctggggtcgaattaaaacacattgatcctgcatgtaaaagacccatatattttccagcgaaccacacaggtcataatagccctcacggtgatcccaacgaagagggaggccacatagggcacagggatactgacagtaacacgacaccggggcacccttactccccggctgttgtaccaagaaggcaacacctctgccatcacccgattaaaggaccgacgcccatggacaaggtttaggcgcggccccctccggcgagcggcaaaacagtgtgctataaggcacgtatatgcacgcggcagagcaattataaacacgctgcaaggcaacaatagcaacacctatttatcagaccccgaacatacttgtgcagcacaaacatactacacttcagttgtccctacgagcttctacccagcgctaaacgacagagcgccggcacggagacacgcataca

SEQ ID NO: 517559 - DNA, 343 bp, Homo sapiens
cgaatctagaggatacccgtatactaggctcccatttgaaaccacttttccccagccgtgtgctctgcagctgttctattactcagatctttagtgcctctagaggatgtcttgcctatcttacttgagggggcccctaggggtccccaaatcagttgaccgtgtgctccctggccgctgggcctgcaacactctgcccagctcctcttgctcgctgtagttcttctcagacctcctcgtgcaggtggacaaagctccttctaccatgcatgtaaacagcactcactgcgacaatgaggcaactttgctgactccttgcttgacgcattccttggaaggtcac

SEQ ID NO: 517560 - DNA, 266 bp, Homo sapiens
ccgatctgatgtgcctggacctgttctgtcaggacaaggacacactcagcatacactagctcatgctgcccgtgttcgagaaagaatcgattgacaagaaaacagagagtgcagctatctcagatacagtctgtgatcgaacttggaagagtgatcagagaccgaaaaactattcccagcaagtatcctttgaaagaaattgtggtcatccatcaagatccataagctcttaaagatatcaagtactttgcgaggaagtatagtca

SEQ ID NO: 517561 - DNA, 331 bp, Homo sapiens
  misc_feature (159)..(159): n is a, c, g, or t
ccatctagcgtgatcccacatccaaccccgatctccatcttcgtccctactcctggaaacctggcccactgaatgaccctcggtgtgctgccaccatgctctcaggggcccagttgacagtgtccaattctcagccgggcgcagtggcacacgcctgtnatcccaacactttggcaggtcgagacgggtggatcacaaggccaagagatcgagaccatcctggccaacatggtgaaacccgcgtcttcactaaaaatacaaaaattagctgggcgtgaagatgggcacctgtagtcccagctactagggaagctgaggcaggagaatcgct

SEQ ID NO: 517562 - DNA, 237 bp, Homo sapiens
gtacggcactagtgcccgctcattgatgacactagccttcaccctgctcatcgagagacactggctccatactctgctctttgacagacactggcccccaccctgctcattgacagaacctggtccctgctcccctcactgacagacactggccccgcctctgttcattgacacagtcccagacatctgaacgtagacagacacataaaccctgcctctgcacattgacagacactg

SEQ ID NO: 517563 - DNA, 214 bp, Homo sapiens
  misc_feature (72)..(72): n is a, c, g, or t
tttgacatgagtgagcagttgaacagttagcattgatctaaagcaccatgaagaatttcctggctgaatagntatggaaaatgatggaaccaggagtcaaaaatgagccgaggttgcaggtttgaagactgaggaagggcacaaaggagaaagccctctccacctctagctcctcatttataatgcgagaggccgggcatggtgtctcatgtca

SEQ ID NO: 517564 - DNA, 392 bp, Homo sapiens
tggggcagtaggggaaattccccccaattttgttatgagcctaaaccctctttaaaaacggtcagttaactaaaaaataaaaatcagtttttagggagagtagaacccccctttacctaaaaagcagggacatttgaaagagacgtattaagttaacatttttaaaaatccaaatgaaagtaaatggaataaatgtatcaggtaaaggacgagttgtaagcttggatttttaggtctagcaaaaccctgtttacaagagcatcccctaaaatgtgccaaaagatgttgaaaggatgaaaaaaaggtatagtagcacatcccctacccaaaaatgtagctctttgaatctcagaaaaaagtagattttaataaagtgtgaaagttgtccatca

SEQ ID NO: 517565 - DNA, 157 bp, Homo sapiens
gcttcaggtaggcatggacaaggtcgagacattcctgcgcatggtgcagagccgctctgtggagggcagcatgtggcttcataagtgcccgagtagcatcctgtgacccctccccagatgcctctccatggaccctgaacggtgccacatccagatg

SEQ ID NO: 517566 - DNA, 390 bp, Homo sapiens
gttatgatcatgggccctaaagtcagagcgcctgggattaagttgtcacaggcactatggcccctgcgaggtgctttttcaaacttccttcagtttccccatctgtcagttaaggcgggattacctgcttcataggggtatgggaagaattaaacaatatgtgtaaagcccttactagccccctgcctaacccaataagttagaaatataatttgtgtagaactctggccacatacatttaaacagatgttagtaattttgggataaggtttgtcataacccaatggaaaagtaggaaacatttataacgtttttaaaaaatagaaaattccccccccttttttttggacttgaagatggcccccctggaataaaaacttaagaccctga

SEQ ID NO: 517567 - DNA, 529 bp, Homo sapiens
ttattagaaaaaaataagcaacaaaaaaaaaaaaaaaaagagccaagcctacttttggcccagttaagaattaagggagtgtgtcccagaatttggcataacagccactgtggttttatttttggaaacagaataaaagaatgaaagtattggaagaaaacagaaaaaaacactctccgaaatgcaagaaaaaattggtttaagtcttttttactccaaaaccggttcttctcttacctctccaccacatctcgggtgtgagcgctacacatctcactgtagtttagattataacattacgatgtgtaatttcgtgtcccctttctcctgtgtttcattcagcctcattattgggttctaatgtgaatgtgcgtgagatattcgtggactcaactttactatttatgcccccattcatacttttgggtggagatgcccagttgggtttttttaccagttaattagccatttaagattcacggttggctccatttcattttcaaagccgccccaactttttcccacccct

SEQ ID NO: 517568 - DNA, 664 bp, Homo sapiens
cgacagccagacggttttcttttgcgtcgccagccgagccacatcagctcagacaccatggggaaggtgaaggtcggagtcaacgagatttggtcgtattagggcgcctggtcaccagggcatgcttttaacatctggtaaagtggatattgtatgccatcaatgaccccattcattgacctcaacatacatggattatacatgattccaatatgattccacaccatggacaaattcacatggcaccagtacaaggctgagaacgaggaagcttgatcatcaaatggaaatccacatcaccagtcatatccaggagcagagactcccatccaaaaatcaagatgggagcagaatgcatggacgactgacgatacgatcgatgagaagatccaacatggacgtcattcaacacaccaaatgagagaacggcatggagagacatcaatattgacacagaggagaggcagaccaaaaaaaagagcattcaaatcgaatcatacatgacacacaccatacaatgacatgaattgacccaccacaaatgaatatcagaaacaaatgagagataggtagaccaaccaagtgaaagcacagatactagcacaaaacaagacacatcacaaagacatccacatcacgaccaaaaagacaacattccaatgac

SEQ ID NO: 517569 - DNA, 751 bp, Homo sapiens
ccaaatatcgtgtgtgatgcaagggggccgaaaattggtctatactggtgaagagacccggtgagggaattcgggtgtttgacagacaagagggattgtaagagcaccagggatctctggattatattgggcctcctttgttagcgagacgaggcccctggctgtctttccgttgtcgctacgtggccgtgggaatgaggtgtttgctcctctgaggaatagtaatctcccgtctaaatccttactcttgggtggcttctgtggcgcgtgtctcccgagagtcgtctttggtcaatatgtctggaataatgagcgagaggttcaggaatgaacggtcagtcagatcaggcgacgcccatggcggcttgggttggagaaagggaaccctaccgtatttatgccccccggttctcgtgcacgacgccgtggagcatctaggccacacacatctgcgatctctgacacccccaccccctctttgtgtacagtcacgtcttggaatcttggcacatctaccctggtaggaaagcaccgcagcatgtggggagagcaaaacgtcctggaatgaagcatgtaactctatggggggaggggggagggcctgcctggaaaccatccatctgtggaaatgacaccggggaaggtttttatgtgcccttttgtttttgtaaaaaagggacacccggtaagactggaagaatacattttatattctggatttttaccaataaagatggctattattatggga

SEQ ID NO: 517570 - DNA, 269 bp, Homo sapiens
  misc_feature (6)..(6): n is a, c, g, or t
  misc_feature (37)..(37): n is a, c, g, or t
  misc_feature (46)..(46): n is a, c, g, or t
  misc_feature (63)..(63): n is a, c, g, or t
  misc_feature (68)..(68): n is a, c, g, or t
  misc_feature (92)..(92): n is a, c, g, or t
  misc_feature (99)..(99): n is a, c, g, or t
  misc_feature (104)..(104): n is a, c, g, or t
  misc_feature (111)..(111): n is a, c, g, or t
  misc_feature (122)..(122): n is a, c, g, or t
  misc_feature (127)..(127): n is a, c, g, or t
  misc_feature (136)..(136): n is a, c, g, or t
  misc_feature (141)..(141): n is a, c, g, or t
  misc_feature (157)..(157): n is a, c, g, or t
  misc_feature (165)..(165): n is a, c, g, or t
  misc_feature (178)..(179): n is a, c, g, or t
  misc_feature (203)..(203): n is a, c, g, or t
  misc_feature (206)..(206): n is a, c, g, or t
  misc_feature (214)..(216): n is a, c, g, or t
  misc_feature (251)..(251): n is a, c, g, or t
  misc_feature (262)..(262): n is a, c, g, or t
gtgggntgtgagtgtacaagcagtgtgtgtccagagngggtgtggnttcatgtccgaatggtntttcnatgtggaaattgataggccagtgnctctggnccccnaatcggngttgtgactangcatntagaaaagntaacntggcttctcatagtanctgagaanggaggtgtccccnncgtgggctcactaatggggctgtncanggtgggcnnnccccattgcttggtgccacttgcacccgacatgcntaaagaatacnagggggc

SEQ ID NO: 517571 - DNA, 219 bp, Homo sapiens
aggaggaggaggaggaggaagtcaaggaggggcagttgcaacccccggagtttcaagccacagaggccagactcgacccgcaggtctcagaactctgggggctctgactcagacaagatccttccagatcgccaaaggaccagaaatcaagtcagctcagctcagagccagagagatggaattttaaacttaataaagatcaggctcttaaaacctaaa

SEQ ID NO: 517572 - DNA, 407 bp, Homo sapiens
ccaccatactatagatcattcacaaaataagtttaccagtttcagaaccactttcttttaatacttaccaagataaaattatgggcattgttaaagtaatattacacaaatttatactatgcatccttactctaccaattagagctactgtgtcctctttgaagaatcagaaaccctaaaaaaacacacattatcatagcagaagataacattgtaacacagtccaaaacaagctgtgatggtgttggtgttcaaaagagctttgaggactgagatgagcaatccactgtaattttatactggtcaagctgatgttcgctttttcaattcatcccttgcatgtgtggcagaagaaagagcagaagataaaatcacttccacctggaccactgcttatctttatctgt

SEQ ID NO: 517573 - DNA, 1214 bp, Homo sapiens
gtgtactgcgagaattactatcatcatcacaatatgactgtctgttatgatatcccaatagagtatctctgacgccgttgcgagacagtatcaccgacaatgtggtgcgtacgattccaaatagattttcatcccataatcagtcagatgactggagtgatcctacaatgcgcactcacgatgtattgtcatcattgtgattcatgatgttgccaactcagtgttcggctaacctaggtgtgcagaacagtaaacagaaaaaatgatagtgaactacgaaacgtgtactgttgcgtatgctgcttgccataactatacaaaaataatgcgtgtggatatatagataggggtgtgcatgaataaatagtcgtatgaaaagtgatgttcttggctacaaccccatgaattttacgttctgcaagtttatagtatgtgatgaacgtaaatcatgatttacttcatagttatagagatgtgttttgcctggaataagcatgatgagtgtgcactgcagcgaatttgtggccttaattctttcattgggaggaatatatagactaggcaaaagttaagtgcgctgcttcttgcgagattttaataggtctacatgaggcactgtgtgtgcacaggtaaccattgactgatattgacgatgacttttttatcatagagatcgattttcttggcggatggtaaaattggttcgaaatagaccatcgtcactagggttgtgttcgtttggattccaataggagagcaccaattgtttgacaagttacatgttgtctatttttcattagcatatgctgaccaaagaactatctaaggtcaacgcggcttgtacaaacattggaaaggtaaaaacctcagaaaatattcaacgtgattaagggctgggttggttagtgcccctatttatctttgaatatggggaaagatggacaggataaactaagtttggtaagagtctacatggttgttaattaatatggttgaagttgaatgggaacgaccttttgggggaaaatgaggggggaatggcagggagcaaggaagacgcggaagtttgaccccgttgtcgcagcgtcaattccttgggctagcgtgagggtaaaacactatgggtttaatagagcgatttaggggagacttcgtttgctggtccttttggcattaaaggataggacggtgatggcctatggtttaaggtataa

SEQ ID NO: 517574 - DNA, 143 bp, Homo sapiens
ggagcgcggccagcctggctaacactggtgacaccccgctctctactactatcaatacaaaacttaggcatggtggccggcgcctgtaactcccagctactcacggaggctgagtcaggcgcctctcttcaaccagggagccg

SEQ ID NO: 517575 - DNA, 1594 bp, Homo sapiens
  misc_feature (322)..(322): n is a, c, g, or t
  misc_feature (450)..(450): n is a, c, g, or t
  misc_feature (583)..(583): n is a, c, g, or t
  misc_feature (805)..(805): n is a, c, g, or t
gagaggctccagagcccgcgcgccgacgcgcagagagtctctcagcgccggtcggcagccatagccgtccgctgcgcctcgctcaagccatccaatcgatggctagaataatcgtccagcccgtgacagtagactagtagcgagtgcgtcgagatcccatgcatttgcatgatcgttccatgaagtatgctggatgatggatggttatagaactatcactactcgtgctcgagaaggatcagggagtgtgccgttagacggcttcgaatgaaagtaacattgagagcgtatggcgtagcacttcgagcacagaggagagccnacgaaaggaagcacctgcgttgtctctttgagcccggcatgattgaatgaaaactggcacaccagatcagtggattggctcatgcctaggatttatcatctagtaaagattttcttatagtcttgatntgtgggctggtccttagacgtattaggcatatgccattggaacatcactgtcgctcgaagggcatgtctccatgtcgccatgataggctggagcacttgaaagggaacactaccttggggacgccttcgtgcncctttgcaaaaaacactctagcacgccatccgtattcccctttaccgaggacacatatgtgcatagctacgaattcagtctttctctaaaaaggccacgaacacgcaagtgcacgccgctggaagccaagaacataaaacacaagcattcatatcgcaggcacgcccaaacctgttgcaccgaatcaggttcaatcaataggccggaagatgtcgagctttntatatttaaacagagcaattgtaaaaaaaattaaaatggttaaatttaaaacctcggagcggacatcttaagtgatacgcgcggggcggggggagacaaaaggaggggtaatgtgcacaagtgggcacacacgtgtcgtccaataaagctgggttcccacgtgggacccccaaggcttttcttttggctcccacccggggtgggttcacgattcttcgccaggagttcttcccccatcaattaagggggaagaggcggtaactaaaaattagccggaataaaggccatgtgtttaacccttgtcaagagaaccggcagccgaagacgacccattgaaaacacccacacaccaaccccccgcgcgggcccgccacaaaaaaggggggttcacccacaccctatgggtccgacgcaaggacaaaccaccgcaggtcgtagacgccaccaacaacacgacaagcaacgagcagcggaagaaacgacgaactaaaaccccacgagcccgccacgacagcagagacggagaacgacgcggagaagaaggacgagtcagaagagaagaagacagaggagaaacaagcgaacagaagccccggagacgcgagccgaagcagagcgagagcagggaacaacgaagagacgaaggaagcaaccacagcgggatcggggcgagagagaacaaagagaaaggagaagcgaagagcaagcagcacgcgcgacgaagcgacgacgcgaagaaggaccaacacgaagacagagcgaggaggcagcggaccgcggacacgagat

SEQ ID NO: 517576 - DNA, 2720 bp, Homo sapiens
tttcagctgttatggctaagtcagttaacctcatcaacaattttttcttctgtaaattgaggacaatttttgcttttatgaatgaagtcttaaccagcaggaagaaatataaacaaaggaacatatttttaatttaatgaagcaaaattccatacatcattttgaaaatagtgtttctttccctgataggcctgttctgcatcattcttttagcttccttctgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccgggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaaattagccaggcgtggtggcaggcacctgtggtcccagctactcgggaggctggggcaggagaatttcttgaacccgggaggccgaggttgcagtgagctgagatcgcgccactgcactccagcctgggtgacagcgagactctgtcaaaaaaaaaaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttttcgtttcttgtgtgggaaagctcataaattgtgtggtcttacccctctggaccctgtagttgtagcattgtgaaaatggagcttttggcaaaactttgtattatgctgttgactcacattgtctcatatttttcctttattcttctatattctatgaatatggtgctgtcctgtcatttaattattataatatatgtgaactgctggaggtagactgatgtgagtgcagtttttcaacttaaaaacccttatatatcacattcatggtgtttaagatataagaacagccctacaaagaggggttgattgtattgaagattctttctgctgagcctgccttaattgtgagggtggttgtttgggtatcttagagctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccaggtacaagtaattctcgtgccttgggctcccgagtagctgggatttttagtagagaacaggtttcaccatattggccaggctggtcttgaactcgcaacctcaggtgatccacccacctcagcctccccaaagtgttgggattacaggcatgagccaccatacctggccccttttgttgttttgaggggcaggcagtaagaagcagggatttcttcaaatgctagtaagcacaaagagagggagaagtttttgtaagtaacgaacagggccgggcatggtggcgtgagaggccgaggtgggcagatcacgaggtcaggagttcgagaccagcctgaccagcgtggtgaaacccccgtctccactagaagtgcaaaggttagccgggcatggtggtgcacgcctgtggtccagctagtcgggaggctgaggcaggagaatcgcttgagcctgggaggtggaggttgcagggagctgagatcacgccactgcactccagcctgggcgacagagtaagactcccgtctc

SEQ ID NO: 517577 - DNA, 155 bp, Homo sapiens
aacgatggtcctcagctaaagcagtaaggaaataaaaattataaaaaggaagcaactggatgcagtaattaagcgggaccagcaaaaaatcaaagaaatacaattaaaaacaggacaggaagaaggtctaaaaccgaaagctgaggacctcgttg

SEQ ID NO: 517578 - DNA, 189 bp, Homo sapiens
  misc_feature (92)..(92): n is a, c, g, or t
ttgttctgctcatcctcgggggctgcaccactttctaacatgtccattgagatgagaagggtaccgcagttgaaactgcagaactcacctgncttctgcattggtctctctgggagctgtacctttttggccatcttgccagatcccatgaaataggacttttatacgctaatgaggagaagtcagcac

SEQ ID NO: 517579 - DNA, 877 bp, Homo sapiens
ggaaagcagcaagccccgggctgtgctcaagccacggcgcgtgtgcgtggggggcaagcgccggcgtgatgacatcagtgtggacacgctcggacttcaccaagaagatcctgcacacgggctggcgacccggctgagaacatcattgccattgccggaaccaacaaccgtgtacatcttccaggacaaggtaaactctgacatgcactaggtatgtgcagatcccgggccatgccacccagcctcatgcaagtcatccccgacatgaccttcacgaccgtgaatgcaaggaggggaagtaaagtcacaggcactgactgacggacagctgcagaggtggcagctgtgtggacacaggaagttagggccccctccctgccccagtctttcctaggccagaatcgtgttcggcagtaattgtctgtgtaagagagatagataacaagaggcagaggacagcgttcaccgtcgcgacactcataaaatggacatgactgtggagtcttacagttcagggttctttcattcacgtcccttcctgtctcggtctgcggtcttgaccacatcaataggactctgtatgcgtccgggttaagttcctcactccagtgtgtcctgttgcggggaccggagctgatgggagctgcttctcccccatgcctcacgtggtccgagatcagggtctccaggcacagatgatgagtctcaaacgagccaagccaggggttctgataggccataaatgggggcaattcgccctgttctcagagctgattgacctcacccgagtcctgggatggtgaattctagctgacgactttggcagatgcaagctcctcttctaggtcttctgaatgtcttgaacaatccagggccc

SEQ ID NO: 517580 - DNA, 291 bp, Homo sapiens
accccgctctatcaccgaacacaattctgcttctcaaggcacatcttggcttagcttagaattaggaagtttgcagtcacaccatcatccatctatacatatgtcactagtgacattacattcacttgtgtttcatattccagtaagaacgaacaaagccaaacccctctagaatgaccagtacttcaagatctttacttagacctgcaccatcaagaacttctccaaatggtactaaacatactcttatcagagtcctgattcggtatagagcggagaagggtaacgaag

SEQ ID NO: 517581 - DNA, 686 bp, Homo sapiens
accctttggggaggggcaaaaatggccaattcagctaaatggggcccaatttatgggggctccaaatcattgttccccaaaaaaataacccacccaggtttggggaacagcataatagaaggtggccgtccccgctaaggctcggtagggagatccccaagcacgtgggagttttctaacaataagactttttttgcttggagggacatgcggaccccattaattcccaagcccagaatgaattgcctttaaaccaaggagtatttaaatgcctgggccctctcgagtcaagagtattttctcatatgggaagaaataggggaaattttaatgctcagaaagttttcacccctttttggttgccctgaaaatgcaaggggccccataactagggaaaccggtggcctttagagcaagggggggttcccttcttgttagtgagccaagcaatccgtgagttcaagaaatgcaaaaccggcaagtctgctaaggactacaatgagcttggaactgaacttttagcttcaggtgaagacacgggctaacaaagcctgtggttgagtctttccaaaaaaagcaacctctccaagccgggattttggcctgtccacatttaagttaataaaaaaatgttgtaactgcttccgacaatgtcaaattagacaattaaaataatagtgatcaac

SEQ ID NO: 517582 - DNA, 209 bp, Homo sapiens
tgttcacgtgtgtcatgattcatcccggaaattgtggctattcatctggcaccagcccaagccaatctgtcccagctcctgggatcacttgtggacaggaggtcatctgtgctgtctggtgttgacctgtgctgagaaccgggatgcagctgcatgttgcaccatgaatggtgcttgtatgactgcctacgctgtgagtgccgatgctg

SEQ ID NO: 517583 - DNA, 158 bp, Homo sapiens
cgcgggcccgcaccagcgtctccgcgggctcatcgataagcagatagcgtcgagcccacagcattccttccgccgccggccagagggggcattccccgtcgccggctaccacgatcggctgcttgagggccagaaaggcctgcaccaggttctgaccc

SEQ ID NO: 517584 - DNA, 421 bp, Homo sapiens
caatgcacaggacaattttttttacagcaatgaattatccagttcccaatttcaatagcaccaatattgagaaaccctgttgaagatggagactatccacggggcattgatcttggggtctcccccttcctgaaaacttgaagtcccctcggcagacttttggatacctccagcaatggggagctccccccctgtttttaaaccaggcaggtttgggctctttttgtaactgtgtgactttggattttcccataggtgggagtggatcccccccctttagcttcagtttcctccagtgccatgggattagcaacagccctgcctcccagattgggtgaggatgaaattaaattatgctccttagttggctggtgcagtgcccggtacccaaagagtgctcaataaatgttccctgctgtga

SEQ ID NO: 517585 - DNA, 215 bp, Homo sapiens
tatgctggtccccagcaggaactcaaggattccacttttgaagtgtcatacacaacttttccttgctatgaagaaacatgtactttccagctgctacaaaagtaaaaatttcctccctgactctccccagagaatacatgcacagaaaactgaattcatctgttctggtgctgcttggaggtaagaaaaataaagagaaaaagaaaactgttaaa

SEQ ID NO: 517586 - DNA, 657 bp, Homo sapiens
  misc_feature (276)..(276): n is a, c, g, or t
  misc_feature (472)..(472): n is a, c, g, or t
  misc_feature (505)..(505): n is a, c, g, or t
  misc_feature (520)..(520): n is a, c, g, or t
  misc_feature (551)..(551): n is a, c, g, or t
cacgagcggtacgcggactggtcggtcacttgacccggttattgcaggtcgaacccttggctgcgggcctgcccatggcgcgggtgaggttggtcgcgggtccaggtcagcatgtgtccttttcgatatgaaaggccgccaaggtagcgctgaggcggtcatcaaacagctcgctcttgacccccacctcataacccacgccttcttcaggcttgaaggacttgccaccggcgtccaggccactattgggcttgaacgacgtggaggcgttggcanacacgccgacttccggcgtgagctggtagagcaggccggcgcgctgagtgaaggcgtcgtgggtttggcggccattggcgtggttgcgggtgaagtcgtcggtgctttgttcgaagtgttcgaagcgcgcaccgatcatgccgcgcaggcggtcggtgaagatgatctggtcttgcaggttgagtgcgtggctttnggtctgttcgaagaagtcggtaccggagcgttnccgttgggtttggcnggccgtacaccggcttgtagatgtcgatggnatagtcccctgcgatcgccgtcacgcgctctttcttgcgagtatcctcgtactcggtaccgatcaacagttcatgttgccaactgcccatatcgaacaccccgcgc

SEQ ID NO: 517587 - DNA, 831 bp, Homo sapiens
accagatcttcattccataactcgtgcttctcgtcctaaattatgtactagaaaaaattgtaatcctcttactataactgtccatgaccctaattcaactcagtagtattatggcatgtcatgggaattaagattttatatcccaggatttgatgttgggactatgttcaccatccaaaaaatcctggtctcatggagcccacccaagccaatcgggcctttaactgatctaggtgaccctatgttccagaaaccccctaacaaagttgatttaactgttcctccaccattcttagtcataaaagatacactccaaaagttcgagaaaatctagataggcgccaacaggaacgagaaaacaacatcccctggtatcaaagcatgttcaactggaacccctggctaactactttaatcactgggttagctggacctctcctcatcatactattaagtttaatttttgggccttgtatataaaatggtttcttaatttgtaaaagaatgcatagcttctgtcaaacttatgtatcttaatactcaatataccccctgttataatggaggaatcaacgattgattcccaaaaacacaagtgggaatgtaatgccagcttgttttactaaccctgttttagactctcctttctttaatacccaagctgttcacctgattgatctcctttagtaaagagcagaagatccacttgggctcctgggccgtcccaagactaatggaagggcccccaccaaaggtacgtaaacggggcgctttgaccggatatttgaaccaccgctaactgaattacaccggagataggacactaagggt

SEQ ID NO: 517588 - DNA, 462 bp, Homo sapiens
aactgaccaaccagagaaaccgattggcaacccaaggaaaaaagcccattgcccccagccccccagacccaaacgcaagaaaagccactagaaatggtgaactgtgagccagtcctataagccttgagaaccatctaggcacatctagtgtataaaactactgaaatttatcataactgttcaaatttaaaaattattgtcaaacttgaggttattcaaattgccagcttttttgtacataccagtggtttctggtcccaagttccccttgaacttatttactacaatggtctttttacgcctatttatttccttctacaatagtacagaaaggctaaccattcatgggtcccataaaaaacatatgtgaaggacaggttctaagagtgaccaaatataccagtgaacatgactatctttctgaatgaagaaagcaattaagtgtccaactggatagagatc

SEQ ID NO: 517589 - DNA, 1568 bp, Homo sapiens
  misc_feature (562)..(562): n is a, c, g, or t
  misc_feature (612)..(612): n is a, c, g, or t
  misc_feature (1140)..(1140): n is a, c, g, or t
gctgcccgagtctgggtcagatgagcattgtcctttagagcatcctcaccgccagggaactagatgccgatggccaggggctcatggattcaatgcctgtgttcaaacacgctgatccgctcctggctctgtctcatgatgatgactcaatggctgtgaatgacagtcttggccgtagaatccgagaactacgatgaacatgcagttatccgtcgacgggggcgaacatatgtgtagtttgggtggaaacgcatcaatatttgccccgtgccttcatgcatagctcgtcgcgcgagcttgaaaccaagggcaccatcatctttagagcgttgctacacttgcggaagggaagcatagggggagaagatcggggggggagagagggccccgttgtcgcggtgcacacaggccaagcttccgtggctaacgactcttgccacaacgtacatgagcgctcaaatgcttggcgatctactagagtagtcatcgaaaataggaggcaccatgaaggggcaaaaccacccaaggtatggtagatactcctagcgtggtgacgtggganggacatcacgagagatgaagaacaagtctactattctactaaaactcacncaataggcatctatgcgtcctcggaggaccactttgcttccattgccccctgcccaaagcccaagccaaggatgcgggcggagggggttggcaccttcccttaatatccccgcgaagccataacttgccctatagagggttcccaaggggcacgggcacacacatggaactattataccaaggggacaggaacattggcaccaaggtcgggcgttcgggaagccccaaagttcccaactgtcccgttttcccttttcagtaattcaatttccccccgtggccgcaagcgttccctttttccaagagtaacgttggaccgttgggacacggggaacaggtttccagggggttcccttggagggaaacaaatgggcgcccccgcaagatatttggcccttgagaaacctttgtgcaggagggcggccaaagaacggcgaaaggcaaagagaactacaattatcaaagaaggttacttacttagaaagggcgtgaaatgggggggctttgaggcaaagggaaagggagggngcgccataggcgagcataaaagacacgccaccacacgggcggctttaagggcgacgactagggaaaggggggatatcactccgggagccaccaattttatgtagactccaaaggcgtggcccgtatagagataggcgggagaaaaccggccaggcgaaacacacatattcagcgagccaccggtttttagactagctaagacaagggacccagccgaagatataccgagcacaaaaataggggaagactaacaatccactacgcagaggaagaggcgaacaagtaggaagtcacaccaaacgaaggacaccaagcagtaagtggatacgacagcatagcagaaagaaagtcaaacaggagggcgtagaacaaacaaacaagcagggtgtcgccgcagaataaaaaatattactgcagcgcaccaaaag

SEQ ID NO: 517590 - DNA, 420 bp, Homo sapiens
cgacgaccatcacactcttcttgaggcgcaagaggtcgttacacgtgcgcagctgtggcactcgctgcttgctccagactacgcgctgactgctgctgtgacagctacacatatcacgattatggccatctatatgtgtgaccccgactgggttggtgacactcctaataggcgtacctatgctgatgatctgaatgagtgcattcccaaggtaatgcatgctgaagtgaccatgacgatggagtggactctactttggccatacgagatacactgcaagaaggcatctgtcgatgatgacctggaacatcattggaagcggcactgtagctagcacgcgtacgattgacgacgcacctgagtaatgactacgggatgtactactctgtacgcatgcatgggatgggatctgttgccgcc

SEQ ID NO: 517591 - DNA, 216 bp, Homo sapiens
ccctctagacattcacttaactcattccatcatgccaccctgacctgctcaagtgtcacctgttcaaaaagattcttccagagctccttatgtaaagtagcagtccctgtctccctgaatgtgattaccctacattatgtttctttgtcctattatgcttttttatttagacaaggtctcaccctaccctgggtgacaaagtgagactccatctca

SEQ ID NO: 517592 - DNA, 1161 bp, Homo sapiens
ggcccggcgccaaggcttcgcactcacacggcgcccccgagcgtacgccgggtctaacatggcgcggccaaggaagccactggcccaccccattgagggcaccgctgactatcgtccccgcacggcgcaccacgcctcggccaccggctccgaccccccgggacgcagtgggactcccaaacagggggaaaacagactcgccacaccaacaagttcaaactgccggggccctcttggggatgcctcccccagtccttccgttacaagggctcacgaaggtctaccgactttgcgacgctttctcgctacagatcgtccctccttggccatatgtaaccctggtggggcgtgccgacactcatgcttggataaactacgggacgcactgaccaaaccgctcgaaccgtctagcgactcggtcgacctgtactggtgtcttcggttcataccatggccgggcgagctttatatttccgtgaaggcccgtgcgtccccccatacttggggatccacaggtgcacccgatggacgcatagacaattcggtgcgtccgggacaccgttacgcgcgtgaccttcgcccggtcatccctcctgtcgaccagtgcatgccgcggctcccctcgccaacctgacgcggatctgctgcaggcaatcgcgggggatccctcgcatctgttgtggcaaggcagcaggcgacgctgcccacatatacggctgtaccgggcaactggacacgtgcactgaccacgatcagcaccattaccgcctaccactggagccctgcccagaatgagcgccagactgcctgactgtctctgttcttcgtcctagggtatgcctgagtgtgcccctctttcctcctgcaccgttggaggtggggatcttgcctcaacagcgctacggaggcaactgcagaagctctcgtgagtgtcaccctgaagtaccctgtgtcctgctcagggactggagaagggctggagaggggctcagttccactatgcttgggtgctcagcacacgcctccaacatctgagggcgtggaccattggggtactgctggtccaggggtaggatagtaataggaagtagaaggaggaaggagggttagataaagaatgctgaataggcagtagatagggagagagcctcaatattgggg

SEQ ID NO: 517593 - DNA, 206 bp, Homo sapiens
ctctgacaggtgatgccccgccctggctgcagcttccttcctcccctgcatcaaccctttgtcctgcggcacaagttttcatttgagtttcctttttctggtttgttttttgtgagacggagtttcctctgttgtccaggctggagtgcagtgaccatgatctcagctcactggaggcttcaaccccccaggttcaagtgattctt

SEQ ID NO: 517594 - DNA, 978 bp, Homo sapiens
gagcagtaccatggcggttggcaagaacaagcgccttacgaaaggcggcaaagagggagcctaagatagaaagtggttgatccattgtctaagaaagattgggtatgatgtgaaaagcacctgtctatgttcaatatagtgaaatataggaaagaggctcgtcaccaggacaccaaggaaccaaatattgcatctgatggtctcaagggtcttgtgtgtgaattgagtcttggtgatttgcagaatgatgaagattgcatttagaaaattacagggctgattactagaagatgttcagtggtaaaatacatgcactggagtaacttactcatggcatggatcttatcctcgtgatacaaatgtgttccatggtcaaaaaatgtgcagacaatgattgaagctcacgttgatgtcgatgactaccgagtggttacttgcttcgtctgttctgtgtggtttatactaaaataacgcaacaatcagatacggatagacctcttatgctcagcaccaacaggtccgacacaatccggaagacgatgatcgggacatcatgacccgcgaggtgcagacaagtgcactcgacacgaagtggtccataaattgattccaagacagcattggaaaagaccatagacaaaaggcttgccaaatcctatttatcctctcccatgatgtctttcgtcagaaacagtcacaattgctgacagaaagcccaagtttgaattgggacacggctcatgacacttcatggtgaagggagcagttttcgagacacgccttggggacgagcaccggtgctcaagtttgacgagtgacgatatgagcacaggacacaattcgctaacgttcgcctcactctggcatctacaaggccttgtgacccaccaccacatagaaaccccctcgtcccaccacacaccaccaaatcggccacgccacacccgcacaacatcacgtcctgagccacgcactacc

SEQ ID NO: 517595 - DNA, 323 bp, Homo sapiens
agttcccattcacctgctctcaaattggaaaaaaaaaaaaaaggaaggaaaccgggtacctaaatccaaataatttaggcttttctgtttcctttccggaaaaattggaaaaattggccttggagaatccccaaatagcttcagttgaggaaggaggcctcttttttacagaagaatgtcatttataaggggggagtaacagaattggacttgggccattctgcacctctaatgaaattattagttctggaaaggatagggttaatggttgaggagaaaatgcttctagcacatttgcccaatgagaagcagattgtcatcac

SEQ ID NO: 517596 - DNA, 153 bp, Homo sapiens
agctagtcttttcatgttaaaaaaaaaatgtatttcatatcttaaaacctctatagcctttagctgagcccagcttccaggtcaagggtacaacttctaaatctcaaacattttaggcaagggtatatacttaactgcacctcaatatcttgg

SEQ ID NO: 517597 - DNA, 89 bp, Homo sapiens
ctggtgttcttgctaactttgcccttcactgttgcttaattggaccagccaaaagctatatgttatggcttattgtgtgaaggtaacta

SEQ ID NO: 517598 - DNA, 158 bp, Homo sapiens
ttgagcctcggaggaggccggtgaggcgcggacagggcggcctcataccagacactgtctcgacagcagcaattatagtcagctcgataacaaccaggctctgacaggttcagctgaccagggagcttaacaaagaagcaagggcggcagcccgcagg

SEQ ID NO: 517599 - DNA, 224 bp, Homo sapiens
ctagattgacttgccatggctcttagaacagttactcttgtcctcattgtagagatggcgatactaaggcagaatatggctagcctggacttcacttctgcaacatttattgatgaaagcaagtcacaagaccagactgattcaaggggtggagaaatacaccctacttcttgatggacggaggagcccacccacatcgcacagggacccgcacaaacacaggc

SEQ ID NO: 517600 - DNA, 810 bp, Homo sapiens
aggatcggcgctgcgatgggagccggcgccatgtctgcgcatctgcaatggatggtcgtgcggaatctgctaaccagcttttcctggatcaacggacggtaatataggcagacctatcgaagcacgtagagactccatagtagacttggaagtgccactgcaacttccgtgtccagcgtacgatagcgagactgagtacgaccagcatacgactgttggagtcgatggagctctggtcatggctcgtacggcgattagaggtgatcgctgggtggctcatttaacctggagatccgggcctagcaggaatgcctgcctaccttcgctatgtgcggaaccgagtcgatcaaacccttggacttgggcgttcgtatgctgacggcctctaaggccagtcgcatacactggatcagcatagataccggccatagaaacgaagttaaacgcggctccggactctgcgaacattgggagatgttcagtacccgacgcaggtggtccaaggcgtcccattcccttgccgccagccgagatagtcccttggtgacagtggtcgacaccgaacgggaacagacggggaaccttggtcccccaagcaccagttgcgaacgccctcaccttggatatccccgcacctttggttccatcgcaaaacaaaggcctacgctaaagcaaagttacaattggcatggcgtgcgtatcacctctcaaccgctggttatcacgaactcagccacatctctcctttgcgtaacgacgcccaccgttgtacctcgttgcacttcccctatgtaataccgcctatacttg

SEQ ID NO: 517601 - DNA, 734 bp, Homo sapiens
gagaagaggatggattagacaagctggagctgctggctcccggatgaatttcatacctgcggttctcagctgcaggcgacttggactaccaggacctcctgatgttgctgaccatgctgcttaccacccctttctgcgtctgtccatattgcctgcttcagcaccaccagccacctcaaatcctgatccagctgtgtctcgtgtcatgaatatgtctgtcatcctgccactgtctgtgcagagagtgtagcggctctgtgtggaccccagacaccgccaggggccagtgaacctgctctcacaccctgagcaagggggtgaggtgactgctcactatgagagggaggctgggttctcatggatcgaagtgaccttcaagaaccccctggtatgggttcacacattcactgaacacgtggtggtgactctgaaccgaataagctctgtgtacaattggaaggagacgctattctcagtgatgcccggcctgaagatgaccatggacacgacaggtctcctgctgctcagagacccacacacagtgaccatcagcctgttgttatgggatggccgtggagaggggctacagctccttctgcgtgacactgaccgattctacagccacgctggagggacccttggccagatctaccaggaggtgctctttggatctccacagcatcatatgacggcagacgcacactgaggggtcatggcaatgaccactctgcccc

SEQ ID NO: 517602 - DNA, 367 bp, Homo sapiens
  misc_feature (1)..(1): n is a, c, g, or t
  misc_feature (78)..(78): n is a, c, g, or t
  misc_feature (92)..(92): n is a, c, g, or t
  misc_feature (357)..(357): n is a, c, g, or t
naaaacctaactatcctaaatatatattcacccaaaatagttagcacccagatttcataaaggcaagttcttaggagnacctttcaaatagnacttaggactcccacacaataatagtggtaggacaaagatattcagggacctggaaatcagtaccaggatcaaatgggacatgataggacatctacaggggctctccatcccaaaacaacaggttattcattctcctcattgccacatgggcacataatctaaaacaaatcacaaaatcagggaataaaacactcttcaggcaaaaggcaaaaactggaaatcattaacaaagagtctcttggggccaggggcacaatcaaattngggaatcaag

SEQ ID NO: 517603 - DNA, 337 bp, Homo sapiens
aggactcccggcgacggattgtcagacttgatgaagaaggacaccactctagtcaagagtggtgagcgtgagagctgagaacgccaggcaaatggcaggatagagcacaatattagaagctgagaggagaccactcgggctggagcttagcaagaaatcagcatttgatgagagttcaatgggaaggcaagaaccagttctcataaaccaaggtgaacagtttacagttttacctgaggggtaatagaaagcagaagggttctaaacaggggggtgatcagatttttatttcaaccacccaatcctggccaggtgtggtggctcatgcctgtaagcc

SEQ ID NO: 517604 - DNA, 647 bp, Homo sapiens
gcgtggatgacggccatccgatcaactaaccctggacagacagtttgcggaatacaataggcacaacggtccggtttccaaaaagaggaactgtagttgctgtctttggggatatgccacttgaggctggtaatatatacctctccccagaggtgctacccagaagataggacttctagcatgtctcccagaactctgttacctgtcctataaccccactcctctaggtggtgccagtatttctgtgggggatctttagtagatgagcagtggatactgacttgccggggaggttctcctcctggtgagcctgccttgtgtttggagaccaaatctcatgccacattaaactttccccagagaagctaacaagggagctctagatgcaagacactgagagtcacaaatgacctttaacagctttgtacccaaccgtatacctttcaccgactatgaggcatggttgaccaccccagactaacgtcttggaaagccaggcttacatatcctccaattacccaaaatgatttgtggtgccttaaactgccagtttttcctgttttaatcttgaaatgtaaagcctttaccaccttttgggcccaatgtttctttcgcccttgggttttttttcccccacgggacttttg

SEQ ID NO: 517605 - DNA, 107 bp, Homo sapiens
aaacaaaaaacaaaaacccacacaaaatagagaaagaaggagactgtatacatattgggccatcgctcagcgaagacgagcgcagcgagctaggagcgaggaagcgg

SEQ ID NO: 517606 - DNA, 498 bp, Homo sapiens
actttcatagtgcgagcaagatgtgtttgacagtctgtttcatccacattcaagcatttcttttccagatttctcaacattacagaagtttgttgtatttgttgatattttgggtagtggtggccaatgtctgttatctctctcctgtatcgctgccccttgaggcccctgggacacagattgaaaggtcgcagcttccccaaggtacttggactgcagacaagctggctagcggtcagcaggcggcatgttgtgaatgaggagacccgctcatttctatgacccatcagggaagctgaacaaaatctagaaatgtcaccaggataactgcatagggagatacagcatccttgacagctctataactattatgcagaaaatagcaacagcagaatcaactaaggttgtaaaggaacattgaaaccattatgaatggagatctaaaagaagtgatcagaaaagcactacaggatttggcaagcaccctgtggaaacgta

SEQ ID NO: 517607 - DNA, 469 bp, Homo sapiens
ttggtgacctttgtaatgtggaacagtatttttcattttaaataaaatttagagtgattaaaaaaatgattattttcctggggcattaaaccaagtctgatgaggtttttagcttcatttgtgatgtaaaacccatagttaaaattaaaagtagttccttaagtatgcaaaccctgtgaaaaatatttctagtttcaaaatccttcctaagggaaatgcccatgctatggaaatccctatgattagccttaattgttatgcttcttgggtccccctgcaaaaaaaccagacttgtaaaaaccaacctcttttttttgccccgtaaaggtcataacaacagacattgtcttaaaatggaataggaaaatggtctcttgactgatttaaatggtaatatgtaataaaaaaccattatattggatgggtgatatgggagggaaccttccttaagttacatttctttcatatt

SEQ ID NO: 517608 - DNA, 213 bp, Homo sapiens
gagcgtgtttcttcatcgtcgggcgcccagacacagggcgtaatggtgggatgggcagaaggactcctacgtgggcgacgaggccagagaaagcgtggcatcctgaccctgaagtaccccattgagaatggaatcgtaaccaactgggacgaatgaagaagatctggaacaaaccttctaaaagagctgcgctgggccccgagagaacccagt

SEQ ID NO: 517609 - DNA, 1585 bp, Homo sapiens
gccccacaaaacaccttcagtagagccttgattaaaaggaaacctgcagactctcaaaaaaaaaaaaaaaaaaaaaaaaaaaaaaaaaaaaaaaaaaaaaaaaaaagaggggcggcggcgcgccaacaaagaattccccgccggggggcccccactactcgacggcgtcccccagttttgtgtgggaacaaaggggggcccccataagggaggggcgttatttatataacggcagaaggagcgggggcgcgaggggtgtttatacaaaagggtgggagaggtgggagaaaagcggggagaacgggggagatcttcttggggagaagaggagaccttatatatttctgggggggggggggagaaatatatgtgggggagaacatctctctctctctagaaaggagagatatattatagagagctctctctaggggggagaatataatatataaatatttataaaagaggggtgttatatgaggtgggtgtagaaacaatagagggcggagatatattcgtcggggagcggagagtggaaaaaagtttatgtggagcctactatacgggcgaggtagtctatagtagtagtatttatggcagaaacactatatattatatacacgagacgggggggtctttttgtttttgtaaataaaaaaaacggacgaaaaaaaacaagataataaaaagaatacagaacagtaaaagagaaaaaaaagaaaagggaccgcgagcagacagagagagcgaagaagagcgaagggacggcaagaacagaacagcgcacggacgcgcagcaggagaggaccaccaagcgaaagggagacgacgcgaggcagggcagcaggcggagggaggggaacaaggcagagaggcgggctagacacgacgagaggcaacaacgaacgcacaaaaagacaacacccaaggaaagcaacgcacacagaaaacaacagagaacaagagacgcaggagacacgagcaggcagacaggagcggaggcgagcgggacggcagagcgccagacccgcgaacgccgcggacgacgcgagagcgacggcagaacaacgacgccggcagcaggagcggcagcggaccagaggaacgacgcacaggccggggacggcgaaggggcggaacaggcaaaagcacaacgcacaactgcccgcccacaacgcgggaccactgcccgacgggggcgcggggagaagcgcgcgcccggcgaggccgagcgaggaagacgaggagggcggggcacggcagcggaagcacccgaccggaccggccccagcgccgaggcgagcagaacgaggagacaacgagcagacgacgcgaagcgacgggcaagagcgcgcaagggcaccacgagcgaccgcacaaaagaccaacacgcaagagcgaacagaacgagcatcgagacgagggaccagcaggacgccagggagcggggcagggcggagggacgaggacagcggaggacggagccagcgcgacacgcaggagaagagaggagcggaagagggacacgacacgagagcgaggaggcacaggagcacgagagcagacgagaagacgacggaagaaa

SEQ ID NO: 517610 - DNA, 344 bp, Homo sapiens
agcagttgggaggtctccaggacccggtggtccccccagtactgggtccatggtagatgtagatgtggccagtgatagtcatagacccgccggtgacatgaacgccatgggtaccgtgggccaccgggctctgctccccgggttccaactggcggctcccggtgtcaggtccagacggactctggctgtttgcggcaccccgtgcctccaaaactgggggctagcggggagcccagttggatactgggggaaacattctccagaaagtgggtagcatgtggctgtaccaatgccaggcgccgtatggcatgggccttcgggaggttcccacgctggctcagacg

SEQ ID NO: 517611 - DNA, 321 bp, Homo sapiens
gaggatacaggatggagttcgctctgtcaccaggctggatgtgcggatggcgcaatctcagctcactgcaacctctgcctcccgggttcaagtgattctcctgtctcagcctcccgagtagctgggaatgcaggtacgcgccaccatgcccagccttctgtatttttagtacagacgaggttcaccatgttggccaggatgatctcaatctcttgaccttgtgatccgccagcctcggcctcccaaagtgctgggattacaggcttgagccactgcgcctggcctattcttttgttcttaaatgtttggtagaatttgtca

SEQ ID NO: 517612 - DNA, 406 bp, Homo sapiens
  misc_feature (406)..(406): n is a, c, g, or t
cagagtctgaactctggacactatgggcgcacgactattccaagatttgtgtcttgtcctcctgacattgcgatatgagagccatatgacccaacagacgcagctggatcagatgcctagcccgagctttctcacccatgtgaaggaatctctctctcaggtactggcagtcagcgaagacaggcgcccactaacctgtacgagaagacatacctgaccgctgtagatgagcttatggacttgtacagccacagcgcaacatacatgagcacttacacaggcattcttactggccaaggtctttctgtgctgaagggacagtggtaacaggcataccccgcattagtggacacggggagagtgccctaatggcctgattccccgctcagactgagcttccctttcn

SEQ ID NO: 517613 - DNA, 249 bp, Homo sapiens
ctcataatagcctatatatgacgtaatcgtactaacaaatagacaaccggttccagaccgacagaccaccccgtctatccaagacgctcgcaacagccgacagaacatctcggtgcccaccaaaatgccgctaatgaagtaacaacaaccccgcaaacgttgtgtagattcccatggcactatgtgctaacatgttagtcgtatggagcagtatacccaaccgtacgaggaatcttgagcgcgcacacg

SEQ ID NO: 517614 - DNA, 359 bp, Homo sapiens
cgcccatttacctttcctctacactcataatattcacactgctaatactactgagtattctagaaatcgcgtgtggccttaatccaaggctacggtttcacacatttagtgaggctctacctggacgacaacacattatggcccaccaatcacatgcctatcatatatggaaacccaagccatgacccctaacaggggcccttttagaccttctaatggccttcgggctagccatgggaattcactttcacttcatatacggttctcatactatggctacttaccaacacacttaccatataccaatgagggcgcgaagtgacacgaggcacataccaagggcaccacacaccctgtgc

SEQ ID NO: 517615 - DNA, 1024 bp, Homo sapiens
  misc_feature (281)..(281): n is a, c, g, or t
tggaaaaagggggccctgccattcaaattagggaagtggtaattcgccttggggaaaagattatacagggaagcgccatcgttggatcgcgtgcagacccccggggacacttttctaaggagaccttcgcttacttggggaccggaccttgtcttgttaaaagtgccgagcctcgttctgtgaagaacattgccccagaggacttctcttggtcgtgtcggggcaagtactaagaccacttgggggttcccaagggcactgggacacatttccccacatgnccccctggttttttatcccacgctgggcccgcttcgtcccctgtctgacatggaacggggtatcaaagaccactggaagatggcgtgtcccacagcccacgccgtctaatccaagggtctctacgccgggatttatactttcgggggtctccacacaccgctattggagaactttcttgggcccaaaaccccacgggcacagtgttaatccaccaccccaactgggacacacgagcccacttgggtgggcacccgctggtcaatcctcgtcacaacacaatgccggagttcaatgctgctccgggtcaaccctccaccgagttccaccacgagccacggaacacattccacatgtggcctctacatggcacctgccaccctggcgcctttgccctattttctgttcacgttttttataaagtgttgtaaagagaacttcctgagggaaagaacaccaccacgtttatattctgtaaaagtaggctctcgtgagagaggccacccacatgcccttgtgcccttgccttttgggactgaccacggaggctgctcaatgtgcgtgaagaggtgggaccactttccttgcggcacagtggcttccgcgtgccccgtgtgctggtgccggttctccctcaccgccgacccggagaagggtgtttgcgcactctgatcaactggaacctctgtatcaagcggctggattccctttttcctttactccaataaaagctacatcagactga

SEQ ID NO: 517616 - DNA, 473 bp, Homo sapiens
  misc_feature (33)..(33): n is a, c, g, or t
  misc_feature (35)..(36): n is a, c, g, or t
  misc_feature (46)..(46): n is a, c, g, or t
gcgttatcgaggatcccgtctgagcagctgggnanngtactgctgnttttcagcgacaggtcttctcctccagagaaaactgcccctcataggctgggtagaagggaagccccaaggcaaactgaacatcgccagcagctccagtgctgcatggccgtagttttcaggagcatggtacatgaagacgtctcctcgggccctctttgcccaggcactggccattgtcgattatagggcagatgataaagtagtcccgggtggcaattctccagagcccgggagcaaggaggcatagtcatccgtgcagtgctccagagagtaataccatgtagcagcagcctcgaacgcgggcaatctgagtcctcgcaaccagagaatcttgcagttgctggaaaaaggctgttttgctactggtccggcctcgatttatcctcaaattgcttcccagcttgttccagacggggaatcctcta

SEQ ID NO: 517617 - DNA, 744 bp, Homo sapiens
tggcacatgcaagcgcagagtaggtctacaagacgctaattcccctatcatagaagagcttatcacctttcatgatacgacgccctccatagatctgtttgccgttatcgtggcgttcctagttccgtgttatgcccgtttgtcctaacactcaggaactagaaaatctaactaatactaacatctcagacagctcaggaagatagaaagcggtcgtgaacgtattcctgcccgccaatcgatccttagttccgtcaattcggcctcgcattccctaatgcatttcgcttgcacataaccgagaacgaggttcaacgtatcccttgccctttaccatcagaaatgcaaatttggggccgagcctaatggttaactgtaagaccctacgtaggtacaccggagtacggtcgggcagctaaagtcgtttcagaaactgccgtagaatagttgtccccccatttagttccttagaagaccgagggcggaccttgttgagtttcccttttgaggtggttcgaaccaaatcgggacgctcaagtagactccccgtgaattgtggagatgtccgcccccactggccggtatttaagtcacttttaacgattcagcaaaggacaggtcttttggcgacgtccaattgacgctggttccccagagcatttagggcttaagaagagccaggatttgcaaattgccgggaactgtgctaaaccaaaccgattttcaaccgttaccatggaccgg

SEQ ID NO: 517618 - DNA, 1018 bp, Homo sapiens
ctacgcggtcttgccgctcttggggaattggcttgtcacaactcgttgtctgtgctatttgccggttttgttcaccgctccggggttctccgccgcgtttggtggcacactgggcccagttatgttgccgcgatgttaatcctcgtcgaaaggcgccctgtaactgttgggtgaagcttttccctggggcaccattgggcctccaagttcaggaagtgtgcttgtcaaggttgttcctacgtgcaaccttcctggtggctgcctaatgtgccccccccatgggagcaccttggtttcatgggtcaggtgattatcctgacccttcccggccctattagtctccggcttattgcccctgtattggattgccaacacggctcacaattgcaagcaagtttgctgagctgaaggtaaagattgatcgcccttctggtataaaagctggaagatggccccttaattcttgaagtctggtgatgctgcccattgttgataatggttcctggcaagcccctagtgttttgagagctttctccagactatacccacctcttgggtcgctttgctcgttcgtggataatggagaccagaccagtttcggtgggtgtccatccaaagccagatggaccaagaaggctgctgggaactggccaaggtccacccaagtcttgccccaggaaagactccagaaggcgtaaaatggaattatttatccccttaataacctgccacccccacacttcttaatcacgtggtggaagaacggtttcacgaactgtttgtttcacattggccactttaagtttagtagtataaagactggttaatgataaccatgcactcgtaaaccttcagaaggaaaggagaatgttttgtggaccacctttggttttcttttttgcgtgtggcacgttttaagttattagttttttaaatcacgtactttttaatgggaacacaacttgagcccaaaatttgtcacagaattttgagaccccatttaaaaagttaaatgaga

SEQ ID NO: 517619 - DNA, 142 bp, Homo sapiens
caagagatggtccaacatttaaaatagcgaataatatcttagacccatccaaaaacaatccttcttaaaggtttatgaacttaataacagagcctcaaaatacatgaggaactcatagaactccaaggagaaacagacacat

SEQ ID NO: 517620 - DNA, 409 bp, Homo sapiens
gttcaacaccttccaatattaaagagcttggtatttcatcttgttcccaccgaaataaagtatcaccaagagaattacctgataaatgattcttgcacgatccagttgcatgcactgtattacttttccttcttgcttttctgaacttgaccgcatccaaatttattaaattcctgccatacagattgaagttcttgaagagctgtatgaggtcgggaatatgcgcttcatgaggctgctaaaatgtattcatggtgcctcccctttgcaaacgttcacatatccttttcaccatagccggatcgcaaagatggatcttcttaaccgcctttccttgttatgacaaccaggggaaggcattcctggtcctgatgaccctttgaacacatgcttagccgtggaccatgga

SEQ ID NO: 517621 - DNA, 859 bp, Homo sapiens
gcccaagggatggcgatggcgtacttggcttggagactggcgcgggtcgtgtccgagttctctgcaggtcactagtttcccggtagttcagctgcacatgaatagaatagcaatgagagccagtcagaaggactttgacaacattcaataaatcaagtgaaactcttgaaaaacggatccaggaaaccgaagtgaagctaaaaatctctacgcgctatataagcaggccacttgaaggacctgtgtaacatgcccaaaccaggtgtatttgacctgtgatcaacaaggccaaatgggcacgcatggaattgcccttggaggccgtgcccaaggaaagcttgccaggcagaacctatgtggattgtggtgtccagtttgagtccttcatgtgaaaattcctctaagtacaggttggagcctgaaaccagacaggaacatcaactgggtttggaaacttcttggtggtgacctccggaaggatggccttcacaaagatcatgtcaaccggcccaaaaaagaaattgcctataaaacacttgagaatgttttcatggaaattatggcgtgcactttaacagcttggccacgcaaggattgacttccaagttccatcacgttgttttacaccaaggacattggttggcctatcaccacgcacggtggggactgactcctggactaaactttcgttgatttttccccctggggaagtcgacgagaacaagtaaaaataatgccgtactgggcggaataggggggcgttatagattcctaggctctgatggcgggccatggccagggtggcctctcgaccctcctgggtaacggcgggtgctctaccggccattctaccctaggc

SEQ ID NO: 517622 - DNA, 373 bp, Homo sapiens
  misc_feature (43)..(43): n is a, c, g, or t
ttcccagaactgatcaaagtagcttactatatttaaactgtanaacaatatagtttctcctgaacacctgctttccttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcttctggattccgcggcggaggattgttggaagcttgcccgttgagtttcccctgagttcaccccatgtgttttctttcgtttgcggattttgtgttgtatcctttcgctgtaatatatacaaggccgctagcaaggagg

SEQ ID NO: 517623 - DNA, 180 bp, Homo sapiens
ccacctaaccaagaaggccacaaggccataggagctcctggaccaacttgctggcagtaacgactttgccagcaatcaagcatcaatggtacttatccggttctctaacttcctgtctgtaaagccattggttaaaggcttcccatacagtatttccagtttaatcaacttctctgtctg

SEQ ID NO: 517624 - DNA, 150 bp, Homo sapiens
  misc_feature (92)..(92): n is a, c, g, or t
  misc_feature (110)..(110): n is a, c, g, or t
  misc_feature (129)..(129): n is a, c, g, or t
  misc_feature (141)..(141): n is a, c, g, or t
tagtggaagttacatctccattgcaggaccctactgctatcattccacaggataaagctgtgacacctgacacctccatgctggactgtgantctcccatcacagggagnaggagtgttaggacatctncacgatgtgagncagtataag

SEQ ID NO: 517625 - DNA, 149 bp, Homo sapiens
gcctagaggatcccagaggggtgtaagcagtaatatcatggaattggcaggtgtggaaagcaggaaaagtggatacaagttcgggggagggggttcaacccatgaatatctgcatgcgaggccgaggacaggaccctcctctgtgctgt

SEQ ID NO: 517626 - DNA, 1229 bp, Homo sapiens
  misc_feature (61)..(61): n is a, c, g, or t
  misc_feature (63)..(63): n is a, c, g, or t
  misc_feature (334)..(334): n is a, c, g, or t
  misc_feature (340)..(341): n is a, c, g, or t
  misc_feature (353)..(353): n is a, c, g, or t
  misc_feature (356)..(356): n is a, c, g, or t
  misc_feature (369)..(369): n is a, c, g, or t
  misc_feature (372)..(372): n is a, c, g, or t
  misc_feature (428)..(428): n is a, c, g, or t
  misc_feature (493)..(493): n is a, c, g, or t
  misc_feature (498)..(498): n is a, c, g, or t
  misc_feature (502)..(502): n is a, c, g, or t
  misc_feature (529)..(529): n is a, c, g, or t
  misc_feature (556)..(556): n is a, c, g, or t
ggccttcgcctcctgacaggaaacggtttaacgggggacacgagccctgggaggccgggcngngctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgagggagcctgacgacgagcgggagctcgacgccgacgacgaaccggggcgacccgggcacatcaacgaggaggtcgagaccgaggggggctccgagctggaggggaccgctgcagccacctgcngcccgnngctgcagctgcnacngcggagccctggnggntactcggggccggacggacattatgccatggacaatattaccaaggcagaaccaanttctacgatacccaagtcatcaaacaagaaaacgagtcaggctacgagaggagaccacttggaantggangcangcagcaggcctatcgtccagaaatganagacagagatgaagcaaggagcacccnaccagcttcctcccgccctgaagcttctcaactcaagccagacagggcagcaattccagagtcgcaaagaggcctttatgaagaaaacccggggacggggggtactttgacgcacccgagaggatcggaggggccggtctcctctgcgctctgctcgcccaggatgaagatgactttgactgataaccatggtagacatatcgacacctataactgcgaacgttcacttcacggatggaccgagatcgcgagtaaatggctatccggtccactgatcgacgtgctttgcagtaccttgctaggaacacggagagccccgttgtccaagcgtaagcgaggtccagaacgggcggcgtgtatagcattcgagacttgaaaaatcagttataggaagtcaaccggagaacagcaccttcgggatacagtgagcttagggccccaattgagatacacgcaggcggacgactgggacccataggaggcacttaacgttgccccacacggtgaaattacaaaaaaaagcccatagaaagcaaccacgcggcgaatttcaacgaggacttaagggagaaaacgtcacacaggggcacccagagtctgggaccgacaccggcgacgacattacgacaaaaagaaatcaggattagaggatcggtagacgaattagaaaacg

SEQ ID NO: 517627 - DNA, 161 bp, Homo sapiens
ctggtaggggcggtggaccagcgcatcaggagcgggatgcaccgagttctaaagacctttcgcccttggcccttcttgtccggcctccaggggcacagatctccacccagtgtgtaccaccccttcccaacaaatccctcagcgagattctagcagagggg

SEQ ID NO: 517628 - DNA, 1111 bp, Homo sapiens
  misc_feature (61)..(61): n is a, c, g, or t
  misc_feature (63)..(63): n is a, c, g, or t
  misc_feature (310)..(310): n is a, c, g, or t
  misc_feature (375)..(375): n is a, c, g, or t
  misc_feature (380)..(380): n is a, c, g, or t
  misc_feature (384)..(384): n is a, c, g, or t
  misc_feature (411)..(411): n is a, c, g, or t
  misc_feature (438)..(438): n is a, c, g, or t
ggccttcgcctcctgacaggaaacggtttaacgggggacacgagccctgggaggccgggcngngctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgagggagcctgacgacgagcgggagctcgacgccgacgacgaaccggggcgacccgggcacatcaacatgccatggacaatattaccaaggcagaaccaanttctacgatacccaagtcatcaaacaagaaaacgagtcaggctacgagaggagaccacttggaantggangcangcagcaggcctatcgtccagaaatganagacagagatgaagcaaggagcacccnaccagcttcctcccgccctgaagcttctcaactcaagccagacagggcagcaattccagagtcgcaaagaggcctttatgaagaaaacccggggacggggggtactttgacgcacccgagaggatcggaggggccggtctcctctgcgctctgctcgcccaggatgaagatgactttgactgataaccatggtagacatatcgacacctataactgcgaacgttcacttcacggatggaccgagatcgcgagtaaatggctatccggtccactgatcgacgtgctttgcagtaccttgctaggaacacggagagccccgttgtccaagcgtaagcgaggtccagaacgggcggcgtgtatagcattcgagacttgaaaaatcagttataggaagtcaaccggagaacagcaccttcgggatacagtgagcttagggccccaattgagatacacgcaggcggacgactgggacccataggaggcacttaacgttgccccacacggtgaaattacaaaaaaaagcccatagaaagcaaccacgcggcgaatttcaacgaggacttaagggagaaaacgtcacacaggggcacccagagtctgggaccgacaccggcgacgacattacgacaaaaagaaatcaggattagaggatcggtagacgaattagaaaacg

SEQ ID NO: 517629 - DNA, 106 bp, Homo sapiens
cggggagtatcgctgagcctcacttattacactttcatgatctaaaacttcaatatcacgggtggtagaagtacctgatggaaaggtactaacaggaggagaaggt

SEQ ID NO: 517630 - DNA, 686 bp, Homo sapiens
  misc_feature (61)..(61): n is a, c, g, or t
  misc_feature (63)..(63): n is a, c, g, or t
  misc_feature (310)..(310): n is a, c, g, or t
ggccttcgcctcctgacaggaaacggtttaacgggggacacgagccctgggaggccgggcngngctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgagggagcctgacgacgagcgggagctcgacgccgacgacgaaccggggcgacccgggcacatcaactgatggagtgcctgatgttacatgccatgccacncctacaaccatgggatggttacatgccatgggctacagcagccccactcgcctccacctccaccaccaccgtgcctacgaactatgggagctactggcggttacaacaccggccccctataccccaccgccaccccccaccgcacagaacctaaccctcagacccagctacaaccacgacactcagcacccctgcccagcacagagaaccagacaaacagacccggccccgcacgcaccgcacataccaccggcaactacgaaccacgaggacacacacctaggagacacaaacgaaagcaccacaagataaccaagaagccaccgccgaccccaaaggaaccacagagagcccaagcaacacacacgacacagca

SEQ ID NO: 517631 - DNA, 402 bp, Homo sapiens
  misc_feature (2)..(2): n is a, c, g, or t
anatgcatccccaacacttctgagagagttatgtttttattatccagtttttaaggataaaacatagtataaatggaatggtgcatgtaaaagcatttgtattattatatcacgaggcccaatatcatagaatacataaatgctagagccacttgtgatttttggtatttacaaaggctgataggcaggtggatttcagcatccctgccaacaaggtgggatctgaggctgccagggtgggaaccactcgtcaaggagaacattccctgtgtctaccagcaaagatccaggccaactgctggctgaagagagagcaaaaagaaacaggctatgaagggcttctgctcttacaaccctataaggagtatatattttacactggaaaatctgatccttagagca

SEQ ID NO: 517632 - DNA, 294 bp, Homo sapiens
tctgagaatcgacgcaccacttgaatgcggtagtagttaggataatataaatgttaacttacgaatggttattttagggttgcactgtacaactgctattattcatcctatgtgggtcattcacgagtatgctaagattttgcgtagctcggtttggttaaatccacctcaactgccctctatgatgtactaacacttgagagagtgaggagaaggcttacgttaagctgagggagagatttggtatatcattgatatgggggctacattcagtcatgctgagaagaaccaggc

SEQ ID NO: 517633 - DNA, 775 bp, Homo sapiens
  misc_feature (551)..(551): n is a, c, g, or t
  misc_feature (765)..(766): n is a, c, g, or t
  misc_feature (775)..(775): n is a, c, g, or t
gggaccacttaattgttaaattcggtgtccgatagggactacagaaaaggttttcctcatgataaaccatttgcaggctctgaattaaaaatctcatgtaaggaatgtttcataataaaaaaaggatcttgccctataccttatgcataatgaattaactaataataccttttgtgggcggtttcggcgataatacttttgaatccagacaagttatttatgagcacctaattgagccctccttggcctattcccccttttggggatgatttttaaattgaggggccaacctttccaaacctggtgattggtaaaacccctggtttgaccatttttatagctttgaatgtgctccccctttcctcaaattgccttaataaaaagaacccctgacccatagaccttcccatcttttgacactcctaaatagccttttgaaaattgtaacctttttttttcccttaaattgccttaaaacttttcctaattaagattgttttttaacccaacagccgctacctggaaaatccctttttaattaaaaaaaatanccctcgttaaggttgggccgttttaccatttggaacaagaagcccttttttagaaccgggtctccacctactagggcaaaaaacctttattagggggatggccactacctggaccctttcttaaaaaattttttgggggaaaggggcctaaacactaaattggctccctaaggacccccttttttaaggtggaggggaaaacgggccccccggnngcgtggccn

SEQ ID NO: 517634 - DNA, 99 bp, Homo sapiens
agcgcgtccaggtgggaggttagtgttggcccggggcgtcccgctcctcaagcgatgtgggcagccccgagccatgctctcgccgtcccgagtcgttta

SEQ ID NO: 517635 - DNA, 282 bp, Homo sapiens
tctagacggatcccttaacggtaatttttgtattttacgtagaaataggtttcaccatgttggccaaaccggtctcctgacttcaagtgatctgcctgcctgggcttcccaaagtgctgggattacaggtgtgattcatcattcctggccagttcccagactttataggtggggaaggtgagctttagaaaggagaaatcctgtgtcttaatttgaattctcctgagaacaaggacttgggtgcaggtagtttattttggagagtgatcctaggaagtgggc

SEQ ID NO: 517636 - DNA, 151 bp, Homo sapiens
gagatcactcttcactatggaacaaggaggcacataagctagcttcagtatatggacacttagactaaatggcccccaaaatgcccatgacttaagcaatcttactgccttactgcgcttactgcaaaatagcagcacagcagatgaggtg

SEQ ID NO: 517637 - DNA, 132 bp, Homo sapiens
ggccactagaagtatcctccacgaccgaaggttgtcattcccaccgaaaccacctccaacgacaccaacaaagtttccagaaccacttaagagatcttaggctggatgcaagccactagccatctcttgctt

SEQ ID NO: 517638 - DNA, 384 bp, Homo sapiens
ttcggcagacacagcacagcacacatgaggggccctctcctttcaccatatgctgaatggcagtgcacagtttgcgtgatgcgaatgagcctcgatgttactgtgggggttctagaacccagtgacctcagttctggatcatgggaaagggatcagtatgccgtaacgtgtgtaaggttccagatctataagccaggacctataacctagtggtttcacagtgggcatagcagtttggaataagccaggttaggggtgggcgaagacagccagctctgtgctctgcatgcggattccctggagggagatctcagatttagaaaggaagagtaagatctggtccagacaggaccagaaagaccggaaggcatctggactgagact

SEQ ID NO: 517639 - DNA, 852 bp, Homo sapiens
gcacgatgagctcaagtcggcgctgggtatgacctgtcagactctacatgctctcctgacggaacgagtttagcaagttgaatatgctatgaaggctgtggagaaatagtagtacagctatgggaatcagatgcaaagatggtgtgtcgtttggggtagaaaaattagatcctttctagactttatgaatgcaatggtgcctactaaggactttttagtgttgatcggcatgttggaatggcacgtagaaaggtttgttggcagatgcatcagttctttagcagacagtaggcaagagaagaagcttccaagctttgagatctaacttgggctacaagattccactaaaacatcttgcagagcacgagtggccatgtatgtgcgatgcatatacatctctacagtgctggtaagaccttttggcttgcagttgtctattgtataagggtcttacgagtggtgaatgacggttgcgcaactctacatgatttgaccctatcacggtgttatcatacgggttattgcggtgcttgttggcatcgggaaaagccaggcaagcttgcaaagacggaaatagagaagcttcagatgaaaagagatgagctgccgtgatatcgtataagagaagttgcatgaaaatgaataatacatatgtaacagtgatgagagttatggataacgccttgggaaagtagaactcagctgggtggatgaattcacctgactggaagacttgaaattgttccgagaagatgtagcggagaagaaggcgaggaatatgctaaggaagtctctgaaggaagaaggatggaatcagatggtgaataatttgttaacattgattcagggtta

SEQ ID NO: 517640 - DNA, 112 bp, Homo sapiens
tcttcatcatacctaccttcctttttccttcctttccttccttccttctttccttcctttccttccttccttccttctttccttttcttcgtggtaggtatgatgaaggacg

SEQ ID NO: 517641 - DNA, 339 bp, Homo sapiens
taaaaatacaaaaaaaacaaaaaaattaaccaggtgagtagctgggattgcagggcgcgccaccacacccagctaattttgtatttttggtagagacgggatttctccgtgttggtcaggctggtctcgaactcccgaccacagttgattcgcctgcctgggcctctcagggtcctggaattacaggcttgagccactgtacccggcaacattctgtcttaaaaaaaaaaaacacgggccgggctcagtcgtcacgcctgtcatcccggcactttgggaggccgaggcaggcgaatcacgagacagatcacctgggcaagagagggagactccatctca

SEQ ID NO: 517642 - DNA, 1029 bp, Homo sapiens
  misc_feature (418)..(418): n is a, c, g, or t
  misc_feature (435)..(435): n is a, c, g, or t
  misc_feature (437)..(437): n is a, c, g, or t
  misc_feature (501)..(501): n is a, c, g, or t
  misc_feature (515)..(515): n is a, c, g, or t
  misc_feature (534)..(534): n is a, c, g, or t
  misc_feature (556)..(556): n is a, c, g, or t
  misc_feature (689)..(689): n is a, c, g, or t
cagaggctgaaatctagaacttcatcccgggcaatgaggttctcacagaaggtgcagttttataactaactacgtccacttatatatattcacactctacatatatatatatatatatatatatatatatatatatatatatacacaaatgcacagtccccctcccactccgttacctaactgtacgtcttttcatgtttataaactatacagaaaactgtatttgctgaactaaggattgtattggtgatttctagcaaaaacaaagtgatagaatttttgtctagaatcccaaactggcaacgatagtctccaagggacctggccttgccaagggcctggggcaaggtgtcggcgggacggtgaggaagggggaggcagcaagagtcactttgggggaccaatattcttagatatntagagcatcaccttgtntntatatgcaacacaagcctgtctgccaccctggagcgccctgtcacccctgctgtcgtagctgtnggcttcagggtganaagtgagaagcagcttatngtatatgagggagccaggcccngagggtgagcgagatggcagaaggggcaaggaaggggctccgggatctggaaaccagcaggccaggcagcatccacagtgttagtccaaagggtcggaccgtgtccgtcagcctagcgtttggtcagtgacgngctggacgggccaaggagactccgggcttgagcccaggcctcccgcacggctcagctgctgaatttttccttgacggcctgttggtgtgtgacccagcaaagggccctgtgtgggacagcaggagggaggcgtcgggggccttagcacaaggggaacaattgaagggcatctcatgaaccatctccacgcacttgctggcattaacggaaccacctggccctcccagcgaaccagggcactgcctcaggcgcgcacggcacacgacccggacaggccgccaccccacgggcaaaacccccgaccgggacagacaaccgcaccgcaaacgcggcctcaccc

SEQ ID NO: 517643 - DNA, 106 bp, Homo sapiens
gacttcgctattcatcggcacctcgctattcatcggcactgggtggtgatccactggatcaggatctgctccagtggatcaccacccaggtgccgatgaatagcga

SEQ ID NO: 517644 - DNA, 898 bp, Homo sapiens
  misc_feature (9)..(9): n is a, c, g, or t
  misc_feature (23)..(23): n is a, c, g, or t
  misc_feature (28)..(28): n is a, c, g, or t
  misc_feature (36)..(36): n is a, c, g, or t
  misc_feature (83)..(87): n is a, c, g, or t
  misc_feature (89)..(89): n is a, c, g, or t
  misc_feature (91)..(91): n is a, c, g, or t
  misc_feature (93)..(93): n is a, c, g, or t
  misc_feature (99)..(99): n is a, c, g, or t
  misc_feature (172)..(172): n is a, c, g, or t
  misc_feature (183)..(185): n is a, c, g, or t
  misc_feature (193)..(193): n is a, c, g, or t
  misc_feature (198)..(198): n is a, c, g, or t
  misc_feature (215)..(215): n is a, c, g, or t
  misc_feature (218)..(218): n is a, c, g, or t
  misc_feature (228)..(228): n is a, c, g, or t
  misc_feature (230)..(230): n is a, c, g, or t
  misc_feature (234)..(234): n is a, c, g, or t
  misc_feature (236)..(236): n is a, c, g, or t
  misc_feature (241)..(241): n is a, c, g, or t
  misc_feature (273)..(273): n is a, c, g, or t
  misc_feature (279)..(279): n is a, c, g, or t
  misc_feature (299)..(299): n is a, c, g, or t
  misc_feature (315)..(315): n is a, c, g, or t
  misc_feature (343)..(343): n is a, c, g, or t
  misc_feature (348)..(348): n is a, c, g, or t
  misc_feature (379)..(379): n is a, c, g, or t
  misc_feature (384)..(384): n is a, c, g, or t
  misc_feature (387)..(387): n is a, c, g, or t
  misc_feature (393)..(393): n is a, c, g, or t
  misc_feature (442)..(442): n is a, c, g, or t
  misc_feature (450)..(450): n is a, c, g, or t
  misc_feature (519)..(519): n is a, c, g, or t
  misc_feature (670)..(670): n is a, c, g, or t
  misc_feature (673)..(674): n is a, c, g, or t
  misc_feature (679)..(679): n is a, c, g, or t
  misc_feature (681)..(682): n is a, c, g, or t
  misc_feature (685)..(685): n is a, c, g, or t
  misc_feature (687)..(689): n is a, c, g, or t
  misc_feature (693)..(693): n is a, c, g, or t
  misc_feature (695)..(695): n is a, c, g, or t
  misc_feature (717)..(717): n is a, c, g, or t
  misc_feature (732)..(732): n is a, c, g, or t
  misc_feature (736)..(736): n is a, c, g, or t
  misc_feature (743)..(743): n is a, c, g, or t
  misc_feature (751)..(751): n is a, c, g, or t
  misc_feature (755)..(756): n is a, c, g, or t
  misc_feature (888)..(888): n is a, c, g, or t
gagggggcnacctagctgactcngcggnccaggganacccccgcccccccccggtgtgaggcggccacacagggccgggtggnnnnncnancngacgcngcggcggaggaggctgtgaggagtgtgtggaacaggacccgggacagaggaaccatggctccagcagaacctnagcaccttatnnnctgttgcngcaanacctcatcggggcgganatngccggacgananttcnanaaaancttgggaggtgcctcgaagtgcctctataaangatatnaaaaaggcctaaaggaaacnagccctgcagcttcancccgaccggaaccctgatgatccacaancccangagaaattccaggatctgggtgctgcttaanaggtnctntcaganagtgagaaacggaaacaaaacgaaacttaaggggaagaaggattaaaanagggtcancagagctcccatggagacattttttcacacttctttggggattttggtttcatatttggaggaaccccncgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtnggnnagagntnnggntnnnccancngggccctgggcgcttccaaatnacccaggaggtggtntgcnacgaatncctaatgncaannagtgaatgaagaacgaacgctggaagtagaaatagagcctggggtgagagacggcatggagtaccctttattggagaagggagctcacgtggatggggagcttgagattacggttcgaatcaaagtgtcaanaccaatattt

SEQ ID NO: 517645 - DNA, 293 bp, Homo sapiens
tctaattcgacctctctttcccctatgtgaacccgttcttacctataaaacacgatctaagtaccttaaaagattcacaggtcctcaaaaccaaaattcgtggccgttctcgagggaaacctttaaagtcacaccggtttactaatagttcgtaacgtcgtagagacggtcggagggtgggaatctttccaccgtctcactctcaaatttatgggaacctttacacaaagtagagtcattataaaggtgacccataggtactgtatgtcataccagacggtcccgacgtccgt

SEQ ID NO: 517646 - DNA, 308 bp, Homo sapiens
tgaatttaattgacacgaattttgtatataataaatgtcagtgatgacgaatggctttctagcaatatgtagatttttggcaatatagtgtggcttaaaaaaaaaagtttggtcacgcctgtaatcccagcactttaggaggcaaggcaggcagatcatgaggtcaggagatggagaccatcctggctaacacagtgaaaccccgtctctactaaaaatacaaaaaattagccgggcatgggtggcgggggcctgtagtcccagctactcaggaggctgaggcaggggcatggtgagacagcatatta

SEQ ID NO: 517647 - DNA, 472 bp, Homo sapiens
gcgtcgcccacgcgtccgcatctccaggtgtgagctcatctctttccccaccacaggtggccccacccgatctcagctctgcctttcccgcctctctgctgggttgcataagccagcgattcccaaccccggctgtacctggaagctaccccaggagcttctggagaatgtgccgtgtgagccatccccctgcactgagccctggtgggtcagcggtgggggcgcccaggcgtgggggtctatttaaagctcccaggtgctgtgcggccaagattaagaggcactgctccaaactgtcctggcaactctgactgtacccggcactccccacgcccaagctcccttctgcccctgggcaggttggcatccagtgtcggggagaaccctggaggcgaacgccagccttatagagccccactgttgggaggcctgcaggttggacaaggcgaggtctgagtcaccttggttggga

SEQ ID NO: 517648 - DNA, 741 bp, Homo sapiens
ctagatcgcgagcggcgcccttttttattttttttgggtctggtttggctttaggccctactggtgcctcgggggggggatggattttggtatagtcaactcttaaaatcattttaaactagaagagaaatatttccccgagaatcacaaattaacatcgctccagtgcagggtggggttgccgggctccgagtgggacaccgaagaggaaaagccggtgctgtgtcctagaaagagtattacagatggtcacacttcttttatagtgttttattgtgccgcgacaactattacaggcgagttaggacgtgctcgtggtgaggacgtatgaggaggactcctgtgaggggtgtgtgcgcgataggtggctaaagtgggtggatggggggtatgggtggaatagttgtggcgggataaactgtggttatattttcctgtggtgttttataatatatatatattctgtggcgcagtgtgggtgtggcaaaggtggtggtggtgagacagtggatatgtgttgtgtgataagtgggtggggaataatccggaaatgtcgggaattggatccctgggagcgacgtggcgggacgggacaacaggggcaaagagggcacggacaccacgcgcgacgagggcgcatacggagcggccagagatggcgacaacgcgacgctgggggggaagaacgggacacacggacagagggcgatgagcgggggcggccatggtgggtaactcaaa

SEQ ID NO: 517649 - DNA, 140 bp, Homo sapiens
atgccccctaaaacacatgattctccctaaaatgtccaatgtgggacttgtgccatatgaggccttcggttaacgaacggcgatgcttcactccactgaagagggcgagacacacactcgtctaaaggcacctgaaatat

SEQ ID NO: 517650 - DNA, 275 bp, Homo sapiens
cacatcttggcctgtctccatcaagtggattttagcctgggaggcagtgcagtctggattggggtcagggaatgactctgggcttgaatcctaaaggatctccagtagaaaatcacatctatacaaataatggcccctgaaaatatgttgatattattgggcctttgaatgccttcagtgtggtctattattttatgagcagcatttgccacaactcgttctacccccgtgaggtccaaacttttcattgtgcatacaaagccacttatagccga

SEQ ID NO: 517651 - DNA, 940 bp, Homo sapiens
gtcggtggatctgccattctgaggatgatgtacctcttctcacagctccactaggcagtgcccctgtagagaccgtgtgggggctcgaccccacatttcccttccacactgtgctagctgaggttctccatgagggccctgcccgtgcagaaaccttttgcctgggcatccaggcatttccatacatgttctgaaatctaggcggaggttcccaagcctcaattgttgacttctgtgcaccctgaggctcaacaccacatggaagttgccaaggcttggggcttccactctctgaagccacagcccaagctgtaccttggcccctttcagccatggttggttggggcgactgggacacagggtaccaagtctctcagctgcacacagcacgggaaccctggacctggcccacgaaatcactttttcttcctgggcctccgggcctgtgatgggaggggcttctctccatgtctctgacatggcctggagatattttcaccatggtcttgaggattaacattaggctccttgctacttatgcaaagttctgcagccagcttgaatttctcagaagaaaatgagtttttcttttctatcacatagtcaggctacacattttccaaacttttatgcttactttccttataaaacctgaatgcctttgacaggcacccaagtcacctcttgaatgctttgctgcttagaaatttctttcctccagatactctaaatcatctctctcaagttccaagtcccacaatctgtagggcacgggcaaaatgctggcagtctcttgctaaaacataacaagagtcacctttactccagctcccaagttcctcatctccatatgagacaggctcagcctggaccttattgtccatattcctaatcagcatttgggcaaagccttcaacatgttctctcagggaaattcgca

SEQ ID NO: 517652 - DNA, 248 bp, Homo sapiens
cggcctaatttttgtatttttagtagagacggggtttcaccgtcttggtcaggctggtctcaaactcctgagttcataatccacccaccttggcctcccaaagtgctgggattacaggagtaacttttaaacaactagagaattgtaaatcactcctgaaaatattgggttactacctagtggagtgagcaagtatgaggaccatctccttcaatcatagagaaaattcaagatgggtttctgtgacc

SEQ ID NO: 517653 - DNA, 123 bp, Homo sapiens
ggttcccgctggattaatgtggtctccccagaattggctgtggcggcctgggcatagatgaggaagtgcgcccaccaatgaatagccccctgagcggggtcagccagtgatgggaagcaggtc

SEQ ID NO: 517654 - DNA, 239 bp, Homo sapiens
tagggcaagtccttcatcttattctgggtccttgtgttttctttctgaacctacaatttctccataggtcccatggttttcaaaaattctcattttccattttctgtccttttatattacctacttgaaaaccacagtcatctttcaaaacaaaaccatgtcttaattttaggattttattggggcttgttattcctaaatacaaatttacaataaataataacaattaagacatggaa

SEQ ID NO: 517655 - DNA, 273 bp, Homo sapiens
  misc_feature (82)..(82): n is a, c, g, or t
  misc_feature (111)..(111): n is a, c, g, or t
  misc_feature (120)..(120): n is a, c, g, or t
  misc_feature (145)..(145): n is a, c, g, or t
  misc_feature (150)..(150): n is a, c, g, or t
  misc_feature (154)..(154): n is a, c, g, or t
  misc_feature (158)..(158): n is a, c, g, or t
  misc_feature (176)..(176): n is a, c, g, or t
  misc_feature (182)..(182): n is a, c, g, or t
  misc_feature (261)..(263): n is a, c, g, or t
atggtgccatgtcatgttatagcattccctgctacagtgctttatacacagtgtgtgcggccagtgatcttttgatgacatnaagagttgtggttcatctggctagcaaantggctgganacaaaatcctgtgggttccacaacntcgtnttanacanacagagattttgcatganaattanggcatattaacaataatgctttacattatgaccttctttgtccaattcatctggcacattgctgccaggtaataaaatnnnctcatatcag

SEQ ID NO: 517656 - DNA, 313 bp, Homo sapiens
gcatgtattattttgataaaaatttaaaacaacccgtcttcctaaatatccttacaagagggagtgaaggtggggaatggtggttcatgcctgtaatccctgcactttgggaggttgaggcagggttcaagaccagtctgggcaacatgtcgaaaccccatccctacaaaagattagccaggcacgtgcctatagtcccagctactcaggaggctaaagtgtgaggatcacctgagcccaggaagtaaaggctgcagtgagctgtgatcatgctactgcactacagcctgggcaacagagtgagatgctgtca

SEQ ID NO: 517657 - DNA, 310 bp, Homo sapiens
ctctacaggatccccgacggatctgatcgcacttttttgtgtctgttttaggccggtaaaatcaaggcgaccccagaaaatggctcctcccccaaaggaggtagaagaagacagtgaagataagaaatgtcagactataggaggattatgcagcggagaagaggtctcagtgccgagttgtcttatactatcaaatggaggatgggaggagttggtcttgactatctgaaacttctggcaggtctcgggttatattcataacgtgtactgttgtaaaggttgagtgtttcccaaactttttattgacctg

SEQ ID NO: 517658 - DNA, 1060 bp, Homo sapiens
atgaatattctctacgatgttgtacatgaaggccctcaaccgtcgtggtgaaccacgagacagcgctgtgaagtaggcttcggagatgaccaggatcatgaacttgctatggcacactagagtccccgtcatcccgacgaacttgctgaccactatccgtcagtgtagtgatcgtgtgatgcacatgcagtgcccgaatctaagtcggatggactgtatgtgcccagtacttcgttttcctcattagtcgctggctcgacagtgatatgcgaccgttagccttgtgagctagtccctcacgcaatgcgtctgacaagaaagaagtccttgaaaaacacaaaaataggaggcctcagtggagtcactagtggtggcagtttggctatgagaatgcatgccggggaacttaggatgatcactgggagggaccccattcgtgtgatcttgtcaaactatggggatagagtatgagaaggatgggctttgagaatggctgtattgtgtgcgtatgcatgccacaacaggatagtatttcacggtaagtgctgatgataaatgcttagtagaaaggaatgctgactttgagaatgatgcaacgtgaaaaaagccaagactaacaaagtctgaatactggataagtgatctagtccattgaatacatatggtgggatgaggtaggagtggcaggacggtgcgggacgtccagagtgagtccgtgacactgattggtgtggcacgtgcatgctaaccactgtctgtggcaggacgacgaggtgtggcatactcccgtgatgcatgtcaatggtaaattaactagatgacatgttgggtagatggaagatattgcgtaatggtatgacatgttgtcgcagagaggcgaagggtttccctagggaggcgtgatagcaagatgatgtctacaccactgtgcaggggacacgcaagtagtaaatgcaaagtttctgggcggagtgaacaaggtggagaagaaaataataatgggggacaaaaccgaagggtgtttgaaattgtccaaaataagggttagaaaaaagacgaa

SEQ ID NO: 517659 - DNA, 439 bp, Homo sapiens
aagcgacctgcgtctcccaactcctgggaacttctattctactctccatctgtgtgaatctgcccatactaggcgcttcatataagtagaaattgtacaatatatgtccttttgtgtctggtttatttcatcttgcatgtaatcaaggttaatcaatatagtagcatgtatcagaatttccattcccttttaaggctgaatacatcttcaattgtatatctataccacagctttaaatttttattaggttataagcatggatgtgatatggcacctaataacactaataaaggtacacatctccaagcaaacagcaatcagttcctatttcggatatattctcccacatatcatcttcacttagcttatttcccattttgcttaaaggataatttgtttctgtaataatggaaggtgacatgtcctcccctcacgggta

SEQ ID NO: 517660 - DNA, 424 bp, Homo sapiens
gtcagcccccttttttctccaccggtgcctaaaggggaagagggcaccctaccgtcgggggtttttccttcccctccccccaagcttttctctctcaggaggggccccagggggggtccacacagccgcctgggggccctctgtggggaagaggggggggccccccccctgcaccctcaaaggggggttagattgggggacgctgggggtgggttcttccagcggggggggcctctttttgggcccgaagggggaatttttttgggggaggtttaagacccattatcccccagggttttttggggccggttggtttattggcacctttaaacatttcccccccccattggaaggggggggttcgcccaccgggtacagttttttccccggttttgtgtccggcaagggaaaaaacaacacaaag

SEQ ID NO: 517661 - DNA, 340 bp, Homo sapiens
  misc_feature (4)..(4): n is a, c, g, or t
  misc_feature (65)..(65): n is a, c, g, or t
  misc_feature (329)..(329): n is a, c, g, or t
aaanaaaacgtgtatcatatgtagtctcttatcaagattgcactaatgtaatctttaagcttggnagtgcttagaactacacacaactttcggtaataattactattatgttgctctgcgctcactgtttttggccagataaatgccaggtccacccccattcagtagaattggacaggaccaatgtatttggtgggtctcacttaagatttccagcgccagggagcagcaagaaatgttacaaattttgtggcattaagcctgtctcccgaagtacaggtctctcgatcgaccttctgatgcaatctgtgtataacaccaaactagtnctaaggttctg

SEQ ID NO: 517662 - DNA, 116 bp, Homo sapiens
caggagtatcaatcacctgagctcagccatagtctaatagcaaacaaccgaaaccaataattcaagcactgacttattacaatttactgcatctctatttgacccaccacaaggca

SEQ ID NO: 517663 - DNA, 1167 bp, Homo sapiens
gggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaaaatatacaaaacacaaacaatattaagctggggtgtgtgggtggggtggcagcgcctgtaaccctttaagctatatgcaggaggttgagaagagggagagaatgtccgtgtagaaccaccaggggaggcgacaagaggggtcaccaggtgagacgccggaaagactcgggagcacaccgggaaccttcatagacctgggggacaaacagggatgtcagagagaatcacagtcgtcgagaaaacagacaaagccgaaacaaagaagacaagacaagcccacatataataccaaaaagagcattagggagaactctaggaacgggggcacgacacacctcctgctacgggcgaaactctacgaggcggggaacaacagctcctactgcaaagcgtcggtggggcaacaaacggggggaagtctgtaacactgcacgaagaccagagtttacggcgttgaagagtgaaatagtaggagaaacccccacctgaggtgggtggggttaaccaaagccaacaacggacgaaccgagagagaacacaagagccggcacccgccgaaaatagaacagaggggggggaaaacccaaggaaagaagaacaggagaggaagaacaagccaacaaacaacggggaggcagaccgcagccagaccaaatgaaaccacaacaaggtggcggaccgagcagaacaaaagacgaacgtcgagacgcccatgaccggagcagagcaagaaagcccaccacacaccagacaggaagacacatacgcaggcggaccccacacgagaaaagagacgacgacgagagagacaagcaactacacaagcggggggggaggagacaactaatcagacggagagaggagaggtgagaacgagaaacgaaaacacgcgtggaacgatggagggagaaagacaccccgaga

SEQ ID NO: 517664 - DNA, 1035 bp, Homo sapiens
caacaaatgggtgttaatcgacgagaaaggcgctcgtacttagcggaagagattgactcccactctcagcgcgacgggttgttttatccaacgacagttggtgctgtggactgttactgatccgcgcttgttgtctggtcgtcccagcaaagctgcgtcgcctattgtgacttcaggaggcgagagtcgtgcgtgatgtcagaactacgcccccgtgcgtggcctatggacaactcctgtgtggcgtcgcggcctcccgcaccacaccatcggtgtgggcagttactctggaagaggcgcggcagacttgtattgagttggtcctgaaaggcgaagagtaggtattttcttctcccctcccgccagcaactgacgatcaccgctggcgagtacatcatgtatctgctatactatcccactatacatcatggctgccccactacttcctccccccgtccttcaacttctatattagtgatctttcgtgttcgccgtcccgcaccctcacgctaataatgtcattacgcgctctccttctctcacttagtcaataaagagctccatctctctcttcctaggtcggtctcgctccccacgcatcaaggagtactgctatatcatacgtaaacaataacagtccgctctcttcttcttctgacaatacaaacaatacaaaatatacaacaagtataacagtagtaagaagaataaacactccctactacttttcgtagtgtcatcattaatttattccacttcgttggctgtgtcattaccgctacagcacccggtcgtattcatactactactccccctcttttctactcagactagcctatttttttcctcgtctcgtaacatctctgtacaagcaccggcacccctccactctattcatatccacccccctctcactactagagaaacaacatataacaatcctttttttttttctagcaaatagaaaacaataaaacagaaaaaaccaaacaacataaaaaacaaataacaaacaaaaaacaaaaaacatcacaa

SEQ ID NO: 517665 - DNA, 208 bp, Homo sapiens
tcacaactggaattcgggaattctgaagtgtagagctgaacagactgagacggactatgcgccgggacgcatcccctctattccaaattcatcctcattgcggactgagagttgaataagtgaatcgtcttttagaatccttcattcacagtggcacttccaaccggtactcatattgtgtataaatcaacgcccagggtttgaaaga

SEQ ID NO: 517666 - DNA, 912 bp, Homo sapiens
ggttgtctgggctcgtgcggcagccgggctcgagagtggacgttccactatggggtcgtccaataagcatcgcggagagaatgaggcgtgccggtgacgtacgtgcggcggcctggtaccttattggtgcacatctgagcatgccgtctgcagggcaccgggaacacgaaaaacacaacgacacctggagtaggcggcagtgtgcggtatcggtggcgaagcgactggatagctggatgccggtgaacgtggggggcgaagcggcggggagtcggggcaggacagcggggccagaaggctgagagtccctgggaagtcagccatggcaacatgcgtctgcgagccgtgggtcagtgcgatagccctccgaggtgtgccgcgtcgaagccggggagaaggcgcggattgaacgggcttacggagggcccggtatgccctaggtcttcccaggaacatttacatgtcgagggccgaatgccttcccttcaattttccaagcattcgggaaggaaggaacgtaagcaagtatttccagagcgcaaccaaggtatgaggcgctttgacaacccccgtttgcgtacgggtttagattgccacatcaaaggaaacgtgaggggctgggggccaccccaaaggagacagggaatgccccccgtcgatgaaaagcgagggccttcgtagttacgtccagtttcataagcccctttatttggggccacttttggccggaacggacgcgcggcaaggcatgtgcaccgcctttggccgcgggaaagaaaaggtattgggggcagacgtattgcccatacagggggaaggcaacagcctggccttagtgctagaaaagcggagccaccaagcgtttggtgtgggaccggtagtaagagagtgacccccattagcgtaacgccg

SEQ ID NO: 517667 - DNA, 314 bp, Homo sapiens
tgactcctcactctacatatgtagttctagtttaccagtaaaatcctacctcctttctccagcctatatgtcaggcatctgccctgtacaatccctacattcccacaaaagtagttgctttctgctgtcctccataagtgatctctacttaataagtatttttttcaaaaagcttactataccttttattttttaaaaaaaacctagaagctactagtcattaatgaaccacggaattggtcccaccaggacaccaatccctactttttcccagctaccctctttggtgtggtcacaggtggcaaaaaaatatt

SEQ ID NO: 517668 - DNA, 224 bp, Homo sapiens
atgacagtgctatttgcattagaaccaggaacagcaagacatactcgccaaggttctcagtgcacgactcgaccgggaagtgcgcctgcaagttgcggaggatgccaccctgattggtggtgtcatcattcgcgccggcgacctggcttatctgatggctcgattcgcgggcaaactcggcgaatctgtgccgatgtattgaagatcattgatgtttgatacgg

SEQ ID NO: 517669 - DNA, 178 bp, Homo sapiens
cccgcggccccccttggacgccagagtttttgcctcaaaactgtctttcctgggcccagcagcatgagggtcccgaggccattgtttccgaagggtatgtgccaggtttgagtggcgagggtgatgctggctgcttttttgaacaaataaaggagcatgccgatttttaaaaaaaaaa

SEQ ID NO: 517670 - DNA, 178 bp, Homo sapiens
tattctaatctctgctatttagctcagttcagttatctgatctgcttggacccctactcattgcattaaaatcaggaaaggaccccaggaagaaagcacaggtcaaagtcggtcttaccttatttgtttctcttctttcatgagttaaatgtttgtgggtcctactttcaggtggagg

SEQ ID NO: 517671 - DNA, 101 bp, Homo sapiens
ttggggggggctttagggaaagctgatggagattacgtatagttacctcctgctccccaactgaccagctgcccttgttatctagggttatgtgattattt

SEQ ID NO: 517672 - DNA, 510 bp, Homo sapiens
  misc_feature (377)..(377): n is a, c, g, or t
  misc_feature (424)..(424): n is a, c, g, or t
  misc_feature (481)..(481): n is a, c, g, or t
atgacgaatgtaccaagtcagcgagcgcagctgtgcgttcatcatttatccgccggcggagttcaccgacaagaccttcaaggagcacctgggggaggagtttttattcgtgcatgaaggccaggttgaggtggatttcatgaacgagcgcgtgctgttggcgcgcggtgatgcgctgcatttcaacgcgcagaaaccccaccggattcgctcggtgggagaggtgcaggcgcagttgctggtggtggtgcacagcgctgaggagtgagactgagcccgacttgaaatgcattcaatgtgggagctggcttgcctgcgatagcggtttatcggtgcccaatctgtcgctgacccaccgccatcgcaggcaagccagntccacattttgctcagcgttctacagggacggacaatgccggattgnccagtgggtgcgtacgcgcggtaaagaacctcagtcacattagagccctcgaacagntccacattcgtaatcaagtcgactgatta

SEQ ID NO: 517673 - DNA, 641 bp, Homo sapiens
ttgactttcgtcccgcgggctcctcccagggtaaaggtcttgaagtctatgcccgtccagacacgacccgtggccgccaccgcgcccggttcagcgcatatgttgctatggggggatcacatggccccgtcggtctgggtgttaagtgctccaagaaggtgaccaccgccatccgtggggccatcatcctgggccagctttccattgtccccgtgggcaaagggtattgggggaacaagattggccagccccccactgtcccttgcaaggtggcaggcccctcgggctctgtgctgggacccctcatccctgcacccaggggccctggcattgtctccgcccctgtgcctaagaagctgctcatgatggctgggatcgatgactgctacccctcagcccgggggtgccctgcccccctgggcaactttgccaaggccccctttgatgccctttttaagacctgcagggacctggccccccgcctttggaaggagggctgttttccccaagtctccctatcaggagttccctggcccccttgtcaagaccccccccagagtttccgtgcagcggactcaggctccagctgtgggtcccacatagggtttttataccagaaaaataaagtgaattaagggtga

SEQ ID NO: 517674 - DNA, 142 bp, Homo sapiens
ctacaggatccccgcgcaggcagtcattatcgtgatagaataatcatgtaagtagtgccctggcggttctcggtgggccgcgtgcccgtcaacagcacttaagcaggctgggaggtgggggatgatactgttctctgcagat

SEQ ID NO: 517675 - DNA, 100 bp, Homo sapiens
tgtgtgaaagtgcaacaagctatacacttagaagtgtatagcttacaacattctaaaaaagaaaaaataaaaaagatacgaatgagacctatgaaatcca

SEQ ID NO: 517676 - DNA, 470 bp, Homo sapiens
cattggaaagcttcatgcccactcacctatggagttgtggaaaaaagtgtatgaaaagctctttccaccaaagagtattaacacgctgaaagatatcaaggacactgcgagagatcctcagtatgctgaaaatgaagtcgatgagatgagaattcagaaggatctggaactggaacagtacaaaagaagttcttccaagtcttggaaacaaatcgagcttgattcttgaacctatttcaattactgtatatttatttcttcttttccaacatacaaataagattataccgtgaattaactattgtggcacatcatgcgacagaaacgttaaactgcacaacttcttaacggacaagccgcatctcctggactagtgcatctccccgtctatcctgaagcttctcaacagcaaaacttattgtacacccccgcgtaactttttttacactacaacaatcctctactacctc

SEQ ID NO: 517677 - DNA, 1242 bp, Homo sapiens
cgcggtggctcacgcctgtaatcccaggactttgggaggccgaggcgggcggatcgacgaggtcaggagatcgagaccgatctccgggtaacagacggtgtaaagcccgtctctacgtacaaaagtagcagaaagagattatgccggggcgtacgctggcgggggcgcctgtagtgcccaggctacttgggacggctgatggctaggacgaagtgtggcgtgagactccggggagagcgtgagtcttgacttgtgatgaccgaagatgcgccatcacaacttggcaactgccatgtccttggcggcgaacatgaagcgatggactaccagtactgctaaacaaagataagacaagacaggacgaaagcgggctatgtatcccgggtagagccacaagggacatttcgcgagaggaaacgcggcgggtcactctagcggtggacataagtttgatcgcatccacataggaaggggttatccctgcgcaggaatgggccaccccggcaagggagtcataggcctacgtggataccctctaaaagttggcacccgcaaggggcgtagaactcatctctttttacaacagggaaaacacccaagggggaaagaagagtcaagtctgggaaagcccgtctgtgatgtttgaccaaaggtttccacaaacgtgttgcggaccgatcatataagacgacacaccccacgatgggacccaaacgacttggcaaagcacagctgatagtgacgaaaagagcacgtcccgcgcatggatttagcccgattattaacctggtgtctggtgtgcagaaaggaagtggtgaagacaaagggaaaagtctcgccaacgagatagtaaagggagagggtgttatcaacgaagatggggggcgacagtggttgttgagggggaagaaaaaatggtgcacaccgtctggtttctcatccgatttaagtgggtgaagatgcccggcctaggatacctaggattgatttgtagttgacgacaacggcaaaagagaagtgtcgccgtgtaagtggtcgaaggagattttggaagaccaaaaggcaaacgactaaaaagtaaatggtaaggaaaggtaaagggcggagttattaagttaaactgtgccaagggttgtgtaaatcaaacgaagatggtgtactattggtatagtagaggatcgagcaaaaaagagggagtgtggtgcaaccaaaggaaagatgtggactgcgaggaagaagtaa

SEQ ID NO: 517678 - DNA, 890 bp, Homo sapiens
ctccttggtgccttgttgcccctctgtcccggttgtgggtgcgtcctccgactttctgtcccatgggcgggcacccccgtggtggctcgggccttttatgggacgtttggaccacgtctctagttccgcccgttctgggtggaagggttttcggccccttgggggacttggaaccttctgtttgagatctctgaagaagagtagaggaagaaagtgtgttgaagcccccagatgagagcgcttgattaccccctctccaagacccagtgcctgatcaactcctggaggcttttcatccagtgcctgctggaatggagacccctggactccttgagctgaggaagaagaagattgaggaggcgatggacggaagtgagacacctcagctcttctactgtgttgcccagagaagagaaccagcccctgttggaggggccccttgatgggatccaaccccaccatttatgacatagtcccccggttatgagcccggaagggccccggctcctgagctgcaggtgtggaaatggcgctggcgcctgaagagttgtgagctggatcctatggccctgaccccgaagtatgaggagcatgtgcgggagcacgcaggctccagtagagaaggaggacttcagtgacactggtggctgagcacgctgcccaacagaagccaaaaaaacggaaagctcagcccccggaccaccctgggggcagcacagaaatataaggagttcaagattttaggtcccctcaccctagccctcttttttggccctacgtctggaagcctgggcttcacaccagaaccccctctcccgcagttccccaggacttgtcatttcatgttcttattttagacctgttttgtaaataaagctgtttccccagga

SEQ ID NO: 517679 - DNA, 134 bp, Homo sapiens
agaggatccccgtcggtatgcaaatgtcatctgaaagcattactccttgccaccaagaaaaatgtcacaagacattaaatccattcctttagtttactttcatttattgtatagtaacacaatttacatgcatg

SEQ ID NO: 517680 - DNA, 157 bp, Homo sapiens
  misc_feature (54)..(54): n is a, c, g, or t
  misc_feature (155)..(155): n is a, c, g, or t
aagggcacaggcagcgcgtgtcgtcgtcaggcggcgggtagacgatgacgcggngctcagcctcttcaacccgtgaccggctgcgaatagttccccggtcggacacagcccatccggtccgggtgggccaccgggagtgctgtaggccggatcanaa

SEQ ID NO: 517681 - DNA, 421 bp, Homo sapiens
  misc_feature (291)..(291): n is a, c, g, or t
aacgatggtcctcagctgcataccagccccagttcctgggctgtcttgggcgaagtgaacactgtgtgagaagatggcccagtattgatgctaaaaagtttgcagagacccaatcctaacgaggacacaccacgtgccagagaagggttcacggcgaagagaagcagaagccccaggctgagcggaaggaggcgaaaagggcggttgcccctgctcctgaggaggagatggctgactgtgagcaggcgctggctgctgagcccaaggccaaggaccccttcgctcacctgnccaagagtacctttgtgtgggatgaatttacgcgcaagtactccaatgaggacacagctctctgtggcactggcaatatatctgggagcactttgatacggacggctggtccctgtggtactcagagtat

SEQ ID NO: 517682 - DNA, 137 bp, Homo sapiens
gagggagccgagagtattcgcgatggagtgctggtctccatggacagatgctgggctgcagcctggagcagagcctgtcctagtgtggcatgagcccctaccaccacaaatccctggggcatctagaagattcctga

SEQ ID NO: 517683 - DNA, 955 bp, Homo sapiens
gtctcgctcggggctccctgccgccatcttgttgccgcgtccctgagaaaatgcccggtgaggccacagaatcgtccctgctacagagcatggaggttgccgcatgccgccctagggctagataccggggttcctagtcatacatgcagatcttgactacgttgatgacatgagatacctagaagcttgcggaacaagggttccaaccctcagtggcatttgcacacacaaaaacgcctgagcgtgggcaggactgcggcttgaacttctactgaacgaaccgatgtcaggtaagagcgaaaaacaagagttcgggacgtgaaagtgaccgtgcccgggcctgcgctattgtcataaacttggtcggtcttgggggccacgtgtttaccggagacggtctaacgtagagagttgcgcttatcgcgagagagagcttttaagggaatttcccttccttgtggtacatttcgagcacagaaggcaggatttgtgcttaaaaggggattaccgctgcgtttcaggcacttactttactagtaggatatcagggggaacgccacacgatcgcaaagatttttattcgcccaagtcaagcacgacacctacgtgagcccgtcgtggatgaaggttcaaaacgtcccaagggtgcaatgctagttcttcgacacacgtgtccatgagaaacaacacgggttgtccaagcgtgtacatagagggacgagtagtagccagtgaagacgcgtcgactgaacacagggggtgtcaaacgtttaggggaccattcgaggtggaccatgttcccatagcatagagtggtgtctgagagcaaaaggcagaccggagcgctgaagatgaaccgtcatgcattatgttaggtgcgcctctgcggcttcctggttcccctttttgaacaactgtttcggtggcccacaggggttactgcgtgggctagaag

SEQ ID NO: 517684 - DNA, 217 bp, Homo sapiens
attaagccggtccaacctgtcatgaaagttgcagtgaagatgctaaaacccacggccagatccagtgaaaaacaagctctcatgtctgaactgaaggtaatgactcacctggggccacaatttgaacatgtaaacttgctgggagcctgcaccaagtcaggcccatttacatcatcacagggtattgcttctatgaaggtgggcaactatttgcata

SEQ ID NO: 517685 - DNA, 177 bp, Homo sapiens
aagctgtctggggctggagggggtaaggccggcaatgggcggcccgaacccccaggaggcatccagcggctgcgggacacggaagagatgtaaagcaagaaacaggagttcctaggagaagaaaatcgagcaggagctgacggccgccaagaagcacggcacctataaacaagcgcg

SEQ ID NO: 517686 - DNA, 273 bp, Homo sapiens
  misc_feature (150)..(150): n is a, c, g, or t
  misc_feature (183)..(183): n is a, c, g, or t
  misc_feature (235)..(235): n is a, c, g, or t
  misc_feature (259)..(259): n is a, c, g, or t
  misc_feature (266)..(266): n is a, c, g, or t
tctggaaaaggggatttcacagagaaagtttttcagtcgagcaggaaggctggtgccaggaggctttactgagaggaagcacttagatttaacaattatagacacaccattaggggagttaaacaatgtacacgcagtgacagtgttctnactccagatcacttggttgctacggctaccaanacatgtacagaaagacttcttcgggtagttccagcttgtggccatagccagnttaggacctatgagtgggacctangatctangatcggg

SEQ ID NO: 517687 - DNA, 194 bp, Homo sapiens
ctcacgctctctacttgtatggcagcaccactcccccaccctgacgtagagtagaagacacatgagaagccacgaagtgtggttgagctaccagacattccatgcagtcccgttgagaagccacgtgcgtgagggacagggctaaacggctaggcagtgaacagggctggactgtgtcccgacgtctgctcctc

SEQ ID NO: 517688 - DNA, 86 bp, Homo sapiens
tgcccatggactcaaggctggagcacgtggactttgagtgcctttttacctgcctcagtgtgcgccactcatccgaatcgtcgacg

SEQ ID NO: 517689 - DNA, 105 bp, Homo sapiens
agaagacactctgggactgtaatacttcgaggcgaacctgaaaagttaggtcaggcgttgactgaagtctatgccaaggccaatagcttcaccgtctcctctgtc

SEQ ID NO: 517690 - DNA, 174 bp, Homo sapiens
gggatggtcaactgaaggggcagaggggcccccgaatatccaggggcctggccagggccaagactgtggctctagagtccttgcctttggctctgccctccaccccttctcaccagctccaggtcccgaaaaacaaatgtgtccttgagctgaatttctgtgacctgttggtca

SEQ ID NO: 517691 - DNA, 336 bp, Homo sapiens
gagacaggatcttgcttataaacccaggctggagtgcagtggcgccgtcatagctcgctatagcctcaagctcctgggctcaagcaatctttctgccttagcctcttgagtagctgggactacaagcagacgccatcataccctgctaattttaaaattttattgtagatatgggggtctccctatgttccccaggctggtcttgaactcctgaccccaggtgatccgcccacctcggcctcccaaagtgctgggattacaggtgtgagccactgcgcctggctgtaatacactttttactttcctgtctctctccttcccttctgtcgtcttctc

SEQ ID NO: 517692 - DNA, 170 bp, Homo sapiens
tatgtatcccccatggacactgaggcactgctacaccataagaaaatagaggctgtgtcatgccaacagtggggatttgggacaatttttgagcccagcaggatgacctactatactcacaccatacagtctagctctccatctgaagggcacagcactgcctcaccagg

SEQ ID NO: 517693 - DNA, 140 bp, Homo sapiens
agtggtgttggtggtgatggccacggccacgtgtaggggttcagcaggggttcagcaggggtacgtagagcacatggccgcagcagccactgagcagggcattgagggcagccaggagaccagcagccagtaggcagcat

SEQ ID NO: 517694 - DNA, 366 bp, Homo sapiens
acttaccagagacatcacgacaatcgcagaatatggggaaattaaaaacattcatctcaacctctacaggcgaacaggtatatctgaaggggtatactctggttgaatatgaaacataacaaggcaagcccaggctagctactggaggtgactcaactggccaggtatttgagtgggacagcccactcagcgttgactgtgtgttttgttcaggggtccaccatcaaggcaagaggagaggctcccgaagacgcagcagaagtccagaccggagacgtcgctgacaggtcctctgttgtccaggtcttctcttcaagattccatttgaccatgcagccttcgactaatagtaccgactgtgaattt

SEQ ID NO: 517695 - DNA, 686 bp, Homo sapiens
  misc_feature (337)..(337): n is a, c, g, or t
gacccttttccggcggtgaggacctactcacacgagaacatgtctctcgcaaatgtatctccttcatccctctttcagaataaggcagcacattgaggatccccgagaacagacgccgtgggtgcaagatgcacctctagatatccctacgtatgcgactggaaatgtttgacaagttgccccaacggaagtgtctgatgacacaactcgaccatcggatgcttttgagccgatgcaacaacgacgattagtcttcgtgtgtcggctgctccactgtcctctgccaggcctacaggaggacaaagcaaggcttacagaaggatgttccttcagtggnggaatgcagcacctaagaagcactctgagtcaagatgagtgggaaaccagtctcaataaacacattttgcaaaaacaaagacaggcagaggaattaatacacacaaaaaaaaaattttgggccgcgggttggatacccccgagcggaagaagcgcgttacacagaaccgacccagtgtgtgtagtggcgcgcaggggggcccacaatgaggaatctattaaacaagcggggctccaacaggtgatccccaaaggaaaaaactttggggcccccaaccacacggggagtagagaattccccaccaaataaaaaagcccctgcggtcaaacacagagggtttcgacacaca

SEQ ID NO: 517696 - DNA, 501 bp, Homo sapiens
  misc_feature (66)..(66): n is a, c, g, or t
tcctaatatatggggatgtatcttctgaactatagcttccaatttcaatccccgtctttcccgtgngggcagtattttggcttagcaggctgtgagggtaacagcaggcagtttctactatctggacttggaaggtccttggaggaatctctcttagggatagacttgatatcctgactgtgagaaagatgggcataggaattgaatgctttatcagcgccttcttttgatgagtgaaggaggcgacctttatcttcagtgctactgttctttacatcttgtgactgtctcttactgggaatgggagagataaaaagaacgaacacgcctcctcatgattaaggggttttgagaagaatgatcctcctggcctggaagtctcagcataacactaccaggtttggatgactgtgtagcctcagctagtccatgtccatcagtctcatggggcggcccataccttttttgactggacattcctggaggaccgctgcttttggg

SEQ ID NO: 517697 - DNA, 649 bp, Homo sapiens
acaccatctttttttatttctttggccccctcttttgatcaaaaggggcgccctttagggaggagcgagaccaacaagataggggctgggtccatgaactcccgaggatgcaggacttgcatcaccccccttttgacccaaaaagggggtgtttgaaacccttttggcccccctacaaaaattttgtacccgagccgcgaaaacagccataacaccttttagtggggggccgggggacttcctcttgcccaggacgagctcaagaagaacagggggaaaattgagcggtttttccttcgggggtggagaacaaacatccccccccaacgtgtttggttgaggagaaaactccccccccaacgaaaggccttttgtttttcatagcaaacaagaagcccccccgttcatcaaagaaggggggctgtattcccccactgggggacttactgatgtgggtttatgccgccctcatgggggggggaggacaacaaacagattgtcttcttcacggggccctcccttaacatcattaaggagacaacgggggctcccccctttttctaggtggggtgagacccccacacaacaaaggagcttcttttagatgtggctttgctgcccctacttaacaaaagcggaccctcgcaca

SEQ ID NO: 517698 - DNA, 689 bp, Homo sapiens
tattaccatctagttctctacgtgccaccactgtgcagcaaatgtgcactcactcacgtgacctttggcaagagcaaacagcattgtttctggttgtgctacaactagttccagtgttccctcttacttagccaaaaaaaaaaaaaaaaaaaaaaaaaaaaaaaaaaaaacaaaaaaaaaaaagagagagggggggcggcgcgcgcccaaagaaatctctccccgcgagagggcgcgcccaaccgatgcgcgcgccccccgcggtttttgggaaacaacgggagggcgcccactatgagggcgaggccatatatatataaacgacgagggcgagcgggcgcgccgcgcagctattacaacacaggcgcgagaagagcgggagaaaaaaccgtggcgcgacagcagggagacctattgtgggggaaaggaggagaccccctctcactcaggcggggggggagagagaaaaatatgggcggaacacacacccacaccccgacgagagaattattatgaaccgcccctaccaagcggggaaacactctatacacaaatttacacagagcggcgtgtaccagcgggcgggtgttcacaccacacacgcccagtaattagtggcgtggacgggtctaagacaaatttttcgccacccacgcgggagattatagaatttaacagacaccattttt

SEQ ID NO: 517699 - DNA, 284 bp, Homo sapiens
cagatgtgcacaacatctgactaacgtttttaaattttttgtagagaccagatctcgctacgttgcccaggctcatcttgatccatgcccagctaattttctatttttagtagagatggggtttcaccatgttggtcaggctgatctcaaactcctgtcctcaggtgatctgcccacctcggcctcccaaagtcctgggattacgggtgtaagccaccgcgccggccaaattggtattttcaaagagcccgcctctcttcattcccccatgcgtggattgccag

SEQ ID NO: 517700 - DNA, 168 bp, Homo sapiens
gtccgtcttagggtatgcgagtagagtcagcatataagtagagtacggtatacgcaacgagcttgggaacccgaagagccggcccgagcgcctctacgaggtcgcaactacgacgggcggataggggaagacgctcggcggagtcggcaactcgacgggggctatgct

SEQ ID NO: 517701 - DNA, 282 bp, Homo sapiens
cggtgttatagagtgatcccccagaaaaagtcataggttatactccaagatacacgagacacggcagggttgggcagggcattcctggggtgcagcggtctctagcttgatccaggagacactgggcaggaggttgctgatggcatgattccaggcaggaggtgactcagaaggccgggttgtcaatgcccctctgatccccggtatattcttcaggcctgaagctgtagggagggggatggctctgtgggagttgagcccaggctggggttacagaatcac

SEQ ID NO: 517702 - DNA, 816 bp, Homo sapiens
gacaaaactatgactaggacgtcctcggttgtaaatcagcacagggctgtctctctgttagaaggtagtgggtagcctgctctctctgacggaggtgggggtagctgctctctaccgaggggtaggaatagccgctagtctactgaggggtagggggtgccgctctaaatatggctaccatatacatatatgagtattagggtatctggctgtttaggttctcttcatctctattactgcactacagcattataagcctatcacaaagaggaaagcctctggccgtcacacgtaggacgcatgcaaggtcactcgtggtgaggctagacatgctcacacatatacaacagtagagagggaaaatcctaagacagagggaactaccaagagatagagtgtactaggagcgctatcagtatacagctatataaatggccaggacgggccacacgtggctaggcaggcctcgtaaccaagtaggcggcacgtcctatgggcagtctactaatagtctagcagctcaagggctaggcactactttctatacaatataaaaaatagggtagttcatatctaatatatctacaatctagtcaaacgtagatattaactcggtactatctagtatgaccattctggggatgataccatgttctagcgctagtgtacaatgtagagatcggctgcgtactccttgatgtttatgccgtaggcttggggattgtacacgggaccagctacacgtaatgcattgcctgtacacatgtaataaaaagcctcttactttaggggaaaaaaaaaacaacggggccccgg

SEQ ID NO: 517703 - DNA, 170 bp, Homo sapiens
actctgtggctatgtttcccacgcacggactgaaacacagaaaaatcaatcttcttattctcattcttgatcctttcttctctaacgagctatgggcgaggtaattatgtgccctttattgtcacaggccctaacggacattttggtgaagtcctcacttcatcatcgat

SEQ ID NO: 517704 - DNA, 310 bp, Homo sapiens
atgtgctagtaaataagacaatacagtaattacagatgtaataactgtatgtctttatttacacttcatgtacaatctctgcactttgtttgggtatagttgtatgtttcttctactaatttattgatcgagatgaggttttgccatgttgctcaagctggtatctaattcctgagctcaagcagtctgcccacctcgtgcctcccaaagcgtagcattacaggcgtcagccactatgcctagttcaccctcatgtttaaatattgcatttctctttacccttgatagaaactgaagagggaggccgcag

SEQ ID NO: 517705 - DNA, 155 bp, Homo sapiens
atccaactgtcagttttcagtcctcatctttttctttttatttggagacagagtctcgttctgtcacccaggcttgacatgcagtgttgtgatctcgggctgactgcaacctcccacctcctgagttcaagcaatttcccttcttcagcctcccg

SEQ ID NO: 517706 - DNA, 1440 bp, Homo sapiens
  misc_feature (766)..(766): n is a, c, g, or t
gctgccttacatcttgactgtgcatagccattgggcaacacatcggtcagggctggagagacagcaagtatgagcgcccggcctagatgcaagccttgctatcgtacgctcgccatacacactatgacgtgatgttgtacggagcgttcgcttgacgtactttgagatatccagagtcttacatcggttagtcattgcgtagacatccagctagacaccgagaggtcagaatcgagccgtgagcgcaaagagctccagatccgtcctctccgtctcatatggattctctaggcagcgtggtacgcagtacgataacctatcacttcgacctaacaatatccgatggattgtgatagcagtagatagtgatcgctatacgtatcctactggagctctacgtgtcactctcacatagcatggtcattcgtggcgccgggtgattaggctggtggccacttgaggcgcaagcgtgcgcccccgtagcgatgccgccatggcggagtcctccgaggatctggtaacactttcgagtacactaaaaattaagttctaaattaacgtccacatgatggccctgtttgtacactacgtagcccgccacgtatgaatgtaagccttcgttggcacgtgggcccgcgatgtttcttaagccgtatgtaactcgcgacgactaccttacgccgaacgctaaacgacaagacaatgtgcccacggcgtaatgggcgtgacgcctgtcgggatcttaggcgccatcgagaggcgaatntacccccggcagcatttatctaattgcccgacgatttcccttgttccccctaggttaggtgtccgtagttctgaggtacatttccattagtagcccgggatcttccgatgcgctctgcatggtcagaggcgcaatcgggagtccgagtacaatgaatgcgcctaaggaggagcgcggacgacccagtgtccaatacgagtgcgctccgtcgttacccttatgtttcctgtctggtccaatgcgcgccaagagacgttaacggtcccatatggcgaaaacacgtgttaaccttgtggtgcggacaattgcccgattcggcaatttggcgttttagcccaatggtagtttcgaagtcgcctatgtcgaatcctattattggggcatctatggaagaacaccatcaatttggtacaattaacgaatgatagggatcacgttgggcgatccattaccgtaggaccctacgtgtccgtcaggtagcccacttgtggctgtgtatgaagccgaaaagaatagaaaaagcgggtgagaccctctatgtccagggtagactactctcgagataagaggacctatctttacactaatgctgcacgaaggtagccccataacaccccatcaggcgtgcgagtgaacgtggacgcacccattgtcgagagggcacaatcatcatc

SEQ ID NO: 517707 - DNA, 139 bp, Homo sapiens
tcatgtagcggagcaggagaatcacttgcccgggaggtggaggttgcagtgggccaagatcagcccactgcactgcagcctggcgacagaaaaaaaaagaaaccttgacatctttactacaacttagcaacacaacata

SEQ ID NO: 517708 - DNA, 355 bp, Homo sapiens
gttgaattatggagggaaattcttttttgtcctaagcgtttctatatttaaagtaatattttaggagaatatgttagacttaggatgatatttttagttacttgaagaagaaatagaaggtgcttgttttaatatagtctttattttttatttagatataggttgagtattcttaatttgaacagttaaaacccccaaatgccccaaaatccaaaccttcctgaatgctatgacaccatgagtggaaaattccacacctaacaaacacatttgcttttttatggttcaatgtacacaaactgttttatatagaaaatgatttcaaatatcataaaattaccttcaggctatgtgc

SEQ ID NO: 517709 - DNA, 247 bp, Homo sapiens
  misc_feature (228)..(228): n is a, c, g, or t
caaaagatctgacagatgagatagtttagtaggttgaagaaacacaagatcgattttaatgtaaaaagcagttccactcaagtgaacattacatatataaagtacttgtaccactttacatgtaccctactatgagttggcatttaacaaactgttctagagaaacagagatagtgttgcaagaattggagggtagtgtcaaacggtgggataaacggttagctcccnatagattctcatgctaagc

SEQ ID NO: 517710 - DNA, 882 bp, Homo sapiens
ttataatgtcagggtacggctagaaaatatgatttctacagcacatcagggccaaatggagggcgttgttgggtgcatctctttgggcctcagtgaacactttcactaaattctttacatgcaatcatgcactgcatagcaacatttctgtcaatgatgcactgcatattcaacaggggcctcgtcagatgatgataccgtgtttttgctgtaactttcctatgcttagatacacaaatccttaccattgtgtgacagttgcctgcaggattcagagcagtgacctgctgtacaggtttatagcccagaagccatagactgtgccacgtggcccgggtgtgtagtgggctgtaccatctaggggtgtgaaatcacctaaggacaccttccttagaacctatcccagtcaagggatgcgaggctgagtaacggggccccttgggagttcagcactcagcatgtttcagtgagtgactgaaataatgaacgttctgatcgggccctctctggctggcacctgtgaaccactcgctttgtacccattatttcttgttcccacagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccaga

SEQ ID NO: 517711 - DNA, 1060 bp, Homo sapiens
ttataatgtcagggtacggctagaaaatatgatttctacagcacatcagggccaaatggagggcgttgttgggtgcatctctttgggcctcagtgaacactttcactaaattctttacatgcaatcatgcactgcatagcaacatttctgtcaatgatgcactgcatattcaacaggggcctcgtcagatgatgataccgtgtttttgctgtaactttcctatgcttagatacacaaatccttaccattgtgtgacagttgcctgcaggattcagagcagtgacctgctgtacaggtttatagcccagaagccatagactgtgccacgtggcccgggtgtgtagtgggctgtaccatctaggggtgtgaaatcacctaaggacaccttccttagaacctatcccagtcaagggatgcgaggctgagtaacggggccccttgggagttcagcactcagcatgtttcagtgagtgactgaaataatgaacgttctgatcgggccctctctggctggcacctgtgaaccactcgctttgtacccattatttcttgttcccacagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacacctatgtcgcagtgttcggcctcagctatacggcaggtacatgaacctggtatttgggcttctacaacaattgtacttatagcacaaataaagtacaaagtgttagggaagaccaaagaccataggtagaaaacttggatacaacttccaaataaacactcttcaaaacatttaaa

SEQ ID NO: 517712 - DNA, 776 bp, Homo sapiens
ggcaatgcagtcagaagtataggtacagataatgtgtgtagagatagactggaaaagaccatcatgctttagactaaaagtgctttaggacttcttggatcagcatcctttgacattgactcctctaacttcagaggatcactgggaatcttcctgtagagcgtagtgtttttacagaagatcggtgaaggcgttacattatgaacgatgtcagtagtccaatgtatgaactcttcattgaagatgatggtcaaagaattatgctgtataagccatcgcaaaaattttgaagatagcagccctgtaaactctgtgaagcccataagcattaagatggcattcgtatcacatatcgctactttgagagagatatgtagaagattagtactctgcattattgtgcctattcaactgacagaagaactgagcaactgtgggaagaagacccaggaaggctgtacaggggacgaaacaggacggagattcttggaaactatagttcgaggccatgcagctgaagtatcatgggatgagatatattccatgaatataagtcagactcttagctcctgtacttctagaacctgatgcaaacacgttcaaggacgcgcacaaagtgtggagagatatgaatgcactgttaagtacaaatgagtgctgtgtataagtgctgttggattaggtgcttatgagctcttggacagtgtagaattttgatcaaggggttgagaaaccaggttctgccagaattacaaggtcattcacaaagaggtata

SEQ ID NO: 517713 - DNA, 181 bp, Homo sapiens
actctgtgcttagctctgactgtctgtctctctctttccttctctctgtctctctcatgcctgtctctctcactcggtcttctgtcttactctctctctctctcaaacttacagtgttcatagtcattgacctcagcagcaaatttgaccttgaattcccttacggctcgcaggactcacg

SEQ ID NO: 517714 - DNA, 784 bp, Homo sapiens
  misc_feature (107)..(107): n is a, c, g, or t
aaggagcctctgcagaaacggaaccagcgggaaccttgacctgagacttgcagcctccagaactgggagaaaatagatttctgttgtttcaagcccccgagcctgtngtattttgtcccagcagcctgagcaggctgaaatggtcccaagttcttgtcccacatccagaagaataaggttatgcagacaaccagagagtgagcagggcagaaaaaaacttctattgcatgatggaacagctcccagcgttgaggggacctgagagtgggcagccactacctgaagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacacctatgtcgcagtgttcggcctcagctatacggcaggtacatgaacctggtatttgggcttctacaacaattgtacttatagcacaaataaagtacaaagtgttagggaagaccaaagaccataggtagaaaacttggatacaacttccaaataaacactcttcaaaacatttaaa

SEQ ID NO: 517715 - DNA, 410 bp, Homo sapiens
ttttcaaattttttaggctttcaatttgccatttgccatttgggttgggcaattttttggaagggctattggttgggctctttttggtttttcgccaatttgggaaagggggttttttttcaaggggttttagttgggttacgccagggtttttccagtttcgagttttttaaacgcgggccatttaatttttattcggttcccttttgggggaatttggttccggggccccccttgggtttttttttttttttttttttttttttttttttttttttttttttttttttttttttttttttttttttttttttttttttttttttttttttttttttttttgttataggcaaggaggtatgattatttattagtttctacattttagactatggtgttgtgctcgtgcc

SEQ ID NO: 517716 - DNA, 867 bp, Homo sapiens
  misc_feature (107)..(107): n is a, c, g, or t
aaggagcctctgcagaaacggaaccagcgggaaccttgacctgagacttgcagcctccagaactgggagaaaatagatttctgttgtttcaagcccccgagcctgtngtattttgtcccagcagcctgagcaggctgaaatggtcccaagttcttgtcccacatccagaagaataaggttatgcagacaaccagagagtgagcagggcagaaaaaaacttctattgcatgatggaacagctcccagcgttgaggggacctgagagtgggcagccactacctgaagctcttggaacagaaccagacttctggccggggctcagtcagtgcttgcaagatgtttgttggcaccaggctgtgccaggagagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacacctatgtcgcagtgttcggcctcagctatacggcaggtacatgaacctggtatttgggcttctacaacaattgtacttatagcacaaataaagtacaaagtgttagggaagaccaaagaccataggtagaaaacttggatacaacttccaaataaacactcttcaaaacatttaaa

SEQ ID NO: 517717 - DNA, 822 bp, Homo sapiens
cgcggtggctcatgcctgcaatcccagcactttgggaggccgaggcgggcggatcacgaggttagtatatcaagaccatcctggccaacatggtgaaaccccgatctccattaaaaatacaaataaataaataaataaataaataaataaatagccgggcgtggtggcgggtgcctgtagtcccagccactcgggaggctgaggcaggagaatggcgtgaacccgggaggcggagcttgcagtgagccgagatcgcgccaatgcactctagcctgggcaacagagcgagacttcgtctcggaacaaaaaaaacatatataaatggcaataacatttcaatctttgtgagctatgataggctaatccctaccaagatatacacagatttatggcagtaacaggtgatagagtaaagacaatttcagcctaatctgggtcatactccttgcaaacgctataatctggtgcggacaggtaagtcatctatgtacattggcctggggctaagggtcctctgactacatggtcagatctctttgaggaactctagggagcacaatatgggtcaccagaaacgggttagggaagagcaaggcatgtctcagctactggatcttgaccattgacctagtaataagtgtccgactgcacagtatacaaggtggcaggaaggtctccaacttccctagcgtgacgtatggcatacgttctgtgagtgcacagccacgcgctggctccagcaacatggcataggttcaggcctttatacgggttgatcagacgcggatctcccagtagtaagcgcagcgttgggacgctgac

SEQ ID NO: 517718 - DNA, 1031 bp, Homo sapiens
gggtgcgagggcttctctgtctatgctgccaagagcaaggcaccccgcaacccgcatggccaagtggtgcggtgggtgaggggcccctcaacgagttcgcctatctcgccctgatggcctgtgcacctggcctgtgtgagccaggatggctgcctgcgcagtcttccacttctgactccatgctcctgctgtgggctcatgaacgagctactcttggtgggccttgctgtgtgtgtgctggagccctgacggccgcatacgtggttgacgtggtggcgaagatgacctggtcaccgtgtggtcccttcaacgagggccagctgtggtggctcgatggccatgtggcacacaagtcctgggtcaacgctgtggccttttgacccctacaccacaatggtacagaggagggccggcgaccacgcagcccgcgtgctgcatgggcgagccggagccgcgcgaaacgaggacggccacgaggaacccacgcacgctgcaggcgcaaccagcgcctcaggaacgcacgacgccaaccgcatcataaaacaactgcgaacaaccattgacttcgcctaccacactacaacctcacacccgccttcacgcaggtccagcgaccctgagccaaccgaacacacgaacggcacacctagcacatgacagggcgacattccacctcgcacacaacgctcgcaactaaccccccagcacacacggcccaccaatgacaaaaccaaacacgcgaacccattccacaggcgcaaaagcagagggaaacacacaagaccaagcgcggcaggcccaggcaaaacacacgaaagagaacgcacgaagaacatggagacaacaagaagtccaagacaaagacaagacacaacaagcaacacaaaaaaaaacaccggaaacccaacgggacgcagacaacggaaacataacaagaaataaatcataaccaccacgaacacacacaccaaacaaaaacaaaaaacagaaaacagaaagacagaaaaagaacaactagacaaaaaaaaata

SEQ ID NO: 517719 - DNA, 753 bp, Homo sapiens
tctgcctaggaatctgtcttctgctactatcagagggaccacgtttcgcttatccagtcgtcattcacggaccctgcattgtctctgcctcttgggctttgtgaagaatgctgctgtgaacaggggagtgcccctgcctgtttgggtccctgctttccatttctttgggagctcttggaacagaaccagacttctggccggggctcagtcagtgcttgcaagatgtttgttggcaccaggctgtgccaggagagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacacctatgtcgcagtgttcggcctcagctatacggcaggtacatgaacctggtatttgggcttctacaacaattgtacttatagcacaaataaagtacaaagtgttagggaagaccaaagaccataggtagaaaacttggatacaacttccaaataaacactcttcaaaacatttaaa

SEQ ID NO: 517720 - DNA, 411 bp, Homo sapiens
aatggctgtgacgtcagtgtctgtcatgcccttagttcttttggtccagagaagcagctggccagtctgttacagctggcaacagactggctggcaagttgtggggctaggtcagaaagtgtctgcacttgtaatcgcggtgcctgctgtccacaggtggactctgcgggagccaggccctggatcccaagtcctttgtgtccggagcctttcctggcctgtgccttgagggtagcacatctttccagcctcccagggctttgcagcctgcagatgccacctgtccctgagagaagttagcgtccctggccctggccggtggtctctcatccttgtgtgctgctctgctaagagatgtccaaggcggagccggggcaagatccttccagactcatctgtcagagccccaag

SEQ ID NO: 517721 - DNA, 670 bp, Homo sapiens
tctgcctaggaatctgtcttctgctactatcagagggaccacgtttcgcttatccagtcgtcattcacggaccctgcattgtctctgcctcttgggctttgtgaagaatgctgctgtgaacaggggagtgcccctgcctgtttgggtccctgctttccatttctttgggagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacacctatgtcgcagtgttcggcctcagctatacggcaggtacatgaacctggtatttgggcttctacaacaattgtacttatagcacaaataaagtacaaagtgttagggaagaccaaagaccataggtagaaaacttggatacaacttccaaataaacactcttcaaaacatttaaa

SEQ ID NO: 517722 - DNA, 162 bp, Homo sapiens
cctgagcatgatgtctggagatgggtggtttgtatgtcaactgtcatttatttacgttgttagatattgggagtagtgtgattgaagtgagtaattaggcgtaagtagagtaaaggtaaaggaggtgatggtggctatgatggtgggatgatgaggctattg

SEQ ID NO: 517723 - DNA, 606 bp, Homo sapiens
  misc_feature (107)..(107): n is a, c, g, or t
aaggagcctctgcagaaacggaaccagcgggaaccttgacctgagacttgcagcctccagaactgggagaaaatagatttctgttgtttcaagcccccgagcctgtngtattttgtcccagcagcctgagcaggctgaaatggtcccaagttcttgtcccacatccagaagaataaggttatgcagacaaccagagagtgagcagggcagaaaaaaacttctattgcatgatggaacagctcccagcgttgaggggacctgagagtgggcagccactacctgaagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccaga

SEQ ID NO: 517724 - DNA, 1273 bp, Homo sapiens
  misc_feature (228)..(228): n is a, c, g, or t
tctgcctaggaatctgtcttctgctactatcagagggaccacgtttcgcttatccagtcgtcattcacggaccctgcattgtctctgcctcttgggctttgtgaagaatgctgctgtgaacaggggagtgcccctgcctgtttgggtccctgctttccatttctttgggaggtacgtggagaggagattgcggggtcatgtggtcattctgtttggctcttggaggancaggcatcctgttttccacagcagctctgccatcaaatggcactttcttagtgacacctcccgtatctctccccataaatgtatctctccccataaacattgcaactcctggctcaccttccttctcctgtaacttgtcactgtggaactctcaggtgtgcctgagccgactcgtagcagcccaggagggccagcagtgaggccccttccccactccgtggtcagtgccttcacacagggagtttggaggtggctgtagtgggaggactcacaccgcagaaatcagccagtgctgcaggtcaggggccgccatcccccagagctgctgtgagacatcgaccagcacatcagtgggctgctttccgctggttttatttgcatgtattttggtctgtttccctacctagaaaataaactccctgtggcagaagttttatctctctgctcccttcttggttcccagctcttggaacagaaccagacttctggccggggctcagtcagtgcttgcaagatgtttgttggcaccaggctgtgccaggagagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccagacacctatgtcgcagtgttcggcctcagctatacggcaggtacatgaacctggtatttgggcttctacaacaattgtacttatagcacaaataaagtacaaagtgttagggaagaccaaagaccataggtagaaaacttggatacaacttccaaataaacactcttcaaaacatttaaa

SEQ ID NO: 517725 - DNA, 426 bp, Homo sapiens
gagagagtatagagagagagagagttagagagagagagagagagagagagagagagagagagagagagagagagagagagagagagagagagagagagagagagagagagagagagatagagcgctgaatggttagaacaggcgatggcttacttgctggcatggtctaaactgatgtccgaaactttaaatttttaaaaaggcttctccttagctgctttacctctctctatatcatgctttctgatgctatgtggtcttttttttagattttgtgcatttaatacttaaccttgatttatttcttaatcctttaaatattattcatctttccttataataaatagcctcttacgtaataatataacatcttgatatatcccattctcttatatagtattccattcttctacctatattacactt

SEQ ID NO: 517726 - DNA, 1095 bp, Homo sapiens
  misc_feature (228)..(228): n is a, c, g, or t
tctgcctaggaatctgtcttctgctactatcagagggaccacgtttcgcttatccagtcgtcattcacggaccctgcattgtctctgcctcttgggctttgtgaagaatgctgctgtgaacaggggagtgcccctgcctgtttgggtccctgctttccatttctttgggaggtacgtggagaggagattgcggggtcatgtggtcattctgtttggctcttggaggancaggcatcctgttttccacagcagctctgccatcaaatggcactttcttagtgacacctcccgtatctctccccataaatgtatctctccccataaacattgcaactcctggctcaccttccttctcctgtaacttgtcactgtggaactctcaggtgtgcctgagccgactcgtagcagcccaggagggccagcagtgaggccccttccccactccgtggtcagtgccttcacacagggagtttggaggtggctgtagtgggaggactcacaccgcagaaatcagccagtgctgcaggtcaggggccgccatcccccagagctgctgtgagacatcgaccagcacatcagtgggctgctttccgctggttttatttgcatgtattttggtctgtttccctacctagaaaataaactccctgtggcagaagttttatctctctgctcccttcttggttcccagctcttggaacagaaccagacttctggccggggctcagtcagtgcttgcaagatgtttgttggcaccaggctgtgccaggagagcatcattataaactgctgatctactgtttctttgtcaaacgggaggagataacatgagggtcatgagaaatgtttgcagacggagtgaatgccttgaaagtgctgcgaccaggtgctgacacccggaggtctggctgctcaaagtgttagctgacacggaagacacacggactttccctccattccccaaaactccccttccctgactcgtcagctgcataaaaaccctctccttatctctttgtcaaggggatttgagaaatcttgctgtcttgtcttcttgctttggccaaatggaataaacctttctctgtctccaga

SEQ ID NO: 517727 - DNA, 187 bp, Homo sapiens
cgcgaggcagtctcaaactgctgggcttaagtgatcgttcccctttggcctcccgaagtgctggaattataggtgtgaaccaccatgtctggccttgtagtttatctctaagttcaaattaatgttggtgcttttcctccttttttcttagcagatggtttgctatggtgagactgcctcgccaaat

SEQ ID NO: 517728 - DNA, 402 bp, Homo sapiens
ctcggccctagctgtgtcggggttggaagcgtccgtacgggtagatgtagctgggaagctaggccagtctctccttttcacatttttcttctgctttatattcactggcagctgattagatggtgccctccagattaagggtgggtctgccttccccagcccactgcctcaaacgttaatctcttttgacaacaccctcacagacacacccaggatcaatactttgtatccttcaatccaatcaagttgacactcagtatgaaccatcacaagtccacccctcgccaacttgaacccatacacatctgagatcatacataatcttcaaataaagacaataataaggtcataattatgcctaacatattacaactattctttgtacaaccccgaacacggata

SEQ ID NO: 517729 - DNA, 319 bp, Homo sapiens
  misc_feature (16)..(16): n is a, c, g, or t
  misc_feature (18)..(18): n is a, c, g, or t
  misc_feature (26)..(26): n is a, c, g, or t
  misc_feature (43)..(43): n is a, c, g, or t
taagagccttcaatgntntgtacaanaaaccccacgggtttanttacatactagcatataacgctagacagctgtgatcgacagaagtgatctgtcttcctctccgacagatgagctcacatcgctcacttctcacaactaccggccctgggctctgtccaggcgcccagctacggcgcccggcggtcagcagcgcggcagcgtctatgcaggcgctgggggctctggttccgattcggtcgtcacatcagcgtgtcggctgcacggatacgggtgagatgagtcaaagaagactccacgcccaccctcctccacccgt

SEQ ID NO: 517730 - DNA, 702 bp, Homo sapiens
  misc_feature (1)..(1): n is a, c, g, or t
ntaaagtcaaatgacgatgcctcggtgttcaggaggaggaagatggagcccagcaccgcgtacccgggcttgtggccctctttatggtatgcttgctgaccttgacttgtgtgcggtttgctgccagctggagcccgcaccttagtgctgctggacaacctcaatgtgcgtggagactcattcgctatttctatccgtgagcctgaagtgacctgtggctttgatgctcacattcaatgacctgctgatgaccccagctctgtctctcataaatgtatgtgtgtgaattcctctatgacaatctcatcattttctccccttctgtgttgacgattttggatgtgcaacatcaactgtggatgaccatcatgttgcctttatttgactgtgttggatgtgcatgttgttgctgtgtagcttgccaagctcctgacatatgtgttgaccctacttcgaggagcttgtgggcaaggtgaagttgctgtggctttggcgttttgcactggacggagaaaactgtcttgtcatttgaccatcagcaactatgacatcgtcaggacctttgggcccagcatactgcttcattctgttgagcttgaccacttggacaacctgcttgacatgtgcccacaccatctgttaggtgaaaatccatcttcttagaatccacatcctcttatcagaaggttggtatgggcatgg

SEQ ID NO: 517731 - DNA, 711 bp, Homo sapiens
gagctcggggctgcgcagggggaaggctcgcctagtcgggtccgcagtccgtgtcgatgcgacctgtctggacaccacgagagatgtccacccgttgtggggcaagatgaggccagagaagggctgtcctagaacgtttaaatgctggagagattgtgatatggagatggagggtttgtctttgcgctggagaagaggggctacgtgaaggcaggaccctggactcctgaagctgctgtggagtcgacccagaagcagattcgccagcttcatcgagagttacctcagagctggctcagaacgtcatgcagagcttcaccttactatgcgagtgaagacaagctggagacacaggggcaactatgtcttagacgaagatatctggcgcaggaagtcaatgaagcatgcttgcgacatcggcccgacaagtggctgatgacaggagatgcttgggtagcaggaggagtgagtcacgacacccttccataccttagctgcaagagtgaaactgacagtcacaaccagtcatttctgcaacagtcagaggtcttcatgaacgacggaacgtggacttcttgattcgcaggagtatattgaacacgttgaagaagctgtgtgggcagtttgacacctcgcatagcctccggtaaccctgtgggcagcacacatgtgcattcggcccagaacgcgacactcgccatggcgtgcccc

SEQ ID NO: 517732 - DNA, 964 bp, Homo sapiens
cacgcgtacggtaattcaatcttcgctgtgtgtggtagaagcagtagtcacttttgtaaagccagtctcttcatgcctaaaagacactaccagtcaccttgattcgcgacttttaatttatgattatacttagcctcctcctcctttttttttttttcccaagtggactggacttggctttttcccccgcaagtagaactaatgctagcttccagcgttgaaaagtaaaactccagtgtggagtgaatttggtgtctaattataaacctgtaaccaaaactcagacatctggtacgggtcttggcattgagatgggtccctgtaaaaccccctttaaaagcatatggcatttagatacagagctctttttggaaatgaaggctggagatgtgcattttcacggttgtaacgggttgtatcttataagcaaggagatgggggtttagagtgttggcgtgggtggtttcaattggccaggaactgtggcaggctgctagcacggcagtgagacgctctgggcgagccaaaggggtgcttccaggcctgatttatagagaccctgggttctccttctcctactcccttgtcttctgccatcttgtagcttgtagatttctgccagaggggttgggtcagagcagtggaggggagacttcgccatgtgctctgctctggtcctgggcggggtggcaaaggagatgtgcacctatgagcaagggggcttgaaatacctgaattgaaggaatgctaggtacctgggatacactacggggaaaggacgggcgactaactacggcggactaccggggcgcggggcaaagccatgtgacaccagcgggccgacaccgagctaagggcgaggacaagatggtacagagctaccagtaagggaccagagaagacacaacaacgtcgtgagcgggaacgccccagagtaaaacaccagggacagagaagcgacatg

SEQ ID NO: 517733 - DNA, 147 bp, Homo sapiens
ggagtcaagctgcagtgacctgattgtgccctgtactgcagcctgcgtacacagatcgagactctgtctctaaactaacaaaacaaacataaaaaaatagattaaataggacataacataaagcacccccacttctgtaacctccaa

SEQ ID NO: 517734 - DNA, 470 bp, Homo sapiens
  misc_feature (6)..(6): n is a, c, g, or t
  misc_feature (103)..(103): n is a, c, g, or t
ctatcnaaacctatgaaaaggctgactaaactcccataacatttcactgtcatcaaaagtcccctgataagttaattgcagaaaggggagcacccctcatagntttattcctatgaaatacactattagtattttaaggttgatactgtaactatattctcaaaacagcttctggagcattttgttcctaatagccataaataagacagcacttgtcatacttatcatacatacattctggttccctgggaaaataactttcatatgctcaaaattctttcttcttacctgcctgttggaaaaccagaatttccgttcatggtatgctgataagtagagagcatacatcataccactagtaaccgtgcaagacagccaatgaaaatctttgcaaagcgttgaaataatacatctgaaaaagtatattaaaagtaatcaaaaggtaatatgtacccttgatatgatgtaat

SEQ ID NO: 517735 - DNA, 306 bp, Homo sapiens
  misc_feature (7)..(7): n is a, c, g, or t
catcggngtcctatgctctcttatcggttcccatcccagctgttgatcttatgcaagacgctgcacgaccccgcgcccgccctgcggcacgttacttgaggcagccggagatactctgaggtactcggagcccgacgcctgagggtgagaagaacgcgctggacttcctaaccggccggacctgtgatcgcttgtgggagaccgaaccggcgctcctgccccccgggtgacgcgcagcttccagccgcccagacacatggccccagggcaagcaccccatcaggctaccccgcgccgggacgcccc

SEQ ID NO: 517736 - DNA, 417 bp, Homo sapiens
accgtactataaagaggtgtccgtgcccaatctcaaactatactctaatgctacagtaaccaaaacagcatactactggtacaaacacagacatataaaccaatggaacagaatagagaacccagaaataatgccccataccattctgttttcatgctgctgattaagacatatcaaagattgggtaatatataaaggaaaaaggtttattggacttacagttccacatggctgggaaggccccacaatcatggcggaaggtgaaaggcacatctcacatggcagcagacaagagagcagcttctgcagggaaactcccctttttaaaaccatcattatctcgtgagactcattcactgtcacgacaacatcacaggaaagacccattcccataattcaatcacttcctagcaggtt

SEQ ID NO: 517737 - DNA, 341 bp, Homo sapiens
  misc_feature (67)..(67): n is a, c, g, or t
  misc_feature (90)..(90): n is a, c, g, or t
cccccccccttttcccccaaaaccaaaggcccactggtcccctttttgggtttgtgggtccctgggntttggacaagcactgggggaggngcccccaaagccacccactttttattccaaaaccagtttccctgccccccgacgctggtgatttggggtgtggcctccccggatttatgcaggacagtttgcctgacgccagccctgcctttgggccctggggggtgggctgtaaaaaagttgttggggaaggagggagcttaggagggggcatttccccacttttcccttttgggccccgccgaagctccctgcctttaataaactggcccaggggggga

SEQ ID NO: 517738 - DNA, 106 bp, Homo sapiens
gggttacacagagctcccatctccatgaagaccgcacagcgcgtgtacggccagcccagtttgacctaaagcgatatgagactactagaaagaaacgacacccttc

SEQ ID NO: 517739 - DNA, 223 bp, Homo sapiens
taaaatttcccctttggggaaaacccggttcccccttggggttcctgaaaaaaccgccttttcttttttagccccccctttgtttaaaaacagaggaatccccgccccttttaaaagggggtagggggtttttttttaaaaagcccccgtttttggaaaggaaaatttttggggcccccggttgttccttttttggcccaaaaaaaaaccccttttaaaagga

SEQ ID NO: 517740 - DNA, 199 bp, Homo sapiens
atctcaacattcttgaaccacttaatactctcttgacacactagtagaacagaatcctgaagatatgggagactatacctagatgttgctgcagctttactggatgtaggtgaatataattctgcacttcccttcctcagtgctctatgtatgctctgaaagatacaaccttgcaagaagtttggcttatctgaggggt

SEQ ID NO: 517741 - DNA, 187 bp, Homo sapiens
cggtagacgtctcttcatctatacacgtccagccagcaatcctgcccccaaagcaaatacatatgcaatatggtttaaaacagaatgttgtactctctgattagctcttgttttaacgcaagtaattgctgatgattgaccacatacgctttgagattttcctgcggtcttggccaattcagacacc

SEQ ID NO: 517742 - DNA, 198 bp, Homo sapiens
gctcactctagagtatccccgacggaccgcggatctgcagtcgtgagcctgtgcagacctggttgttcacttcatacacaaagcgcggccaattgctggcggggtgaatttctaggcccaatggactggccagctgcacctgctcgagcacgggcttgtgttccagcagctccttgcggcagcagaccaggatgttgt

SEQ ID NO: 517743 - DNA, 987 bp, Homo sapiens
ctctggatgtttgtgtcgccccctgtctggggcgtcagggttagagtgtcggtgtgcgtgtggggtgccccgccgctcttgtgccacaaaccgttgtttattgggggaagtgcccgtgtcccgttcctcttcctatccgtcccgtgttccctccagacccgtttttttggggagatgagactgtttaaagcctttacctggttggggccaagccccgagttcttaatccctggacgtttgggtgcaccactattccaatggtggtatttttagtgaaacccaaggcttagccccataggtttaaggacccagcctgtaatgggaaaagccgtgtgggaaaacaatatatcccacgccccaaacttgggagcaccttggaggcccaccccttcgcatgcacgttcttctttaaatgttttgaatggaataatatgttttgttaaaggggaaaatatatttcaccgagtgagtccacgggagaatgtaatattataccctgtgaagtcccacgaataaaagtaccccgctaatgccacttttacaaaagaccacgacatttatatgacaaattaatatatgagggtgctctatgaaatggggctcataaggggagaagtgtctcgaaaattatgagtgcccacaaaggaatggagaagaatataatattatgactatccaccccacccgtaaaatgtttgcccaagtggctcgtgttttataaatgggaattatttaccacgcttgattctctattgaaatgtcacgaggccctcataactcttcacggctttgcacatctttgtatatgggagagaaatatgaccatcctaggtaattataaccctagaccccaagcccctacgctttgatgccatttattttttaaataggccctgtttttcacgcttcatctgcacgttttatgtgaagattgataaatcagtttttacttgttttattaattaaacctaatttggatatccttga

SEQ ID NO: 517744 - DNA, 123 bp, Homo sapiens
gatgtcacccattgcctgctggaagccccagtgtataggagatcctccgtgatgtgattctcgatgatagtcttgcacacccttgaaatttgaccactctctctgacagaaaactataacaga

SEQ ID NO: 517745 - DNA, 235 bp, Homo sapiens
  misc_feature (18)..(18): n is a, c, g, or t
ctcgaggatcccgtgcanccgtactttctcgggaaagaaagagaaaaatcccctgcgaggtaaaaggacaagacatcagtatctcaggtctcacagctggggtcaggacaaggacccatagctgaagggaagagggcctcccagcaaatcaggaacatggagcaaaatggagttggctggactgcttcatagccgagctggagaaagtacggttgcacgagaaagtacggttgca

SEQ ID NO: 517746 - DNA, 1763 bp, Homo sapiens
  misc_feature (93)..(93): n is a, c, g, or t
  misc_feature (937)..(937): n is a, c, g, or t
  misc_feature (1092)..(1092): n is a, c, g, or t
  misc_feature (1100)..(1100): n is a, c, g, or t
gtgtcttccattcgtcgcttgtgctcctgtgtggtttgtccgccctcttgttgtttttgctcggaaattttttcctcgcacacacagagatgntgtcgcacacacacgtgtcttgtagtaatacagaggaggcgagcacttgttggtgttgtgacccccttccttcatcactcatgtgggtggttgtgcgttctccttccctcattgggtcccccctctcctttcttagattgtaatgtgggatagtttttcccttgctgcagttttgttcccccccccgccaatcaccgttgggccctcctagggtggcgtcactcaactcctgttgactggtcgtgctgcccaccgcaagattggttgcgtgccccccaccgaccagcggtgctcgtatttggagaagtttgggggcgacatgtgctgatagttgtgagtcgtacgactcgtgtgttgtcgctgccgcagccggccgcccagagcgcccggctgtttggttggggaaggggcccccccaccctacttggggtttttataaggacagttgtagatttctgcccccctcctgtgtggttttgcgcggttgaccccccgtgttgtcccccccgccaaagaggtggttgcaaagcctttttgttgggaaggacagtttgaagtgtttgtgcgaccccacttggaagttggtgcccgcgtgttgtgtgggagaccaccgccgaagttgggcgcgttctcaattgtacattgggggagtcctccccaacagggggggaaaaaagtttgcccacgttcgatttcgcacacacattccacaagacgacacacctcccccacatatgaaattgggcgaatattctctcaccacgcgcccacattgtgtaaataagcgcggcttgtttgaacatctggcggctttctcaggaaaaatcttctgggacatctcttnccaacaccagaagggggcgctcttgtgtcacatatggtgccccccgcggggagctctctgtaagaagcacccccacacacgcgtgtcaccccacagtttttggggcccccgcgtgtggcaacactctgcgtctgtgttgtctcttttgtctctgngcgtctgnggaatatctctgggagtgtcacactctctcaacgactcttgggtgttattatgtgtggttctctccgggtgtaccacacacacttgggtaaagtagactctctctctccacacgccacacagtgtctcatatctctctagagtccacacccagcaccagtgtgtccaaagactctctatatagagagtgttgtgcccagccacaccagagattccacacactctggagacgctgggtgagagaatgtctctgtggcgcacatgttgtataccctgcggttctacatttgaacacatcttgcacatgagaagctgtgagagagagaggcgccacaatatccctctacatctcctcacacaggagccctccacaccaccgcaccggtctactatcccgtgtttatcacacgcctcccctcgagtggcacccctcacgctctgagatgagaagaatgaaggagaggaaagaaggaaggagaggaaagaaagaaggaaagaaagaaagaaggagaagaaaactttaaacccagctgagatgtggagagctggagagtttgtccctcccccgcaggactacgcagggcccttgaagcttagatggaaagtgtgtctaacttgctctctgaccctttagccagatgaaattaaaaaaatatctggtttt

SEQ ID NO: 517747 - DNA, 488 bp, Homo sapiens
ccgccacggatgtgccgattgttgttccctgggcggcgtgcgaacaggtgacatgcaggtcttggcgcccgtggtgggcgactcgtgtgtcaccttgcgcaggcctttggtgcctgtagtgggagtctgggcccttgagcgtggcacaggccgtgtagttgacgttgggcagcacctccaccggctccttgaacatgacgcggaaggtgctggctgagccgtcgcagctgaagcccgtgtcgttctggcccaagacggtgttgctatcggtgtgaataatctggatgttcacttggtagtcggtgggcccgtggatggatccatacagcccaaatcccaccacgaagatgcgcttgttgactgagaacctgatgcggtcactggtcccgctgtagccccagcgactctccacctgctggaagcggttgatgctgcactccttcccacgcaggcagcagcggggccggtcaatgaactccactcgtggc

SEQ ID NO: 517748 - DNA, 183 bp, Homo sapiens
gtggccttgaagatgtaaaactgaagttaaaacagagcatttgagtcgcctctgacattcccttggaatttgttagaatgggcctgacacaacccaagggagttctcctctattggccccctggatgtgctaaaaccactctgtgaggccctgccacaagctgtcatgctctttcgtttcagt

SEQ ID NO: 517749 - DNA, 563 bp, Homo sapiens
ctacatgctcgacacaacaacgaaaaaaaaaaaaaaaaaaggggcacccagagaggcggggaccaggcaaggatattgaggaagtgtcctgaggacagaaaacggggaaatgggggaggagaaggagcggcacatggagctcagcagaggagacagacagaaggaaagatggctggcaggacttctagactagtcccctcagggctttggctgtatctattctgggccacttccaactcataacctgaagggctgctagatggagctttctcaaatccaggcatgatcattccagtgtactttttaaaaccctccaacagctccccaaagctcaggataaagggggataaaagctatacccttcaggcagggcacagtggctcacaccttgtaatcccagcacttggggaggccatggtaggaggatcgctggagcccaggattttgagaccagccggggcaaatgggtgagaccttgtctctaccgaaattttacaaaatttagccgagcttgggggcatgctgtcggtcatcccagctactctggaggctgaggggggagg

SEQ ID NO: 517750 - DNA, 220 bp, Homo sapiens
cagtggaagaagtagagtataccagtttttaaaaatgaataaggctttaaatctggggacaattaaagattatctcttacagagtacatcagaaaaaccttcagtgaattaatttgcttttaataaatgttatcacacgttggtagaaatcaccacaagaccatagatatttatttaccattgtcccggaagtagtgtaacatgtatatattagttcaca

SEQ ID NO: 517751 - DNA, 496 bp, Homo sapiens
tgagttgaagtgggggaaatagaggagtaaatcatttcacgatgtgtggttaagtgctgcagctcaggtaaccaccagtacacagaggaagggcggtttctggagacagggcggagaggagaccgtgggtgggcatttcccagagcagcctctgccagccaccctactttgatcactttgccgccgagcagcagcggcggtcaacctcagcctcccttagcaacctgagtgccccgtccaggagcctttactattggtctcatgcagcgagatgggcagttctgccgtgcaatcccagctcgcagttcttgctccgcgtgtactcacgggaggactcgcaggcgttaccgccttcccgcgtgccccgcccaccctcccgagcgtctttcggcgcatgcgcggactggagctgtgtgcagggccagcgcggagcccgagcagccgcggtgaagcgcctgtgctctgccgagactgccgtgcccattgctcgcctcgg

SEQ ID NO: 517752 - DNA, 233 bp, Homo sapiens
tgctgagattacaggtgtgacccactgtgcccagccaatttttgtattttttgtagagacagggtttcaccaagttgcccaggcttgtctcgaacttctaggttcaagccatctgtccacctcagcctcataaagtgccatcatgggcagcctcatatgttcttttttgttttgttttggtttttgagacagagtctggctctgtcggccaggcccgtgttggcacgatctca

SEQ ID NO: 517753 - DNA, 125 bp, Homo sapiens
tccgtgaaaccctcacagagtcttgatgtcaccctggcttctgggcacactccagaaaactgtttgatctcatagcaggcaaggctcagtgattacttcctaccactgaaagccacagtacggaa

SEQ ID NO: 517754 - DNA, 690 bp, Homo sapiens
agcggagagaattggcagttttaactatttttttcaaagttgagtctttatgtaaaaaagtacacaataagaggctccaagttggctaactaggggcattttatacttgcttcctccactaagaagaacaaaaatagcaagtagataatcacactttaaatagatcatccaagagaaaacactggaattcaacatataagtgacaggcaatacctaaagcaaggaaggagaaagaagcaaggcagcctacttggctggcttagctgggagctgagagagactccccaatatgggggaaagagtgagagaccctcagcagtccacattctcaccctggactccagtcctagccatggaagaacccctcaaccctcacaggccctgaaactaatgtagggagctgacaaggaattgtaccacaagcactgtgccagggaggaaagcttgtgctgggtccctcacattctttgagacctaagcagcaatggcaaggtgccattttagaattccatccccaacaggctgcacactatcctgaagcccagcagcgctgaggctgaggtgcaagaaaagagctggcttaggcatgagtaactgcaggctaccacacccaggtctgaggcatgagtggtatgcacactccccacctgccagtctaggttgccatcactgaagatagcactggccccc

SEQ ID NO: 517755 - DNA, 156 bp, Homo sapiens
caagaagtacatcaaagattacatgaactcaatcatagggaaacttgaagaacagagaccagaaagagtaaaagcttttatgacaggagatgaagaacaaatcaagcacatccttgcaaaatataacaaaaactaccagtagctatacttggtaga

SEQ ID NO: 517756 - DNA, 244 bp, Homo sapiens
tgggggggggttttcccccccccccccgggaaccttgggggggacctttggggtttaaaaaagggtttttgggggttttttgggtaaaaaggctttttttttttggggggcttttgggggggttaaattttgggttttgggggggttttggggggggggggggcccccccaaaccccgatttttttgggtttttttttttttggttttttttccccccttttaggggggttgtttggggcccca

SEQ ID NO: 517757 - DNA, 365 bp, Homo sapiens
gagggagcgggtgccgcagaagtctattccagctctcatccagcttacacgcctggtggagcgtctgcctggtggtctcaccttctccatgtgggccaactacactgttctcctttagcggcgaatatctcgcagaactcatacatctccagcccccacagtttgctgcttgcagtcttgcttaggactgccttgcggattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaag

SEQ ID NO: 517758 - DNA, 149 bp, Homo sapiens
accccagttgtctcaagatgaatgggtgttacaaaaaatagctatcggctgggagtgggggctcatgcctgtaatcccaacactttgggaggctgagggggaggatcatgtgaggttaggagttcaagaccagcctaaccaacatggag

SEQ ID NO: 517759 - DNA, 398 bp, Homo sapiens
aataatgaaaaaaaaaagttatgcaacaatgtcttaacccaagcatgttctgcctcagggcctttgcacttgttggcctctgtctggaatatgcttttctcagatctgcctgcctcaacttcccaaagtgctgggaatacaggtatgagccactgcgctttaagtcttttttttttttttttttttgagatggattttcactcttgtcacctagaatggagtgcaatggctcaatctcggctcactgctatctccacctcccaggttcaagcagttctcctgcctcagctactcaggaggctgaggcaggagaatcacctgaacttaggaggtagagactgaagtgagctgagatcgcagtgtgggtgacagagtgagactctgtctcaaaaaaaaaa

SEQ ID NO: 517760 - DNA, 320 bp, Homo sapiens
agtaggttcatcttcatcacgtgcatgctgaaaacttcgagatataaggtgctgagttgttttttcagtaggtgagaggctttattgcggtttctgtaggaaggaacaggtgaggtaggatgagcaggtttaggattgcctagtttgaatgatttcagcaagctctgggggtacaggagctgaaatggtttggctgtgtccccacccaaatctcatcttgaattcctactcattgtgggaggttcctagtgtgaggtaattgaatcatgggggcaggtctttcccgtgtcgttcttgtgatagtgatttattaattatat

SEQ ID NO: 517761 - DNA, 105 bp, Homo sapiens
taatcagtcggtaccctcaaagaatactgaaataggataaaaattgaaattggtcatgatgaaatggtgcccactcaccagtaccagtactaaaatgggtcagag

SEQ ID NO: 517762 - DNA, 363 bp, Homo sapiens
ctcggtgcccactcagagtccagcgtctctgagggttgtgtttccctcccggctccctccctcccaccgtctcggccggctgccccgccaggctccggtgagagggagtgtggagtttcccctggaggctctgagcttcaatggatcactacgccagacacgggccaaacctcccgagttactcagcgccccggccaccctcggaggcaggcggcggagcacgtggacgccatcaaaggcctgggacgtgcacagcaggagaggctgtgccagggcgtgggcgcgggctctgtggggagaccgctgcgaccggcgtggacaggcatgcacaaaggacgcaggcgggactgcctctgaagacac

SEQ ID NO: 517763 - DNA, 103 bp, Homo sapiens
gggcccccggaccccgggcgggggggggggggttttttcctaggggaaggggggccccggggggtttggggccgggttttttttttaaaagtttttttttcca

SEQ ID NO: 517764 - DNA, 459 bp, Homo sapiens
  misc_feature (316)..(316): n is a, c, g, or t
  misc_feature (362)..(362): n is a, c, g, or t
  misc_feature (373)..(373): n is a, c, g, or t
  misc_feature (389)..(389): n is a, c, g, or t
  misc_feature (402)..(402): n is a, c, g, or t
  misc_feature (423)..(423): n is a, c, g, or t
acttttccttttctcctcagaggaatagtaaggctataatccttgagccaatctttgcttaaaatgtactctggagtgcatagaaagccagttcaaggacaactttcttagccaagggggaaattacattttctgcaatttattttgttattttgtgagtttctctccttttcctaagttggatccaactgaagttaaattttaccacattctccagatgaaaagtggtgatagaacttagttgcaaggtgtggaaacagcaacaacagcagcagcatttgctaactgttggggtaaatgctagacagtccagggnaacacgttgcctgggtgatctcctttactccccactccagttgatnagggcaggtgncattattacttctaantcacaggtgaggnaaattgggtcttgggggttanggttttaggcccaaaagttgggccagaggaggcagg

SEQ ID NO: 517765 - DNA, 692 bp, Homo sapiens
tggaacatttatttaccaagttatatggaaacctcctgagaacttaaacccggtaaaaaacaaatgaatcaaacccaggccccattctcgggaagtctcacagggtgaaaataggtaactacagaaaacacagccaataaggtgcttgtgaaacagcaggaagaacataaaaaagagtgtaggtgtacgaaaaccgtggaactcaaaaactaaaccggcggagaagggtgacggaggagtgtcctagaccctcccagagaagagcgtggggaacatccagaaagaggcctctggcgtgccgacacagccacatcccctaggctcctcgtggagtatcacgtgcgaggcgtggcccattgtgcgagggaaggcgtgttagaaccaccttataccaatcgaggacgtggcggagaaaacaggaggagccacggggtctctcttctcgtgaacggcgtggttcacccagagggcgccccagaccaagacacaccacaggttctggggaaggtggggaacggggtgtccctcaggggggcccacagacatgtgaagcgcgcatataataaacggggggcgcgtgtgtacaaagcgccgtaaagggggcgggtctacaaccccacagcggatctagaaaaccccacggagaaaagctacaccctccgaaacttttggccaagccgcacgtgacgaac

SEQ ID NO: 517766 - DNA, 308 bp, Homo sapiens
  misc_feature (20)..(20): n is a, c, g, or t
  misc_feature (49)..(49): n is a, c, g, or t
  misc_feature (64)..(64): n is a, c, g, or t
  misc_feature (91)..(91): n is a, c, g, or t
  misc_feature (115)..(115): n is a, c, g, or t
  misc_feature (133)..(133): n is a, c, g, or t
  misc_feature (170)..(170): n is a, c, g, or t
  misc_feature (212)..(212): n is a, c, g, or t
  misc_feature (307)..(307): n is a, c, g, or t
taggctcgggcgcgcgcagntggcgctgcagtgcaagactgtgccgccncacagccgaggcgcnaaagggggacgccggcctctgggccgntgcttcgctttctcttcgtgtgcnaacgccgtccgttaagangcgccccgtaccgggcgataagtgcaactaggaccanagatgactagagcatacctctattataagagataagttccgnaataagccagttctttcatatagataggtaaatgtgatccaaagcttctaatgagattctgacagaacatatccaacactcaatctattatgacnt

SEQ ID NO: 517767 - DNA, 266 bp, Homo sapiens
atggtaaagaaggagatcagacgctacagtatcacttcaggcccagctgtaaggcttcttcgaggctattatatggagtgtagaacctccaatctggaatttctagctaattctctgaaatcacatgactacccgcgacctccagacaaataagactcaaggcccagttagaggtttgtactgcccattaccatcgactaaaagacatcagacagagagacactggctacttcttagtcgctattgtctgttttaatctcagcttg

SEQ ID NO: 517768 - DNA, 201 bp, Homo sapiens
gcatgaggtaatgatatctactgcgctcgtcgtcgacaagggctccggcatgtgccaggcacggcttcgcgggcgacgatgccccccgggcctgtcttccccgtccatcgtgggggcgccccatggcaccagtggcgtgataggtgggcagtgggtcagaaaggattcctcaagtggagcgacagaggcccatgagcaatg

SEQ ID NO: 517769 - DNA, 480 bp, Homo sapiens
acctcccacgctcaggtcacgaaaggatcagcaaagaagggcaagaaggcccagcatttggtgcataccaggggcaaatcagacatcacagtattctatgtactattgtgtacctctgctctgggagccaaatccctggatttagttttattcttaaccattgagggatttggttaaatgatttctcactccagctgggtgtggtggctcatgcctgtaatcccagcactttgggaggctgaggccagcggatcactggaggtcaggagttccagaccagcctgaccaacatggtgaaaccctgtctctactaaaaaatacaaaattagccaggcgtggtggcgcatgcctgtaatcccagctacttgggaggctgaggcgggagaatcacttgaacctgggaggcagaggttgcagtgagccaagtgcgtaccactgcactccagcctgggaaacgagtgaaactctgtctcaaaaaaa

SEQ ID NO: 517770 - DNA, 449 bp, Homo sapiens
cagggtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtgggacttgctactctgaataatgtaacattttttctaagttctataaatatatactggaagttttggaacacatgcagacgcttaggaaaggaaaggctggttccttggaagtgacgatccaggatgatgcagtcacttggtggcggagggtgggcctttcttacggttggattttggcaggtggttttgccactggtatagatgggtgatgtgtggatcgcaagttctagagggcgaatgaaggtgctgactccaggtaatttctggatactac

SEQ ID NO: 517771 - DNA, 548 bp, Homo sapiens
gatcttactaacaggaacgtgtgggcccgttcatcgcatgcacggtcagtgggcacgtgaacatgctcgcctggacaactgttctggacagggccgctccaacaaagggctcctggccaggatctttggatccccgtcagcctcagagagcatggagggaccttctcttgtcagggactcctcagggcctgggttgccccttacattacctggacctgttctgcttcctgtctacctcatattataatgcgtgttacttgcaaaaaccttatggtactgtgtttctcagaccaagtgtctactgatggcccaagatggcgttttgtgggcttccactgtccccactccgaactcctgtatgtgcctggctgagtcacctaatccatactgtcatactagcataattatgactattgcatatgcttgtatagtttgactcttggctgcctacgtctgtagggtcccctgaaaatcccacttcctgcccccagaaagggcctttatttccaactaggaggataatgctagtacaggcaatctttctctgc

SEQ ID NO: 517772 - DNA, 134 bp, Homo sapiens
tcatcgagctcggtcccaccttcacgcgcgcgcccttgggacgcgggcgcctcggccaggctggtgatgaagctgcgcacgttgtagcggccgatgggacgggtcttgtccggcgccttgcccgcgggcgtcag

SEQ ID NO: 517773 - DNA, 373 bp, Homo sapiens
ctctggtatcaagtgtcctttacataatggttgctactcttctgtgtatcataggcacacacactactctgagtacatatctgtctacataatagagcactatatttgttcattgtgcctgcacctaggatgtgaattttagacctcttctccccccttaaacctaagaattctcctgtctttttctcttgcctcaggatatcatgaattattcccctttctcctcccacctctatccacggaattgatttctttcttattcctctgcttataagcttctttcctcttgctcttcctttatccagctcatgtcgactaaatcagctaattccatttgtcctgttacagaaatattagctcctaggattgtcac

SEQ ID NO: 517774 - DNA, 824 bp, Homo sapiens
  misc_feature (3)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (17)..(17): n is a, c, g, or t
  misc_feature (25)..(26): n is a, c, g, or t
  misc_feature (30)..(30): n is a, c, g, or t
  misc_feature (33)..(33): n is a, c, g, or t
  misc_feature (53)..(53): n is a, c, g, or t
  misc_feature (57)..(57): n is a, c, g, or t
  misc_feature (60)..(60): n is a, c, g, or t
  misc_feature (71)..(71): n is a, c, g, or t
  misc_feature (98)..(98): n is a, c, g, or t
  misc_feature (104)..(104): n is a, c, g, or t
  misc_feature (115)..(115): n is a, c, g, or t
  misc_feature (127)..(127): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (145)..(145): n is a, c, g, or t
  misc_feature (147)..(147): n is a, c, g, or t
  misc_feature (149)..(149): n is a, c, g, or t
  misc_feature (193)..(193): n is a, c, g, or t
  misc_feature (202)..(202): n is a, c, g, or t
  misc_feature (204)..(204): n is a, c, g, or t
  misc_feature (222)..(222): n is a, c, g, or t
  misc_feature (245)..(245): n is a, c, g, or t
  misc_feature (252)..(252): n is a, c, g, or t
  misc_feature (262)..(262): n is a, c, g, or t
  misc_feature (269)..(269): n is a, c, g, or t
  misc_feature (274)..(274): n is a, c, g, or t
  misc_feature (277)..(277): n is a, c, g, or t
  misc_feature (285)..(285): n is a, c, g, or t
  misc_feature (319)..(319): n is a, c, g, or t
  misc_feature (337)..(337): n is a, c, g, or t
  misc_feature (350)..(350): n is a, c, g, or t
  misc_feature (360)..(360): n is a, c, g, or t
  misc_feature (367)..(369): n is a, c, g, or t
  misc_feature (379)..(379): n is a, c, g, or t
  misc_feature (396)..(397): n is a, c, g, or t
  misc_feature (399)..(399): n is a, c, g, or t
  misc_feature (405)..(405): n is a, c, g, or t
  misc_feature (408)..(408): n is a, c, g, or t
  misc_feature (429)..(429): n is a, c, g, or t
  misc_feature (437)..(437): n is a, c, g, or t
  misc_feature (445)..(445): n is a, c, g, or t
  misc_feature (448)..(448): n is a, c, g, or t
  misc_feature (459)..(459): n is a, c, g, or t
  misc_feature (469)..(479): n is a, c, g, or t
  misc_feature (500)..(500): n is a, c, g, or t
  misc_feature (566)..(566): n is a, c, g, or t
  misc_feature (679)..(679): n is a, c, g, or t
  misc_feature (685)..(685): n is a, c, g, or t
  misc_feature (727)..(727): n is a, c, g, or t
  misc_feature (746)..(746): n is a, c, g, or t
  misc_feature (748)..(748): n is a, c, g, or t
  misc_feature (756)..(756): n is a, c, g, or t
  misc_feature (804)..(804): n is a, c, g, or t
tancccncangtnaaantgctttannaaanctnaaaaaaaaatacagtttaanaaantanctatcttgcanccagcttccttgcagtacactgacttnaaaaanaaaaaaaaaanggggaaaggggnaagggggcananancccnananagttgttggacggaaaaaaaaaaaaggggtttcatttgtattcnctttgccananccaggcctaccgcaaggncacagcacagttttgtaaaaaangttgcanaaaaaagganggaaaanccacnacngccgccangaaggagtgcggggggcggggcggggggtcccanaaaacctgctttccaaangctgctgccgaanactggccttnaaataannnccaggacaanctgtgtgtgaagggaannanccaccncanaagtggagggccctaaaaaanccaaaaangagggcangcncttcactcccnctcccccccnnnnnnnnnnnccccacccccaaaatccaacngccgttgtttgccacagaactttttttttttttaaagaaataaagaaaacagtgacttatcccgcnacccaagcgtgtagagccgcgcgctgtactgcttccgatatgtgccacagagcagcaacgagaagtggacagagccgcaatggttacaactgtaagaggttatttcttaaaanaaaaanaacacctaaggactgagtcccatatgcacttttgagcatttntacagcatgcgattctaanantaaacccncccaatatggcaaacaatcaaaatttttaaaatttaacttagaaagtntgagatcattattttcaaaa

SEQ ID NO: 517775 - DNA, 523 bp, Homo sapiens
ataggatccaggttaacacgtcttcattgggaatactgaggtcgtcaatgatgtgtgaaatttaagtctacacttagttgtttttagaagagaaacaaaagtcttctatacattgggttaatcatattagtagcttaactcttcatagttactatattgccagctttatgtgtctgttgattcagtgaatccagaaacttgctgcccttattcttgattttaaaaatcagagtagaagtttgttcatcgaggtgatcttctgcacgatgaggtgatcttctgcacgataaggtgatcttctgcacgatgaggtgatcttctgcacgataaggtgatcttctgcacgataaggtgatcttctgcacgataaggtgatcttctgcacgataaggtgatcttctgcacgataaggtgatcttctgaggtgatcttctgcacgataaggtgatcttctgcacgatgatcttctgcacgataaggtgatcttctgaggtgatcttctgcacgataaggtgtatcttct

SEQ ID NO: 517776 - DNA, 382 bp, Homo sapiens
ccgggttcagcaattcttctgcctcagcctcccaggtagctgggattacaggcacatgccaccacacccagctaattttgtattattagtagagatggggtttcatcgaggtgatcttctgcacgatgaggtgatcttctgcacgataaggtgatcttctgcacgatgaggtgatcttctgcacgataaggtgatcttctgcacgataaggtgatcttctgcacgataaggtgatcttctgcacgataaggtgatcttctgcacgataaggtgatcttctgaggtgatcttctgcacgataaggtgatcttctgcacgatgatcttctgcacgataaggtgatcttctgaggtgatcttctgcacgataaggtgtatcttct

SEQ ID NO: 517777 - DNA, 295 bp, Homo sapiens
tcatccaagtgccttctgtagtcacatgaattgtaaaggatacgctgctccctcggaggggagcaggaatgctgcacgatgaggtgatcttctgcacgataaggtgatcttctgcacgataaggtgatcttctgcacgataaggtgatcttctgcacgataaggtgatcttctgcacgataaggtgatcttctgaggtgatcttctgcacgataaggtgatcttctgcacgatgatcttctgcacgataaggtgatcttctgaggtgatcttctgcacgataaggtgtatcttct

SEQ ID NO: 517778 - DNA, 527 bp, Homo sapiens
gagactcgtcttcaaaactgagcaaccaatatattcaatttatattatatctcctaaaacatttcattacacatagtgaatttacttgacaattgtactataattattatccataaggttacccatactattaacctttacaggatatatttccaatgggacgttttcacttgacctattgaagtaattagtgaaatttcagaatttccggtatttctaggatttcactctggtgggcattcttttgatttatacggtcacatgctggagtatgtgttaccatgtgtctctgagtgagtcataggataaatgaaggtattctcacattcgataccttcctaaagtttttctctagaatgagtgatgttttaccatcaagtacctctggaacgcccgtaggcctaaccagattttaaactattcgtattggattttcttcagtgagtcctttcaagttttcaacccgcaatggggtacttgaatgcttaaccttattgcttatagtcctaggctctccccgaaaaaaa

SEQ ID NO: 517779 - DNA, 511 bp, Homo sapiens
  misc_feature (225)..(225): n is a, c, g, or t
  misc_feature (228)..(228): n is a, c, g, or t
  misc_feature (230)..(231): n is a, c, g, or t
  misc_feature (233)..(233): n is a, c, g, or t
cccatcgtgcaaacaatacctcggacaggacatgaagtaactttagaaggaggatatgatggatatggcagtggacgtggatttggggatggctataatgggtatggaggaggacctggaggtggcaattttggaggtagccccggttatggaggaggaggtgatcttctgcacgatgaggtgatcttctgcacgataaggtgatcttctgcacgatgaggtatnttntnnangatgaggtgatcttctgcacgataaggtgatcttctgcacgatgaggtgatcttctgcacgataaggtgatcttctgcacgataaggtgatcttctgcacgataaggtgatcttctgcacgataaggtgatcttctgcacgataaggtgatcttctgcacgataaggtgatcttctgaggtgatcttctgcacgataaggtgatcttctgcacgatgatcttctgcacgataaggtgatcttctgaggtgatcttctgcacgataaggtgtatcttct

SEQ ID NO: 517780 - DNA, 143 bp, Homo sapiens
ctttgtacaaatttttatttaaggtcttgactgagcctgtatcaacttcattcttgaatcccgcgtccccgtggctggaggctgacacatccgtgggcaccactgtaacttcctgtgggtcccttcccttctgtcgtcttctc

SEQ ID NO: 517781 - DNA, 891 bp, Homo sapiens
catcctggctaacacggtgaaaccccatctctactaaaaatacaaaaaattagctgggcatggtggctggtgcctgtagtctcagctactcgggaggctgtttggcaggaaaatggcatgaacccaggaggcggagcttgcagtgagccgagatcacaccactgcactccagcctgggcaacagagccagactccgtctcaaaaaaaaaaaaaaaaaattcactctcaaaagtggatttaaagaccttaaattttaaaacctgaaattttaaaacttattaaaattaaaacttagaggaaatgtggttccaaactattgggctctagggaaatttttttattgaattaaaacctcagaaagcccagacaacaaaggcaaaaattaaacaattggttttttcccaaattaaaaagcttccgtgcagcaaggggaacaacagaacgaaaagacaacctgcagagtgggataaattttttgcaacccattctttccaccagggattcttttccagattatacaggggacctcaattgtctcaacaggaaaaaattgaaccatgcattacagtgggaaattgtctgccttctcaaagaggacttccactggcaaaatttttgtaaatggttccacttccttaatcatcgggaaatgccatccaaacccatgaatttcacttcacctgaggatggttttccacagagaaaacatagaaacgccctggaggtggccaagggatcctcacgtggcgggatccatctcagacaccggggaacatggttccctcaatcacacgatttgtccccctgggtgtccacaggcgactcaaatatgtcccttgcgctcaaccaagaaacctatacggacagcgtgcaccgacaaacggtgtcgca

SEQ ID NO: 517782 - DNA, 186 bp, Homo sapiens
acagaggcgttagtgaatttgctgggttttagacacccggtaggccagcctttggactcctgcagtagcagtagtgggctgagtgtgcctgtccttggaccctagggcagtgtacactggtaccattgttagtgagtccaggcaagccaattttgggagtcccaggtggcttgctcaggtggttgg

SEQ ID NO: 517783 - DNA, 355 bp, Homo sapiens
  misc_feature (92)..(92): n is a, c, g, or t
  misc_feature (171)..(171): n is a, c, g, or t
  misc_feature (183)..(183): n is a, c, g, or t
  misc_feature (196)..(196): n is a, c, g, or t
  misc_feature (208)..(208): n is a, c, g, or t
  misc_feature (322)..(322): n is a, c, g, or t
tacgagctctccacttcaaagttgtcctgactcagtagtctcgtgctctccggccttcagctcaggcgatgttgagcagaactggtgacacnctccccacagagacggcatcgggcctctctgttgcgggtgtcgctgattttaaacacggctgctctggcgacttacttncgcccgcctctncttccgagggctncttcgcacaganccggcatcatggctggatggctgctcagcaacagcctgagctccgatcatgctgaagtctgggctggctggcactggctggcatcctgggaggtggaagcaggtgtggttagantcaaacttggcgggagccactgtggcgctgctg

SEQ ID NO: 517784 - DNA, 338 bp, Homo sapiens
ccatttttctaaatataactagggttactagaatgaacaagcttggattatagagccagttatggacgtgatgatactgctgtgtaggttttgaccattgagcaggtcgtggtaattgtttcacagggttgctacttactgaatcactgctactacatgcaatgaactgtgctagactttacagaatgattcctaatcattgaagcaaccctcacaaggtaggcattattatcatcccattttcaccatagcagcgacattcaggctaccaagtttagtagcttgtcctggtttcacagccagcaagtaacagggtctagagagggacccactcaggt

SEQ ID NO: 517785 - DNA, 275 bp, Homo sapiens
catgttttgtgtttaaataaaactgtaaaaactgcaaagaaaaaccaaaaacaacaacaaaaaataatcttgtgttaggcctccttcggtttttcaaaattgcttccaatttccattttcacatatggtattattagttttttttttaagtttaagccttcctgaatggaaggaacccaatgcagtttccaaattaacattttccctgatgactaaagatgttgaacatcatttcgtacgtttaaagactatttggtttttttgtgtgtgtgatg

SEQ ID NO: 517786 - DNA, 292 bp, Homo sapiens
  misc_feature (1)..(1): n is a, c, g, or t
  misc_feature (4)..(5): n is a, c, g, or t
nggnngataccgccggcaacgcgggatccttaacccactgagcaagggcagggaccgttcccgcaacctcatggttcccagtcggattcggtaacctctgcgccacgacgggaactccactctggtgatttttaaatcggggggattaaagaagtcttcacaattcattattaagtgtgttgcctgacactatttccatatcctattttgtaccaataagaaattgatgtcagcaaactatcaacttcattgttttcccaggtgtccatacaatgcactactagactcatct

SEQ ID NO: 517787 - DNA, 376 bp, Homo sapiens
gctctatatctacatccctctggggagtagtattctagggcgcggtgcctcacgcctgtaatcccagcactttgggaggccgaggcagaaacagatcacctgaggtcaggagttcgaaatcagcctgggcaacacagcgaaatcccatctctactacaaatacaaaattagctgggtgtggtggcacatgcctgtaatcccagctactcgggaggctgaggcaggagaatcgcttgatcccaggaaggcagaggtggcagtgagctgagaacgcacaactgcactccagcctgggtgacgagcaaaactccatctcaaaacaaaacttccacaaccagcctggagtgtgtagcccctttgtccaggaatttgacta

SEQ ID NO: 517788 - DNA, 237 bp, Homo sapiens
atgttcggatgtccacacgctcgaaaagatttcccaacctgtttttcagtgtccacagtgcctagatctagacctcacatgaagattaacaaatgccagctgggcctggtggcatacccctgtagtctcagctactctggtggctgacacaggaggattgcttgaagcccaagagttcgaggctgcagtgagctatgatcgcaccaccgcactccagcctgttttaacacaccacgg

SEQ ID NO: 517789 - DNA, 1039 bp, Homo sapiens
ggactggattgcccagaggtctcccgtggcgctctatggtcgtacaccttgctgcgtgggctttgatggagctgggagacaagtctatctatagtcattgcctatcgatttccttgctggttgttgacagaatggcttccagctgtccgtcattgctggctgtgagtacattaactggctgcgcgtccgcagtatgccacggtgtcgatatcactgcgagggcgcggacaggttgtgagctgcgcctgacactcgccgtccgatgaggataggacatggggttggctcggacgacactattggtggcagattgttgtgagagatagggcctcatgagcacagtgcatagactgtctaggaaacttgcactactgggaagctcgattggtatttgcctcgtaacttggagggcctttggaaggtggccgctggtggaccacggaaggccgaatgcgagacaatgcccctctgatgactgccgctggtacaaaccttcagttactgtgcagttatcccccttgaattaaggatcggtgccttgtactgagaagggccgttaccctaggggccaatgaaaggcgttggccgccaaggctggttgaggtttgcaacgataggcactctgggttgtgaccattactaatggggtcagaaaacgctctgactgcattagactagggcatgggatctgttagcccaccgattttggagtaggaatttgatgaactaaggggttgggttgacctgatattttctgtattcgaccgtcacaatcgacaacgcagattcccagtcgctattccggtgagtgcacgcagggccactaactacctgttgagctaacggcagtctcttcacttggccatggcatgagggtgggtgacctccatggaatggcttaactgtgggactcttgggcggaattagcccacaatgtggcgtctttagcccaagaaagacctttctttcctgtttcaacaaggttggctatgaagaatgtccagcaacctgtcttcgggtcagggaaccggctaatgta

SEQ ID NO: 517790 - DNA, 446 bp, Homo sapiens
aggaggccgaggtgggcagaccccttgagcctaggagtttgagaccagcctggataacatggtgaaaccccacccctacaaaagaatttcaaaactagctgagcgtggtggcgtgtgcctgtagtcccagccactcgggaggctgaggtgggaggatcacttaagcccaggaggtggaggctgcagtgagccatgatttcaccactctactactccactccagcctgggtgacagagtgagaccctgtctccaaaaaaaaaaaaaaccaaaacggggaaaaggtaaaagggggggaaaaggagagaccctaggcagggccaaaggcccacataattctaaaaaatgtaagaaaagaattgggctttgggacctattttaggaccaataaaagggttttttgggttttcttcagggaaggaaaaacacacgggaatcctttcgcata

SEQ ID NO: 517791 - DNA, 91 bp, Homo sapiens
aaaaaactttttttttttggctttggaagggcctcatcgcccttaccccgctattcccacctttttccccttttttattaaaattttttta

SEQ ID NO: 517792 - DNA, 160 bp, Homo sapiens
  misc_feature (123)..(123): n is a, c, g, or t
tcagctcgcaccggttatttattatgtattgttgaatcctacatcagttttaaggacacagagaaatgatgttgatgtgttgggaggatcctctacacgtcgacctctgcacggcaatgcaangtcttggcactgtggcctggtcgcttttacaatcagc

SEQ ID NO: 517793 - DNA, 203 bp, Homo sapiens
gggttcataatactgataagtgcaacggtcttgagactgagaggtctgggaaacacgtggtttagccctccagttctgcagtgtgacacggtgtgaaatgtcagctccccaagtcaacccacatattagtcaaaaatgctcactgatgccctcagtgaaaggcacagttgtatgcaacacaacacttcttgggcttcttgggg

SEQ ID NO: 517794 - DNA, 1093 bp, Homo sapiens
cacagttttggaaaaaggtctgtggtagtctggagttgatgaggaaggggtacaagatgtggttagaaacatttctttgttctggaaacaaagtactgttgaaaccagcttggaatttttttttttttttttttttaagttcagttctcccttagtggctgcctttcaaacaagttaccttttatctgatgccttgtatcttcccttggttaagcgtgtaactgtgatgtagggctcaagggttttggtgacaccgaggcagactccacacagagaggactatgagtgagaatatggccatcacctgaaaagtttctatatcttcggggctttgggccccgtggaaacaaatccgacctatgtttgaagctagttgattcccagtgtgcactattcccagttgccctctgaagtccacaggcaatacatggtctagtccttggcgaatttctctgattggggggcccagtttatgaagtttccccacttgtgaacgacgggtccaaaatagcagagccaagcagacagggggtctatccttcataagctcagtgacttgtccacactcgtcttagcacttacgtttcaaaagcttgtcacaaacccttggagtcattcccagataatagacctggcacttgataattcccctattgccaagggtctaggtgtgtctaaggggttatacggggaacgtgtgtggagattaggtgctgcctgctgccctggattggctgaagggcccctgcggcactcttcaatgtgcctgctcggaaaagctcgctattgtgacccccggctcacactgctgtggacccaatttaccatgctgaacaaaggttctctggcacaatctcctgagagggcaatatcatgggatgccccgaaacaaaccaaaagggtgggcctttggggagacacagcaaccaccacacgcacagcacccacaaagccacacataaacacgcaccccagcgacaccagcagacagatcaacgataacacaacaacgaaatgaacgagggctccgtcacaaccactccgtgccgcgccacgaaacgaccgccctcattggcaaaaaccgcacacatga

SEQ ID NO: 517795 - DNA, 101 bp, Homo sapiens
tgcaaggatttgcgaaactcatccggtcgacctgctcaaagattgcgacgatcaccaccgtgcgccgttcgtggggcagtacctggtcttcacgtgcttgt

SEQ ID NO: 517796 - DNA, 163 bp, Homo sapiens
tacaatttgagaagtgccctgacagagatgtgtgtactctatgatgttctcagctattgttagggcatacaaaatttaatgactcttgaatccttgtctctcagtgatgcacttccttccaacaacagaaatcctcagcacgtaggcaatatgcatcatctca

SEQ ID NO: 517797 - DNA, 561 bp, Homo sapiens
gatacaaagatagacgataggcattaaaagctatcccaaaatgtccaagatgtgtgatcagcagtcaagtatttgagagcagctattaaaactatagtcatggggtgaagcaaccaaaattctcataatgaatgaatacatgtggaatctcagcagagaaacgcacattattaaaaagaaccaaatagaaagataatgaaattttaaatagtacttttaggttgattcatagattagaaaaagacagaacaattgaaattattcaatcgtgaaaaaaagagtaaaaaaagtttgaagaaaatgaacagagtcttacaatctgtgggcagatagtgtcctagaaagagtgaagggacagaaaaattaaatggggtgcaaaagtaacaactaatagctgaaaacttgcaaaaatttgtcaaaagcccacattttatatccaagcagtcaacagattccaaaaagaaaatccaagtaaaatcgtacaaagggcacatggtgatttaagaaaactggcaggacagggcttccaattgactttctaaaatttctaatttttactaa

SEQ ID NO: 517798 - DNA, 144 bp, Homo sapiens
gcggctaattttgtatttttagtacgagacgggatttgcatgttgcccaggcggtctcgaaccccgagctccgtgatcctccgcctggcctcctctttgcacactggcgttattctcactcttccaccgaggacttctctgaga

SEQ ID NO: 517799 - DNA, 134 bp, Homo sapiens
ccatccaaaaaactcgacataatgttctcctactgtggcagagcactacacgggagagaaggcagcctcattttccttaatgccctcaatcatgaaggagctaattcctgacaaagtcaatgttttgtttgttt

SEQ ID NO: 517800 - DNA, 119 bp, Homo sapiens
gtatcctttattgcatttatacctagaatggtttatatcgggacgcgatttatcttttcttggtggggctgttaatgaagtagctagtctagtctaaatgcaatcagtctaaatgcaat

SEQ ID NO: 517801 - DNA, 106 bp, Homo sapiens
gcggtttctatttatgttggttttcggaacctgacggcactgacttaacgacgggaccggccggtgggccttcgtacttgcgccgttagacggcgacacttcttgg

SEQ ID NO: 517802 - DNA, 314 bp, Homo sapiens
aagtggcaggaggtggctaggggtcacgcgtacttttctaacattcaacattggctcagaagccaggtcagtgctcacagactgttgctataaagggctgggtggctttctatccccacagctactcagcctaatgccattgccagagcacatgtagccatggacaacacaagggggcgtatccctgtttcacgacagacatattgacaggaataagcaggaggccagatatggtcctccagcgtgtaattacttgggcccctgtttacggagaggtaaaccaggggaggagagatcagtcacggatgacgtga

SEQ ID NO: 517803 - DNA, 103 bp, Homo sapiens
gcctctggatgcaaagtgtccaaggcttcggacctgagccactgttgattgaggtgaggaggactcggggaggagcaggcatagggacactttgcatccagag

SEQ ID NO: 517804 - DNA, 389 bp, Homo sapiens
gctggagcacagtggcacgatcttggatcactgcaagctccacctcccgggcctcagtctgcagagacacagaagcaaatgattgtatgaagctcctgactgtatgaagttctcagtcaaacaaaatagtacctcttctgcccatctcagaggtggataaggataaagtgaaataatggaaagcacaaggaacagtaaaaggcaaatgtcaagaagctgtttgcaaagttaccaagatgtaaaattagattttacttattaataatcatgtcacttgtcattctgtttataatggtcaattcactgctgatattcaagtggaccgtttaaactgtatttttgctcagctatccctccaaataaatatctcaaaatcttgaaagataaaa

SEQ ID NO: 517805 - DNA, 1098 bp, Homo sapiens
  misc_feature (1085)..(1085): n is a, c, g, or t
catctttgcaggcacactcatcacagtgctaagctcgcactgattgttttaccgtgagtaggcctagtaaagtaaagcatgctagcttttgattccgagttctaatcgcaatgagaaatatagaccctcgtttccacaggaagctgccgagtcaaagtattgtccatcacagcaaggcaaccgtcatccactaagtcctttcgtaatctagcatatacctcttacaaacaaatagtactctaccgcgtagcaatgacatcccagtacatctcaaggtgctatcacaagtccaagtatcgtccatcacttagatacatccatacatcgcgcttataacgttacattacaacacctaaggacatacgtccgccttttacgacttcatgcagttcgccagtacggtttgaccgcacaggacagcctcgcatcatgtacatgcacggcactgccttgcgatgcgtgcactagtgatcaacaacacttagaccgccacgattcatcaagtacagtattacgcaaatactgatcgcgctctactaagaacgtacatgccttcatccctcacatactacgtcaagtacttaatccgatccatacgcaaaggcaagtgtgacggtcggcacttagataccataaaccacagcatacgtcaacaactcgttaggcattacgtcactcagagttagcccgacaaataaggattgagatacagtgagtcagttattcgtaacctgatatgaaaccatatacatcaaccaattcgttacaattctcacactactacatcatctattccgtatacatatctacccgaaagttccctacataacgtcaaccttagaacctctcaggcaaccagcagagccttacataaataatactacgacaaccttgacaacaaagcctgaacatttgacttataacaatgcactttaaagttcccgatgcccaaccattccctcttccgctaagtgagaggcatgacccacgattaaccgagctttaatagccgcaaatgggcacataatcgacagaagtccacgaagaatcaatcagcttcatacattccaacatcacaaagcacncaatcaacgctct

SEQ ID NO: 517806 - DNA, 646 bp, Homo sapiens
ggcgagctgtcagcgcgggcggtgaacgcctgcggggctgctggggttggtgctgctggcctgacactgtgtcccctgacgcctgtgcctgtgctgatcccctgtgagcctccctgctgctgcccctgcaccctgacctgtgctcagcctggccggcagcgtaacacgccctacgctcgcttgctctgcctgtgcctcatggtgcaggcgaggctgggctgctgggagacccctgcctggggcctgagacttggggcgggctgacgatggaccaggttacggcctcctctgccatgtcctcggactgcgactgcgggcgaccacataccccctgcacctcctagtctggaagaaactgactaccggcagctcgagaaggagctgcagggccagaatgtggaggctgtggacccacgaggtcgaacattattgcatcttgctgtttccttgggacattcggaatctgctcgagtcttactccgacataaagcagatgtgacaaaagaaaatcgccagggatggacagttttacatgaggctgtgagcactggcgatcctgagatggtgtacacatgttctccaacatcgagactaccacaacacatccatggccccttgagggagttcctgagctgtccacaaaatt

SEQ ID NO: 517807 - DNA, 143 bp, Homo sapiens
cacgagggattcctcgatctgccggatcagcgtacggtgctccgatccacgcaggcgctcggtcagttcggtcacgaccagtcccagtgcatgcatcgtctgccgtaggtcatggttggtggtggcgatgacacgcgacttcg

SEQ ID NO: 517808 - DNA, 167 bp, Homo sapiens
tactacatgactcagatcaaaacagcatacctgtaagctaagatagatggtgtggattccactggttgtgatcaatacaataacaaacctttttcctttgacatactctgaatttggttgttgggggggagggtgtgtgtgtgtgtgtgagtctgtattaactgctt

SEQ ID NO: 517809 - DNA, 418 bp, Homo sapiens
ttttgccgcagttgaattcatcttgtgtctcattcaagtaataaatggaatgcttggaggcttatgtggctattgctgctctcgccaacagcaatataactgctaaaaaagaacacaagacagaagggcgtgcttcctgtatttcactgtaatttgtatattttccctgtgttgtgagactttgcaccttgtgccacatcctaccctttctgcttttgtaaggaaatgtgctgacgtcatcacatgatgtcagtgtttacattcacaaaacaaacaaggcagcaaactgcactctctccgaagggattttacagacttaaggactgttctcagcatagctgagataaactcttcagtgtttgagataaaaatcagagctaactattgtgcatatgtgcatttttttttaaataaaaga

SEQ ID NO: 517810 - DNA, 270 bp, Homo sapiens
  misc_feature (18)..(18): n is a, c, g, or t
  misc_feature (230)..(230): n is a, c, g, or t
tggagggaaatatttatngaatttttgtaatttaaaatattttgttgttagttaattatgaatagatagaagaattttatagatgttgttataaataagtagaaaatataaattttattattaaaatatgttattttaaaatttattttttatattgtatttttaattagatgtattatttttattatttttattgtatgtgttaatgattttatgtaaaaatgtaattnttttttatgagtagtatgaataaaattgattagtttgtga

SEQ ID NO: 517811 - DNA, 879 bp, Homo sapiens
  misc_feature (13)..(13): n is a, c, g, or t
  misc_feature (18)..(18): n is a, c, g, or t
  misc_feature (27)..(27): n is a, c, g, or t
  misc_feature (223)..(223): n is a, c, g, or t
tcccaggattacnaatgnggcatttantaaccccagcagggttggtcctaatgcttctgtgtgggcagctgccaccggtccggcgattctgtccagatctcttggtccctgaggtgtcagttggcggccgccatctgggtcctttccaccattttcagcccctccagggctgggaggacccggggggccacactctgggagcctcggttgaagtggtggggcntgacgccgtttctctgacgtcccccatagatctgggtcatggagccaaccccaggccaccccggaggtacaggtgccggctgtgaaagcagctcgcgtgtagaaccagttctcatcgtagggagcaagctcttggtgctgggccagtttgacggtatccacccattcggggactttcagcttcccggacttttcggaggaaggctgccaaaagctctgacggaactcctgcgggtacacgtctttaacagataactccaggcatcgtgcggatagactgagcatggcatttcttgatcaaccagatgataaccgtgtctcacaaaagacccgcgttgtaacctgaagccccccgggtacaaccccccacgcagaaacaccgtaaaccaaaacaaaaagggaaacaaaacaagaaacccaagaacaaagaaacaagacgaaaaccagaaaaagaaaagcaaacaagaaagaaaaacccaaagacacgaaaaaaaaaacaccgaaaaaaaaaccaaaacacagcaaaaacgaaaaaaaagaacaaaagaacaacacaacaaacacacaaacacagcaaaacaacaaaaacaaaacacaaaacacacagcatcacaacaacagacacacacaatagatcaaccaacaacgagacacaaa

SEQ ID NO: 517812 - DNA, 115 bp, Homo sapiens
gaggatccctatgccgaagagtactgaggatgtaagtccgtgggcgattatgagaatgactacgccggtgaagcttcaggggttggatgagaatggctgttactcttcgggcata

SEQ ID NO: 517813 - DNA, 346 bp, Homo sapiens
tcattatttaataatctgtctgcccacccccaagcataaggatgatgtgaagtaagtacacaagtacactcacagagcatgttttgcttcttgaggttagcttccataaaccaaactgatgtattgctgatgtgttatatctgtaaatattacagaaatggacatgccagatttctcttctttagcatctgctataagagaaaaactaggcagatgcctggaaggcatgggcaattgcaacttttcagtaagatatactgatctggttttaatttgaaataataaagaacattttttcttctctttggacttttttacctattaaaattggttccaaaatgttaaa

SEQ ID NO: 517814 - DNA, 818 bp, Homo sapiens
gttacaggaaagacttatgtcagccccagccctggggctacccgatctgacaaagccttttacattgtatgtgtcagagagagaaaagatggcagcttgggagttttaacccaaactgtggggccctggccgaggccggtggcctacttctctaaacaactagacggggtttttaaaggatggcccccatgtttgagggccttggcagcaactgccctgctagtacaagaagcagataagctgactcttgggcaaaaccggaacataaaggccccccatgctgtggtgactttaatgaatactaaaggacatcattggctaatgagtgctagactcactaagtaccaaagtttgctttgtgaaaatccccgtataaccactgaagtttgtaacaccctgaaccccgctaccttgttcccagtatcagagagccctgttgagcatgactgtgtagaagtgttggactcagtttactctagcagacctgacctccgggaccagccttgggcatcagtagactgggaactatacgtggatgggagcagctttatcaacccacaaggagagagcatttgcagggctatgcggtggtaactctggacactgttgttgaagccagatcgttgccccagggcacttcagctcagaaagctgaactcattgctttaattcgggccttagaactcagtgaaggaatcaaggatttcttctcgctttgtggccggattttgctactgcttgctcttcttactttacttatttctgtgactacctcatggccttaactcatttaaaatctccccaagcttatctgaacg

SEQ ID NO: 517815 - DNA, 531 bp, Homo sapiens
  misc_feature (517)..(517): n is a, c, g, or t
  misc_feature (526)..(526): n is a, c, g, or t
tactactactaaattcgcggccgcgtcgactgtaaagattgtaaatgatattaattaagttggctgtgctttttctcctcacaatggattcttttgttaggctggtaataatcgcgtttttggtaaaaacacctcatggaatttttttcctttctcataaaatagctgtttactgtaaaattgagatagcctctcaagtctggaacaccttccaattcatcaaaaagggacaacctaatattccaaagaagactcaatccttttaacacacatacattttagggccagtcaagagaagtggcctgttctgtaggaaaacatttcttggcacattattattttaagtgattgcaggagaccacagagggagagaaaagagacaacaacaacttctagcatgcctgggggatgacttgctctttcatatttgtggaaccctatgtcaagagagaaaacatctaaaaataaaaacgcatttactcagattctctagggcaaggtgcaaagagcctgtgcngtaggagcncagat

SEQ ID NO: 517816 - DNA, 189 bp, Homo sapiens
tgtcacatagtctcttttaccgatgatcttgtctttactggagtcattatggccactggatacaggtcaccttcacaggtgggtgcaccttcatattcggtctccacgagcagcttggtagtgggtcctattatgagggcatttcacagatgagaccgttcgcccccagggatgtgggtaccgagcgtc

SEQ ID NO: 517817 - DNA, 182 bp, Homo sapiens
  misc_feature (169)..(169): n is a, c, g, or t
tcggtactctagaggacccggcgcctagcacttccgtgtctcttgctgctttcttggcttcagtgtctggatactgagaaagatctagggtcaaactcggctgaacatgcagtcatcgtactcaggatagatgccgatcagcgcgtcgcgtctaggaactagaactctntcttttagggaga

SEQ ID NO: 517818 - DNA, 238 bp, Homo sapiens
ttataccgggctctgcactcatctatggccagcagcagcagcataagacgtaccatggctcccaggtctatgtcaccttacgccgttaggctatctacctggtggcaggagctggtggcgcctcaatacctggccacggccgccaacctcctgcgccactaccccacagaggaagcggagcaggcgctggacctgctctcagagatggaagagaacgagccctaaccggcggaatatg

SEQ ID NO: 517819 - DNA, 1073 bp, Homo sapiens
gcctggcgcattgtcgggactgtctggcgtatcggaaagcaagcctacgttgctcacgtatatacgtataatccttttctgctcaagatagcctgagtgaatgtgctaccagtgagtagaggaggtaggtgtgacgaccttttgccgttgtcagggcagaaatttgcccatactcatgttccctgcagtcatcatatactcttctatttctcaacagaggaagtatttacctgtcggagagtggatctctaaatgcttctgattgccttgtgaccagattcgctagtgaggatgcctagagcatgagcccgttcgaacgttgggacagtaggtaaacagaggcttgaagcattttgacattcattccccaatcccttcaggaacgtatccctgactttaggtagacacaggccagttggctagttgaccagatagcttgaatgctcgatatatatcacatttttagtggaaactcatctgtccatagctctggttactcatatacgcacttcaactggaaggactctatccagtgcttgtggtgccagcacaatactaccatgcagttgggggacatgattcgggctgtagggcctcttctagttccctagcccttaccttttgggtgggcaggaagcaacagctagagttggtgaagtcaccagaatgtcaagccataacgaattgcattgcaaccaagttaattgccttgagcgaaaggtcctatctggcttgtgaagcggtctaccgtattccaacttggtgtccgtgtcgtaggaacccaatgggatggcaagcccccaatttgcttggagggagataacccaaacatgtttgcaattccgtctcagtgcttttacacacgacggcatccaggaagaagaagttatgccttacgaaacgtaagcagtggccggtgctccaaagagggaacggtaagttgacccgtagaggccatttccttccaggattcgcaataggagcctaaatccccaattcgagcccttctgaaattttgggcgtgcacaggggaaccggaggtagagaaggcgacattgaggttcgacatgatg

SEQ ID NO: 517820 - DNA, 198 bp, Homo sapiens
cgactgagtaccacggcaatggtttttgctgcggcccattgcgccgtattaaatagtttagcccgtaacgcagtctcttcagttaaacggtccggtccttgatatgcttgcagtttttgcttttgtaacttgtcgcaaatcacgttttgtatgcaatcttctttatcgcctccaatgaatggcaagtcggcctcaggc

SEQ ID NO: 517821 - DNA, 443 bp, Homo sapiens
catagtagacacatatccagcaagtactggttatcatgattctcattttatcttctttctttttctctactcatcagctttttgctttcttccctccttctttaatctctggaataaaagggcagcagacctggagaaaagggatgcaaattgtcccatacacctattgggaacctcatcaaagagaagactgcagaagacagatgattgatgtttatatggcattgggacaggggcttgcggctggagaggggaggtgtgcagggttgtcttgttgtgcagataatcactcaggtgatctcagagctgctctcagaggaactaggcgaggccgcaggcactcctcttgtgtgtccctgggaccgttcctagatccctctaggcagataatggggcctcagagagagcttctgctcaattctgctgtaacatggtgtggatac

SEQ ID NO: 517822 - DNA, 276 bp, Homo sapiens
atctaaggatccctgtgtctgctctgactgattgtaattcgctcatccactgctgtgactgtttgaggaaagcaagtaactcctccgcaacatctgcttctctaaagcagcagactggtcattttcttctggtgggcggagcaggaatttcaaaaattgcatgaagcaggggcatgaacatctgttgtaaaaacggggatacctgtatcttgaatttggccgtaatctggttgataagaggaatgaactcctggagatcttttgcttcacaaaaaa

SEQ ID NO: 517823 - DNA, 334 bp, Homo sapiens
agccgacaaatgccttagaatccaattttggcctttgatgatgaacggacacttgggcctcttcctcaggtagatggtgtgcagacacagcagactgcataagtcatatgattgtttcttctgaagaaccaaagctgaaatttaatgataatttctacaattaatggaatgcctttcctgctataaaggagcatcccctccacccgttttctagagttcttgacatcttaatctggggcccaagcctgctagctagcgtggtcgacttgttaatatttcttgtagctataacctggtgcttaaaatgaaagcactctctagcggaatcatacga

SEQ ID NO: 517824 - DNA, 110 bp, Homo sapiens
catctataggatccccaccatgaccctgaactctacacaacatattttgtcgaccgagatcctacttctaacctccctgttcttatgatttcagaacagcacaacctggt

SEQ ID NO: 517825 - DNA, 137 bp, Homo sapiens
taccatgtaacgataatcggtttctggtggggtgtcttctttggcacttaaccaccttggatattcaacttaattgccctgttgtcacgaagtctttgactctctcaatttctgagacgctaaaagcttttcggtac

SEQ ID NO: 517826 - DNA, 220 bp, Homo sapiens
ggggggggtttccccccccttttcccccattttttttttttgggggcccccccttttgaggggggggggcccccccccccccccccccccggggggcccccccccccggggggggggggggccccccccccccgcgccttggggggggggggggtttttttttttttttttttgggcccgggtttttcccccctgggaaaaaaaagggtttttcccccca

SEQ ID NO: 517827 - DNA, 761 bp, Homo sapiens
ctcttactgcacataagaaaattcattacctgagtggtctaccgttgctttcagaaacattattaacgaatactgttcctgctcgaataatcaaagaactgtaatgcttttccagtgattaatatacattagactgaccattcactgattagtaacttaccatgtggttcaacgtgtgactctagtaaatacatgtgaacgtatctcttcagctcattttaacaccattgacttctgtgtccaccttctattagacatccgtattataattggtgattacaagcctatcaacttttattcagatctaaatagtagcgctaatgcttaaagagatctgtatgctatacggattataagaaagcctattctccattcactacatatatagatacataacttgctttacagtaagagccaatggggcaactgtgactcacaatatataagctattaacaatattgaatactatcacctagatgacactttaggtatctgcatgttgcaacgctgtttacacgttatcacttcaaaggatacttttttataagcctatcacggatgacctagactcttatttcttcacctatgtcctcatggctagttgactttaaaccattcgatctgcagaggctgtggcctttagcaaacgatgaatgtcatggttgaatccactttaacttcctgctttatttccacaagccccgcagtacacataggccggaatgcttccactgtcggcactcaccagacctctagggga

SEQ ID NO: 517828 - DNA, 164 bp, Homo sapiens
tccattcaaataaaacataataaaaaagtattaaggcgaagattaaaaaaatttgcattacataatttacacgaaagcaaagctatcagctcctgacatgctgggttttttttctgtctccccattacctcccaactaagttacatgttccagtgtggagagag

SEQ ID NO: 517829 - DNA, 221 bp, Homo sapiens
  misc_feature (16)..(16): n is a, c, g, or t
  misc_feature (39)..(39): n is a, c, g, or t
agataaaggccatacnattttgtctttgggtgacggggnccgcctggcctgtgcagggtttgatcccccccctttcggcggagctcgaggagcggatgcaccggtttgcccagcagcatcaggcccggcaggctgccttttagcccccccccctggcctgctgtcctgggtctatccatgtggaatgctggacaataaagcgagtgctgccccccctccca

SEQ ID NO: 517830 - DNA, 109 bp, Homo sapiens
tggacgccacatgctcccatcagtctcttccagaaatctctataaaccctactgtgtgccaatcacagttatttttcactatgctgaatcactattttattatattttt

SEQ ID NO: 517831 - DNA, 104 bp, Homo sapiens
gagtatgtactaaatggatgtacctaaatggctgtacctaaatggctgtacctaaatggcaactcgtatcgccaaatccagcagccattacagccatttaggta

SEQ ID NO: 517832 - DNA, 319 bp, Homo sapiens
ccagccaacctcttgggtcagtccaccatcgggtggggtgggggtagagtttgaagtccttgagagaggattatgatgcgactgtgagtgcgtcactgcactccagcctgggcaacggtgagactctgtctcaaaaaaaaaaaaaaaaaaaaataaataatggggttgtcatttccaaataccttaaaggacctaggtgtcaaaatggtccctcaagtaaaacccaccacaattctgacatacatttatttaaaaaaaacgcgtgggagggggggggctcccttgggggggccactgaacacccacccacttcccggtt

SEQ ID NO: 517833 - DNA, 707 bp, Homo sapiens
aaaatagaagagtaacatgttttatatttttttttgaaaataattatttttaaaataaaatagaagagtaacatgttttatatttctgcaaatattttttatttctggcttaatagaagacactagattctgatatctgcttctgtatcctatctgttgttatatgctgtttggttgaagtctgtgaagaaaatctgaccccactcatatataaagttggaaaagggaggagtattttaatagcttgtctgataattatggatactctctttgataccacaccaaaatatgacaagtagtagagttccttaaaggctagttgcaatgtggattctgaaatcgtatgatgagcttttctaaagtccatgggtgtaccttgtatttaaatagaacttttacctatgtgtgatatttgtaacaccagtccagtgattgatcattcggaaaatattggttcactgagttatgcaaatcttccaaatgttgacaccattttgatattaccaatatctaaaacaaaataccattaattaataatttaccaacaatcccattacaaaagtctaagtcttgaggaagctataaggcacagaagtgtattccaggcttcccaaattttaggtttcctttggaagcttgagttttatccttggcaccaatggcatcaggtttttcccaggcggccttgtcctttttggaccaatctc

SEQ ID NO: 517834 - DNA, 1130 bp, Homo sapiens
gggcggcggctgcagctccggtcgagccgcgcgcgcttgcgaccccgctccgcagcccgctagtcgcccccgagtcaggccaggccccggcggtggctggctgccgaagatggaggcgagcacagcaagacacgacatgctactccgaagaacacacggtgggagcacaggaaccggccgcaacgaagagactaagacaggtagaatatcaacacgccgaaacgagtccacgacaggcggacgtacggccacaaaccgagggcagaagccaggccagaccgaccagagcggcaacaaacgacaccagcacacgacacacgcgccacagggaccagacgcaacgcgacacaccgagagcagcacaggcatagacgcaatagagccaaagcgaagccactcacaacaacaagacgaagacatgccgagacaaacccaaacagcaatgcaagaaccagaaagatgcaagagagaagcacaaacgacacggcatcccaaactgggacacgcaggagcccgtacgcatctaaaacgatgggcgcgaacaacgcgcagaagaacggcaagaaaccgcatgcgcaagacatcacagcgaatggccaacagagtgcacaatacaacacgccgaaaacgcacccccagagtcaccaacccggagaaacggacaacacaacgcaaacccagcacccctgtgagcgccacacgagcgccagaaaacggagcacacagcacacaagaaggaccacaaccaacgagacacacgaccacgacaaagcaaacgcccagaaccagacacgtaaacaccatgagaagaagaaaccccaaccaaacatacagaaacacaagcatggccaacacgcgagaagcgcccacgcgaaaacgaagaaccacaacgaaaaaccacggaccaacacaaaggacagacgaaacaaaccacgaagcggcacacgagatacaggagccgaggacgcacgacagacacaccgacaatcaacaaacgaaggcacaccagccacggcagcaaagagacaaaacaaaagaccgacacgaaacgcgcaccccacacgcacagcgcaccaaccgagacccgacgcaacagaacaccccacagagcaccacgctaaacaccgccg

SEQ ID NO: 517835 - DNA, 101 bp, Homo sapiens
cttttccgcccccctttttttctgcaaatgggttggaccccctggggtgggctttcccccgttttccccaaggatgggaaaaaaggcccctttccccctta

SEQ ID NO: 517836 - DNA, 1154 bp, Homo sapiens
cgttgttttggtcgcccgtgtgttcataatgctcctgttggggagctcgcgtgtgagacaaacacaccgcactttttattagggtgcgcctccctgtctatttcccgcttgtctcgcggtgggggggccggtggcgtccaaaggagcgcccacacaccgctactcaccaagtggtcggtcggtgggggtctcacccacacgacggggggtttagtttacttctattaacctcgctcgttttactctttttctctctctcacggggcggcacttcttttttgtattgagaaaaagagggtggtgtatttattcgaactatagacgttgtgttttctccctctcggccggttgttttagattcagcgcccccttcagtgctcccccctctctccccacagctcgggggttgtatatagagacccactcacacaggtggttcgccccactctcgtgcgttgctctttggtgacacacactggtcgctctatccgttgtcttctcccctcgcgcgctcccggcgcggttgatcagcgcgcccgctcgggtggaggcccccccgctgcttatatttttgtgggctgtttcttcttgtcccccacaaaaggaatctttctgtgcggggcgcacatcaacacacacaggctcccctgcgtttgcacccggagcgaccaccgtgcacacacaggggtctatgtgttggtccctccacacatgcacagcagggtggtgtcttctccccggctgcgccaccccgcgcttgagatgaatattgtggggcggcaccaccacccccgcttgcccagcggggctcaccttttgtgcggtctcctctctccctgcgctgtgttataggacgggcggctaggtggctcattcggcagcactctctcctcattggttcccaccacccccgtgcgcagcacacggaagaagagtgcttttctccgctagcagacagccccatcctggtttatgttgtaaatattattccacacgagtgttatagcttatagcagaaccccgggaagaggacaagagggtggcttccccatggtcccccaaattttttttgtccgggggggtttataaaattttgggggggaaaccccccccggggaaattttttggaaacggaaaaaaatttttttttttta

SEQ ID NO: 517837 - DNA, 833 bp, Homo sapiens
  misc_feature (48)..(48): n is a, c, g, or t
aaggctagtagaggctggtgttaatcggccggcggctcgcgcttaggncgtgcactgcccgcccgccgctcgctcgctcgcccgcgcgccggctgcgaccgcagcatgctgccgagagtgggctgcccgcgctgccgctgccgcgccgccgctgctgccgctgctgccgctgctgctgctgctactgggcgcgagtggcggggcggggggcgcgcgcggaggtgctgttccgctgcccgccctgcacacccgagcgcctggcgcctgcgggcccccgccgggttgctgccgcccgcctgcggtggccgcaagttggcctggagtgctgccctgttgccatgcgcggagctctgtccgggagccggtggctgcgtgtgctgctcgggtgtgcgccctggtggagggcgaggcgtgcggcgtctacaccccgcgctgcggccaggggctgcgctgctatccccacccgggctccgagcttgcccctgcaggcgctggtcatgggcgagggcacttgtgagaagcgccgggacgccgagtatggcgccagcccggagcaggttgcagacaatggcgatgaccactcagaagggaggcctggtggagaaccacgttggacagcaccatgaacatgttgggcgggggatggcagttgttgtccggaagcccctcaaagtcgggtatgaaggagctggcggtgtccgggaggaaggtcacgtgagcagcacccgggcagattgggcaacgggtgccaagcatcaccttggcttggaggagcccaagaagctgcgagcacccccttcaggactcctgccaacagggactggacaggtctg

SEQ ID NO: 517838 - DNA, 506 bp, Homo sapiens
caataggggttgggtatattggggtgctatggttagttaggaggtctggggacatgggcctgagattttccagataggtcggaagatgaaactgtctatcctgggggtgttgatgacaaatctggcagccataaagatgattctatgatgctataatttttgaaatatttactgtagaattttgtccaccctccctgtccacatacacactagcttaggttaattagaagagcaaacagaattaacagtggcatcatggtatctggttgggtcttagagtagcttctatacccaacaagcccacaggagatgtttcccaggaggaggtggctggttaaagccatagaaaggaagtactacagtcaggaagaagagcaagatcaatgctcctattcccatctacagcattacattacctcttctggctgagtgttgattattttaaataggtagcagaggtcttccaaagctttactgatattggttgtggttgtagtgcccttcct

SEQ ID NO: 517839 - DNA, 310 bp, Homo sapiens
ggctgatctacaggatccttagcttttaccgcacatttaagacaggtgatgacactgcccagtcctttcaactctgtctcctcagttaatagaaaggaaacatagcccatctatctggacctgtgtagaagaatttggaggggaaaaaaaaaaaaacaggcaaaaaatgtccccttatttggtgagctacctttattctgccccatggtcctacagcaaagggcttatataaaatattttccagtttccctcatctaatagggctatattaataaatttattaagagcggtaaaagctggggtcccgagc

SEQ ID NO: 517840 - DNA, 425 bp, Homo sapiens
aatgcagcggactcggcagtgcgtagccactgcacccagcccacaagttgtctttttcatatagtggctgcctttcctttgggtagatacccagtagtggtgattgcttggatcgaacggtatatctacttttagttctctgaggactctccatactgttttccatagaggttgtactaatttacattcccaccagcagtgtgtgagtgttccatttgcaccgcatccacaccaacgtctatggttttttttgaatttttatcaatggccattcttgtgggagtaagatggtatctcattgtggctttcatttgcgtttctttaatgattagtgatgctgaccatttttttcatatgtttcttggccactggaatatcttcttttgagacatgtctattcatatcattgggatgcttttcggtgg

SEQ ID NO: 517841 - DNA, 856 bp, Homo sapiens
ggggaagggtgttgaatgtctgcccccctcgtggggggggttccccccatggggaggcgccatgattttcgtccctggcacaaattctatcggggaaggggaccacaactcgtcggaagaccgatcgacatgcgctttcgcaatggcggggcagaactgcctcttctcgcgcggacaccccctgcgttagttttttgtcatacgcgggaggtatgttggttacccacacgcgcggttgccatcagaggagtgccccgaccctcattgatattcggcccgccgatctcaacaccggttcggggccacttcttttctgggcgcgcgcacgacacggcgctgcagtgcccaccgcgcaatcgatggggactcgacgccagccgtgcggaggacaccacacctcgcagcgggggagggaccccaccccaccctgcgaggcacacccgcgcgagcgtgcaatgcaacacacccgctttttagacgggtgcagcaccgacgcggcgatagagagataaaaggagggaagaattcgcggggtacacaacacccgaggaaggtcattccatagcctgcccacttgtgtgttccaccaagggacgacgcactggtcgacccaccgcagggggagatacaagcaggttgcgtcccgacgcagccaaaaaactttgagtcatacacatgatggtcaaaaggtggataatagttgtggataaccatcctgttccaccttcggtggaccatctaccccacatccaccgcctttgtttaacaaagagagggatggaacccacgtcatgatgtgtcggtggtaacaacacattcaagagtatgatataaaaggggtgcgccccaaaagaca

SEQ ID NO: 517842 - DNA, 185 bp, Homo sapiens
tagttgtaaatgatgagagacatatatctccaccctcacggagttgtcatcaacctggagaggaagaagacagccaaaagagagaagtattgtctatgtagacttactagattcacatagtatcatccttctccagatgtgtataggtgtatgtcataaatacggtccagcataaagtaactaca

SEQ ID NO: 517843 - DNA, 248 bp, Homo sapiens
aaccagactgactcctaaactgatggaagatcatgtaaacaaaaggatttttcccctgaagcattgaaaaaagcaaatatcacctattgagtacatgtatgaagaagtgccgatagtaaatataaaaattcacatctagatcaatgtcctaatagtagggaacttgacaaagaagatcagctagttgcagaataaacatgaaatagctcagaccttgccagacagcaatcattaggggaacgaatcta

SEQ ID NO: 517844 - DNA, 139 bp, Homo sapiens
  misc_feature (89)..(90): n is a, c, g, or t
ttatactattctgcctagcaaactcaaactacgaacgcactcacgccatcataatcctctcgaccactaatagcttatgatgactaccnntattaaacctaactgggagaaactcctctgggtgctagtaaaccacgtt

SEQ ID NO: 517845 - DNA, 930 bp, Homo sapiens
tcccccggagttgttcgcgaccgccgtgtcggtgtgtgttttgggttgatctagacccccccgccccgggggcggcgggggcgtgccaagcaccacctttcgtcgcaggttgtgcccgccaggctgggcgcgcgctgctgtcgtcttccacagcccgcctcgtcttgtgtgtgccccccccccccctggggggtgagcacgtgggcgcccaccacacgcccacccggctgtcgtctccacccccccacgcagcggcggctgtgtcgtttgacgccgcacctgccgctctcccgcgcgcgcgtgggtcctcgcaccgccgaagtccccccccgctggtggtgcttacgcaacgccggcggcggcgccggtgtggtgggtggtctgcttctggccggtgcgtgtcggtggtgaagctgatggggcggctcgcccacgccctcccgcgccccgccaccctggtggggggcgcccccccgggccgccccacctatgatgtcccactcctctctctggggtgtggtcctcacggagacgggctctcgcctctcgtttgttttagacagccacgggaagaacctctttggttttttgtgttgtggccccgccgcggtgcccgtcgatggaggcccccggtctcccacgcgtggtttttttgttggtgcccccgtgatgtagcccgcgccaatgtgggggcccgccgcccccgccgccccgcccctcgggccccggggtggcgttgtcccctcgctggggcgaggtgttgagccgcaccggagggggatgtgagagttgttttttttggggcttttttgttttttttctccccccccctccccccccccccccccccccccccccccccccccagtttttttccccccgcggggggttttttttttttcaaaaggaaaggaaaatttttttttttta

SEQ ID NO: 517846 - DNA, 181 bp, Homo sapiens
ttggcccaggatgtcttcaactcctaagctcaagcaatccaccccttggcttcccagtgtgagatacaggcgtgagcatcgtgccagaccagctgagcatctcggagagctgcaggtggggtcatgagtcctcttacccaccagagccaggtactgccaccaccatcaaggtcgcagcagg

SEQ ID NO: 517847 - DNA, 612 bp, Homo sapiens
gaataggatcgagcgaggagcccaagtagcgagcgcgcgagatgaagctcgagccgcctccgaccgtggccgaccacacctcggcctgcctgcactgacctgcggccgcgagaatccggccccggcctccccgagagcgagccccggacggcgagaacaacaagaccggagctaacccgccgaccaaaacgccaccgaggcagcctgagcggagagcaaaggagggagggagggcaatgaagtgcaggccggggcgaagggcgcacgaacaacgcaagcgaggcgacacaacccaatccccgccgggcatacacggcacgggagcggcgagaccaggcgtggacgaaaacaacacagggaaccacagaaggccacaggaaagcgccgagggggcgccaggagagtgacgccaccgcaagagggcccggagaggaagaaaccagagagggaacgaaggccgggaacccaacgcaacgaacaagacacaaaacacccaccacagcaaggagaaaaaagaagcagagacaaccacaaaaacagaacaagcaggacacacccaccagggcgagggcccgacgaccagacgcgaatggagagcaacagggcgaaacc

SEQ ID NO: 517848 - DNA, 316 bp, Homo sapiens
gtcccttgcctttttaaaagcccccccctttttttttaaggggaagggcccggtcttttcccaagtccccaaagggggggggaaagcattgtttttgtgtaaattatgtaaagcaaaatttttttaattttcgcccaaaaactttttttttttgtttttttttgaaaaaagagccttggggcccccccttccccctttttttttcccccaaattaaaaggtaagaagggttttggtttccctgggggggggggggggcagccagggttttctttttccttttttttagaccggtttaataaaaggggcccccttta

SEQ ID NO: 517849 - DNA, 355 bp, Homo sapiens
ctctgcaggcaatagtaacacaagggtaagcatataagtatctaaacatatctaagcatagaataagtacggtaaacgtatgctatgacaatcttatgggaccacggtcattaagcaaaacgtgatgtggtgtcagactgtatatttaaagctgaagtaaatatcagctcttcagaaaatattgtcaggctattctatggaatttatctcaggttacaaaagcagggatagctataaagagagtatcctacgtctggagattggatctgtgcagtggacagctcttgccatgcccattcaatctttctccaaaaagctacatgcaagaaaggacacaaaatccttcattcaacta

SEQ ID NO: 517850 - DNA, 194 bp, Homo sapiens
gatctgacactcttagataagtatggttcaattttccatagatgggagaatatctacgagacctgacaacttgtattgtcgttcttaccttatccaataatatatcttcatttctatcgaaaattttatgatgaccgtattcctctcttgcatatacgtttctatttgttagcaactccatttagtatttcttt

SEQ ID NO: 517851 - DNA, 775 bp, Homo sapiens
tgagcatcttgtgcttccaagggctgcatcaagtgctgaagcgccctgcccggagtgactggcgtgcgtctacgtgaagtgaagtgctacttcttttcctgaggaacccagagactggaacacaggcaggcagtactgccactagccactgaggcggtgctggctgtgattcagagccagaatggagctggaatttatgttcaatgttcacgcaggagggagccctggatttggactacagcagagtttggggacgaattccactgaggtcaactggtggacccgtatatgatcctggacactgttcaccattcgcaggtccagtggtgacgttgtgctcttcggtgagagcccaaccaggcctggtagtcagaacggatgtgctctgactgaccacgtgaccttgggggtggtgcacggccaaagatgtgccctattacctatgaagagctggcgctgcgaggcccaagacgcgattggcaccacggaggcaccttactcgggcacatcaggtaggcacgaaagagggctatggcatcagttgggggattgggtatccattgtcattacacaatggaaacgccgattgggcctaatacactccataagacacggtggataggcgaaccacggaccatctggactctactatccattggactataaacgcggagcagcaacatagccagacttgctaggtagatatatagacaggtatggggaacaataacaaaggacgcactcaaatgtgacgccccacctatcaattcacacg

SEQ ID NO: 517852 - DNA, 798 bp, Homo sapiens
ttcggcgagggagtgggaggctgtagggcgggggaggagggcggggagtgagcgccttcctgtgttggtgccctgccctgagctgccaccgggaagccagcctcagttgactgcatgcgacccccaaacacccctcccccagtgatgtctggaggagatcatcacgccggtgtactgcactggtggtgtcagcccaatgtgcatgaagcagctgtggccatgtggagctgtgagcctgtgtgcctgccatgagaatgccatcaatgtacctgagtgccaggattatgagcatgctgcagtgtgtgcgatgcctgcagagtggttgaccctcttcctgtgatgatgtgccttccccccgtgtaccccagagcctggggttacaaggacctgagtgtacccaatatcactccaaagacctaatgagcatcaatgttgtgaatgctgtcccactgtgaacttgcttgtcaaacccccagtacattgtgggaatggagctacccgcacagacatctagccatgtggagcactggtgggactgctggctcttggctggccatcgcctccctcactctcaaacgacaccctcctgcacccgaagtggttccgcacggcatgagctttccagaattggctatgccgggaatcttccatttccagctgtggcaactttggggagtggttggacctggtcgtggatgactgctgccctccaggacggaagctattgtcgtgcatctgcgaggcaagaatctggacgcccgttgagaggctttcaggaatggagaaaagccgtcgggc

SEQ ID NO: 517853 - DNA, 305 bp, Homo sapiens
tggcacgccgacactccatctcctccctcccgctctacagaaacccctttgctgtctggtcattcggcgtgtgcagtctggagacccgaggatccacacctggttaattttgtatttttggtagagacagggtttcaccattttggccaggctggtctcaaactcctgacctcaggtgatccacttacctcgccctccctgggattagggcgtgagcttctgcgtccagccaccatctctaaatttttaacaaattttcttgtctggagtctcggcgtgtgcagtgtggtcgttcggcgtgtgca

SEQ ID NO: 517854 - DNA, 308 bp, Homo sapiens
tactggaggaacagtataattctagtgcatattgtgctattaggcgctgattcacacacacacacacacacaacaaacacacacacactaccaaaaaatgatcaccagaaaagacatctgtaggccctatccgtgaaaataaacaaagtcttcacaatgacccttgcacggaagctactattttacatatattactgagcaaaacagagactgaaacattaaggtaacaaacgagggggtaacaagaattgagattctaatccagaaactactagattccttaaaaccagctagaagggcaggaatac

SEQ ID NO: 517855 - DNA, 850 bp, Homo sapiens
attcatgatgtcaatggaaccacaggccaacctgaaagttgtggagaacactagtgctgcgcttggatcgatcctggcgtgtgtatcattgccacgatggttgtctagagactttggtggataattagtggaaccgatgtttacgtgattagttagagcgtaaagagataatggaactccaagccaccatccatgttcctgcaaaggacatgatcataaactttgtgcaaccactttttatcgtgtcgccatagtatcttccttttctagaatgtcatatggaatcactatagtatgtagccttttcagactggcttctttcacttaataatatgcaactcccggttcctccatgtcatttcatggcttaaatagtgcatttattgggtagcactgaagtaatactccatgtgtctacgatgaatagtttatccatatacatctatcgaaaggagttcttggtggtttccaagttttggcaattatgaataaagctgttgtaaacatctttgtgcaggtttttctatgggcatgtttttaattcatttgaataaatacccaaagaggcttcaacgaaaacacgagaaacacacacaagaaaacacaaacaagagaaaatatataaaaacacaacaacaaaaaagaaaaaaaaaagaggtggacgccgcgcacgcagcaaaggaaacgacatcaacaaacacacgcgggggcgcgcgcgccccgggaaaatgagcaaagggtacaaatggacaaccaagaaacactggaaagaggggtgaggtttcacacaaacaaacagcggggccacgacgctaacaacagagggcggcagagggttaagggaggcact

SEQ ID NO: 517856 - DNA, 311 bp, Homo sapiens
  misc_feature (23)..(23): n is a, c, g, or t
  misc_feature (85)..(85): n is a, c, g, or t
atacaaggtaactaaagcatgtnttctgtcctctgtagctcacattcacagcagatagtcacaagtactctgtttagtcaatttnctgctgctataacagaataccacagactgggtaatttatacagagaagctatttatttggcttatggttctggaggctgggaaatccaagactatagcaccagtatctggtgagggccctcccatggtggaaggtgtgaggaagtgagcacatgagacgagagaaaaatgggagttgaacttttatcaggtgcctactccaaaggtaactttaacacatccccatg

SEQ ID NO: 517857 - DNA, 679 bp, Homo sapiens
ggcgaagagagtcccctgttcaatcagcgctggtcccagtctctgatggctctaaactactttgtagcggctctacagcggagtccgctgtctggtgtacctgccgtagcaccggactatcagcatgccctacaacgtgatcggacctcacgtgcactgtggtggccgtgtgctaaggctccttagtacaatctcctcacccgaaccttccacatcgaggagccccgcacaggtggcctggccatgcggctggcctaccttatccggcgcgcccgaggtgtccccccactctgattcttgccctttccagcagctgcagcgtgccgtttctctctggggaggggagcctcaagggctgtttctgcacacttgctctccgtcagagtctggctatgttgaaccaaagtgcccctggaaccagcgatcagggcctactagctgtgttgtccagtaacaggagccacgagcacaaatgtggcatttgaatttgaacttaacttagaaattcatttcctcacctgtagtggcctacctctatattgaggtgctcaataagcaaaagtggtcggtggctgattgtattggacagcactagatatacgtatttccatcacaacagaaaggtcggctaggcagcactggccaaggtgctggagtgtactgcccagtgtatgtcacc

SEQ ID NO: 517858 - DNA, 697 bp, Homo sapiens
  misc_feature (129)..(129): n is a, c, g, or t
gcagccttcgtggccgctccccatttcctgcgctgcgtccggagcggcccctggttgcctgccacctgcctgtccccctccctgagtgccctggtgctcgctgacggcagagggctcctgtctggcccnaaacctgagctgggctgccctgctgtgtcctgtgtgtgcatggcctccactcctgctccctcctagggtcgacctgccttccccctgttgctcccccatctggacctgatcgttgcctgccccttttcccccttaccggcgtatcgtccatcgttgcattccccacgccgtgctttgcccctccccattcatttctgcgccctcttccctacgctggccccacatggtgcgcagctgccgcctgggcgccatctgcaattcacacactttgtacacgtggcctctaaacacttcttcatccacgtcgtgtttttcgcgttcctcctcccgtactaatacggtcactgcgactaacagcgtctctgcctgtctacaaacacaagaccaacacaccacaacaaacaccaatcactccgtgataactagtgcattcagccttcacctgttcactttactgtacaaacaaaccagttttattatccaacggacaagaacccaacataccactaccatcaaacctagaacaacacagccacagaacacctgatacatactacactccatccta

SEQ ID NO: 517859 - DNA, 496 bp, Homo sapiens
tctccctcttttccccctctgccatgaagcaatcatgctgttctattgtaaaagaggatcccttacttataaagccaagcttgtcatttaaattcactcaagttaggacaccaccgagctctgtcagatgtcagtctcaattcagcaggagaatgtttttcaacagctttctaacctctttgccgggaaacacagaggcttggatcaagggggaggggcagctgactgggcttgaaggatttttacagaggcaagattggaatttttcatttcaggcaggttttctttttctttacgttttcttattattattttttcctttttccctctaagcctcgtgtaaaagatattcccacaaaaagagagtgaaaaaaagtcagattggttgtaaggaccacttcagttgagggtctccttgaaggtatttaaacctgggagtgatgttggcatcttttctgcattaggggtattggctgtttgccaatcatttcccttg

SEQ ID NO: 517860 - DNA, 445 bp, Homo sapiens
  misc_feature (2)..(2): n is a, c, g, or t
  misc_feature (32)..(32): n is a, c, g, or t
  misc_feature (54)..(54): n is a, c, g, or t
  misc_feature (142)..(142): n is a, c, g, or t
  misc_feature (286)..(286): n is a, c, g, or t
  misc_feature (372)..(372): n is a, c, g, or t
ancggaagaaagaagcagcggcggaaccgacncacgttcaacagcagccaactncaggcgctggagcgtcgttcgagcgcacgcacttaccccgacgcctttgtgcgcgaggagcttgcccggcgcgtcaacctcagcgatncgcgcgttcaggtctggtttcagaaccgccgcgccaagttccgcagaattgaaagggccatgctggcaagcccgctctgcctcgctgctcaagtcctacagccaggaggcgccatcgagcagcccgtggtccccggcccaccgncctgagtccagattatctctcctggacagcctcgttcccctacagcacagttgcaaccctacaggcctgggagcttcagggcccgnaaacccaaggggttcaaacatgggccaacaagcatcggcaagccttccgtcttcaagggccaaagggagttta

SEQ ID NO: 517861 - DNA, 149 bp, Homo sapiens
cctagtgcacacatagaaaaggacactagatgacctgacgagaaggtggcaatctgcaagccaagaagagggctttcaccggaaacaaactcttccagatcttaattgtggatttctagcctccagaatggagagaacatgtggcattt

SEQ ID NO: 517862 - DNA, 434 bp, Homo sapiens
  misc_feature (23)..(23): n is a, c, g, or t
  misc_feature (50)..(50): n is a, c, g, or t
  misc_feature (136)..(136): n is a, c, g, or t
aggggactgagcactgcaagatntaacctgcccggcacatgctctgcctntatcccagcacggggaggcaggcagtcattgacgtcaggatttgagatcagcttcgccactgggcaaaacctgtctctataaaatntaaaattaaccggactgttggcgcccaccctaatcccgctactgggaggctgagacggagatcattgaacccaggaggcagagttcccgtgagcagagatcgtgccactgcactgcagcctgggcaacagagcaagactccatctcaaacaaagaaaaaattagccggatgtggtggtgcatgcctgtagtcccagctactcaggaggctgaggtgggaaaattgcttgaaccaggcggtggagccaagatcacgccactgcactccagcccaggtgacagagcgagactcggtctcc

SEQ ID NO: 517863 - DNA, 1073 bp, Homo sapiens
ggatcccaacttcccgtgcacatccgaggctggcttcataagcagacagccgcgaggagagtgtcctagtgcagcgtcctgctcccacagactacaatattagaccagatgggccgggagcccccctgagggctggcgcattcaccttcaccagcagagcacccgggacatgatggacctacgtatttggccgctgacaccttagaagacctgcggaggctggctacgggcgctgggccgtggcctcccagatgcggaggagggacgactatgggcaacccatggtcaagctgcacgaccaccagcaccggggagggcccacggcggcacccggtggtcacccccggaaggtgagcaagaggggacagagggagccgcaatctcacgaatccacccggaacgctgacctcggacctcatccaggacggtccaagggaacagacaccacaagggcctgcatcagcgtcccaagaccccaaggcaagcgcgcacccttccaactatctggaaccatcgcagaattagacgggcacagcagccgaaggaaggccccacgaaccgtagaatacaaggaccagccgccaacgacggaccgaaccccttcacaggcgaaaggcaccggcaaaggagaacaccgaccaggcggcgccgcccgcagcgcgggggcacgccgcgcacgcgcgccgcgcccgcggccacagcgacgacacgagcgacagacacagacagccaacaacacaacgacaggaagcagcacaccgaaaacggccgcgagcggaggcgccaacaagcagacgacgacacacgagaggacgagcgcaagcgacagcaccaccgcgcaagccgccccgaagcgcccaagaacccaggaaaccaagacgaggggggaaaagccacaccgaagagaggacgccagcggaaaggggggaggcggggcacgagaggcaagagccaggaaagcgggcggcacacggggcggcacgacgcgaacgcgagagggggagacggacggagcgcgagacggagaagccacgccgacggagccggacgaaaagagcggcagggaagggaac

SEQ ID NO: 517864 - DNA, 200 bp, Homo sapiens
tatcttaaaaattaatggagacccaaagagctattgcttatataggtaatagttatctagtagttaccatattattacataaataaaacctgggtatatacaaaatatttatgaatttagcaagtaaaatagccaactctatattaatggcaacctatttcaacatatattttccccaaccaaaaataatatttgtgaga

SEQ ID NO: 517865 - DNA, 640 bp, Homo sapiens
gggttatagtgggagaggggtcagcaggaaaccatgtgaacaaagatctctgtgtcataataagtttaaggaaaaggtcctgtgctttaatgtgcacgtacacaaacatctcagttcactcatatctcagtaaacagaacatacaatcaggttttacaccaagacattccattaccagggacgagcaggagacagatgccttcctcttatctcaactgcaaagaggccttcctctttcactaatcctcctcagcacagaccatttatgggtgttgggctaggggatggtcaggtctttccgttcccacaaggccatctctcaggctattacatggggagaaaccttggacaatacctggctttcctgggcagaggaccctgtagccttccacagtgtattgtgtccctgggtacttgagattagagaatggtgataacttttaccaagcatactgccttcaagcacttttttaacaaagcacatcctgcacagccctaaatccattaaaccttgagtcaacacagcacatgtctctgcaaacacagggttggggctagcattacagattaacagcatctcaaggcagaataatttatcttagtacagaacaaaatggagtttcttatgtctacttctttc

SEQ ID NO: 517866 - DNA, 234 bp, Homo sapiens
tgtcgactctgtaggaccccgagctgtctcaagatatgctctgtgggagcattcatcgggagatgtacaggggcagatcctcagagtcaaccacaccacgtataagatggagatactctggtactcaactcatcacagctgtccataatgaacacacggcggacatagagtccgatgttgttctatttcttcttgttctcagaaaaggtcagagggagcccgtacgagtacact

SEQ ID NO: 517867 - DNA, 242 bp, Homo sapiens
  misc_feature (107)..(107): n is a, c, g, or t
  misc_feature (125)..(125): n is a, c, g, or t
  misc_feature (134)..(134): n is a, c, g, or t
  misc_feature (157)..(157): n is a, c, g, or t
  misc_feature (164)..(164): n is a, c, g, or t
  misc_feature (173)..(173): n is a, c, g, or t
  misc_feature (180)..(180): n is a, c, g, or t
  misc_feature (188)..(188): n is a, c, g, or t
  misc_feature (230)..(230): n is a, c, g, or t
cccttttgggtttaatctttccccttgacccagaacttcctccccccaaaaatgcctttaaaacccttcctgaggcttaagcattttgccccccttactaactgccngttttccagccctgaggnggggcaaanaacggggcatatttaagggggcntctttgngtaaaaaangcatggngtcagganaaaccccccttcataaactgctttgggcaaaaaggaataaanccttttttccca

SEQ ID NO: 517868 - DNA, 287 bp, Homo sapiens
tgaatgtttgtgtcccccaaaaattcgtaaatgaactcttcatccctaggcaacagtttaggaagcgattaggtcctgaggactctggccctcttgcatagaattagtgctcttataaaagatgcccgagggagctcttttgcccctcctgccatgtgaggacacagtagaagctaccatctgtgaaccaggaagcccccctcaccagacactgaatctgctggagccaccatcttggacttcccagcctccagagctgtgagaaataaatgcctgttgtttaagct

SEQ ID NO: 517869 - DNA, 658 bp, Homo sapiens
caaaaattcctttggggccaaagcattcatgtaaagggccagaatttacaaggctgggaaccaggataggtgggatattccggggacccctcaagcttctatggctttagagaagggaagaccctcacagtctctttgagtagagagagtggcattcttctttatttctcgcagatctccacagagttcacattctaagagacccgttaataaacacaccttatcctgcctcaatatggcaatattggaatatgccttaattattagaacttggcagaggctggggaaaatctatagagggaaagagaagtcaattgttttaggttttaatgttcccaccaatccaatggtgtggcctttttccatttttccagataagaagcttgagttttagaaaagacagtgatttcagacagtcccactgagtaagcagcataactgagttttcaactgaggtctacgtgcccactaaaagctgtgcattttgtacaagttcaccactgtttatgcacgtaggtgtgtatggaaggtggttattgagaggagagaggagagtaagaggcaaagagttacacattttaatcctgtgttggcaaattttatatatatatatatatatatatatatatatatatatataaattgaactagttaataa

SEQ ID NO: 517870 - DNA, 150 bp, Homo sapiens
cgcagaagccacgtacagtccagatcccagcgtgtgccggcggatgcatgtatacgtagcaggtcccagcccgtccagggtagtgaagacgaacgtgatcccagagtcgtcgttcaggatgtaatcagtgtcgtgtttcggttacttggt

SEQ ID NO: 517871 - DNA, 265 bp, Homo sapiens
  misc_feature (216)..(216): n is a, c, g, or t
tgggtgggtccaatgtcatcacaatgttccttataagagagaggcaggagagaaagaatcagaaaggcggcagcatgaggaaggctcagcctgacattgctggcttagaagatggaggagtgaggccatgagcgaaggaatgcaggaagcctctagaagctggaacacacccctgctgacacctggacttgtacctagtgaaacccatttcagacntcagacctccaaaactgtgcagtaataaagctgttttgttttaagccac

SEQ ID NO: 517872 - DNA, 161 bp, Homo sapiens
tcccctggtcgcgatcagccgaccagcgcattcgcacagtacgggggttggacgcactgtttaacagcaacagcttgtcgggggagaatgtggatttttgccttgtgtcagattccgccatcagttgacgcctgtcaccggtatttaagcttatccgacga

SEQ ID NO: 517873 - DNA, 184 bp, Homo sapiens
cgatctagaggatcccgaaaacgacatagaggcaggcggatcacgaggtcaggagttcgagaccagcctgaccaacatgacgaaaccccgtctctactaaaaatacaaaaattagctggacgttatggcgggcgcctgtaatcccagcatacttggtgaggctgaggcagacagaatcgcatta

SEQ ID NO: 517874 - DNA, 110 bp, Homo sapiens
cgtagcattggtggccaaatgatctgatggtaaatggagggatcgttgacctcggtctgttatgtaagaggtatgcggttgggatgggagggtgatgaagactaggatga

SEQ ID NO: 517875 - DNA, 1317 bp, Homo sapiens
  misc_feature (338)..(338): n is a, c, g, or t
  misc_feature (354)..(354): n is a, c, g, or t
  misc_feature (358)..(359): n is a, c, g, or t
  misc_feature (363)..(364): n is a, c, g, or t
  misc_feature (372)..(372): n is a, c, g, or t
  misc_feature (377)..(379): n is a, c, g, or t
  misc_feature (385)..(386): n is a, c, g, or t
  misc_feature (416)..(416): n is a, c, g, or t
  misc_feature (427)..(427): n is a, c, g, or t
  misc_feature (435)..(435): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (477)..(477): n is a, c, g, or t
  misc_feature (479)..(479): n is a, c, g, or t
  misc_feature (638)..(638): n is a, c, g, or t
  misc_feature (655)..(655): n is a, c, g, or t
  misc_feature (658)..(658): n is a, c, g, or t
  misc_feature (672)..(672): n is a, c, g, or t
  misc_feature (726)..(726): n is a, c, g, or t
  misc_feature (743)..(743): n is a, c, g, or t
  misc_feature (749)..(749): n is a, c, g, or t
  misc_feature (753)..(753): n is a, c, g, or t
agtctctctccatgcccctcatctcttcctttagccctcgccttcttccatccatgtcttccaaggcctgatgcattcataagttgaagccctccccagatccccttggggagcctctgccctcctccagcgccggatggctcgtcctccatttggggtttgtcgtcctcttgtgtgtcactcttacttttgggtgctggggtggctgccagtccctgtcccgggacctgctgggagggacaagaggccctcccccaggtctgaagagcatgccctttgccgttgcatgcaagcagcgcctgtgtattccagcgtgcagatcccagcagtccgtgtgncggccgggttgccacngagnngatnncagaaggnctgannnggcgtnnaggaattgtggcgttgactggatgtgcccnggaggggtcgngggggccnctcacagaaggngactgncagtgggcncactcacatcccacngnctgctgttctgaaaccatctgattggctttctgaggtttggctgggtggggactgctcatttggccactctgcagattggacttgcccgcgttcctgaagcgctctcgagctgttctgtaaatacctggtgctaagcatcccatgccgctccctcctcnactgatgcacccaccgnccntgagggcccgtccntaggaatggatgtggggatggtcgctttgtaatgtgctggttcgtctttttttntctttcccctctatggnccttangacnttcattttggtttgtttccatcttgtatgtcgatcttatttagggtgctggggtggcatgccagaccctgtcccagggacctgcgtgggagggacgaagaggccctcccccgaggcagaagagcatgccctttgccgttgcatgcaagcaggcctgtgattccacgtgcagatcccagatagcctgtcggggcaggggtgccaatgagaggcattccagaaggactgagtggggcgttgaggaattgtggcgttgactggatgtggcccaggagggcggtcgaggggggccaattcacagacaggggactagacagtgggcaacactcacgatcaccaagtggctgcgtgtctctccaagaagaaacgacactgcaataaagcaggtcttgtacgggccagtcgtgcccaggggacggggagctacaagcagcctctgggtctgggtccggccaggaactcccgtttctgcagtggtgacttggtgccgtttctccacatctgtgctcccgtgccctcttgcctggctctttccctcggccaacttggctggccccatattccg

SEQ ID NO: 517876 - DNA, 1058 bp, Homo sapiens
  misc_feature (338)..(338): n is a, c, g, or t
  misc_feature (354)..(354): n is a, c, g, or t
  misc_feature (358)..(359): n is a, c, g, or t
  misc_feature (363)..(364): n is a, c, g, or t
  misc_feature (372)..(372): n is a, c, g, or t
  misc_feature (377)..(379): n is a, c, g, or t
  misc_feature (385)..(386): n is a, c, g, or t
  misc_feature (416)..(416): n is a, c, g, or t
  misc_feature (427)..(427): n is a, c, g, or t
  misc_feature (435)..(435): n is a, c, g, or t
  misc_feature (447)..(447): n is a, c, g, or t
  misc_feature (453)..(453): n is a, c, g, or t
  misc_feature (462)..(462): n is a, c, g, or t
  misc_feature (477)..(477): n is a, c, g, or t
  misc_feature (479)..(479): n is a, c, g, or t
  misc_feature (638)..(638): n is a, c, g, or t
  misc_feature (655)..(655): n is a, c, g, or t
  misc_feature (658)..(658): n is a, c, g, or t
  misc_feature (672)..(672): n is a, c, g, or t
  misc_feature (726)..(726): n is a, c, g, or t
  misc_feature (743)..(743): n is a, c, g, or t
  misc_feature (749)..(749): n is a, c, g, or t
  misc_feature (753)..(753): n is a, c, g, or t
  misc_feature (874)..(874): n is a, c, g, or t
  misc_feature (962)..(962): n is a, c, g, or t
  misc_feature (1052)..(1052): n is a, c, g, or t
agtctctctccatgcccctcatctcttcctttagccctcgccttcttccatccatgtcttccaaggcctgatgcattcataagttgaagccctccccagatccccttggggagcctctgccctcctccagcgccggatggctcgtcctccatttggggtttgtcgtcctcttgtgtgtcactcttacttttgggtgctggggtggctgccagtccctgtcccgggacctgctgggagggacaagaggccctcccccaggtctgaagagcatgccctttgccgttgcatgcaagcagcgcctgtgtattccagcgtgcagatcccagcagtccgtgtgncggccgggttgccacngagnngatnncagaaggnctgannnggcgtnnaggaattgtggcgttgactggatgtgcccnggaggggtcgngggggccnctcacagaaggngactgncagtgggcncactcacatcccacngnctgctgttctgaaaccatctgattggctttctgaggtttggctgggtggggactgctcatttggccactctgcagattggacttgcccgcgttcctgaagcgctctcgagctgttctgtaaatacctggtgctaagcatcccatgccgctccctcctcnactgatgcacccaccgnccntgagggcccgtccntaggaatggatgtggggatggtcgctttgtaatgtgctggttcgtctttttttntctttcccctctatggnccttangacnttcattttgttcagataccatgctggtgctagactaaagggtggggacgaggtgatagatgtggccccagcacggctctcaagcagaacgcaccttgcaataaaacgggtcttgtcggccnagctgcccgaggggagcggcatgctacgagcacgcctctgcagtccttggtccgccagcgacctcccgtcttctccgtggctgcttgngcgccggcttctctcacatcgtgtgcgtccgctgcccttcttgccctgcctctttcccttcgcctcaccttgcctgggcccccatactcnccccag

SEQ ID NO: 517877 - DNA, 932 bp, Homo sapiens
gtacaccgtccgttcacccccgtctcttccgttctgctctttacggtgttggaaagggatccatcgtccaggcaggccttcctggtggggcttgtttcctgaaaccatgatgtacttttatcatacatgagtcttgtccagagtgctattgctaccgtgtatcggagtctcgcatgcctccctcccgcgggaggtatctcctactatatagaaaattccgtactgtgggatttgtagacatattttcgacatcagggtatttgtgccacttggccaggcctcctcggagaagctatgtaccaccgatgtggaaaggagacggaagccaggactaggacatagggtcaattcagtgacctgctgcagatgtcgacacatgactagatcattggactacgttgccattttaagagcgtaaaatcggagactataccggaatcctgacaaggggttgatccacccaatgacctaggatagaaggcagactaggtagcgctagaacaagaccactgtggatacccgggacaccaggatctgtggaactatacccccttaccacttccaaggcccagggctatcctacctaccctgatacgtagaggcgtcatttgttgcaccacatgggagctcttcttacaagcaaccgtgcccttggagagacactaggcatcagcaaggcccaggaacgccagagacgccccttggaggtccccaggagagggggcacagagcgggccccgaaggggaaatgccgtggcgccgacgtgacaatcccacaccgcgtggagccagggcggcatgccagaggcaatgagctacattaggcacaagatccgaagttggaacccacagttgggccaaacactaaagggcgggaaagtgatcaccagcccaaagaagacacaacagaacacaaccagacgaagggaaca

SEQ ID NO: 517878 - DNA, 346 bp, Homo sapiens
taaggagcagagtggcattgttcatggacacctgtccttcatctccatctaggctagggaacactcacaagcccctccctggcctcattcctttctcctgcagtgtcaaattcagctttacggagtcccactttgagataatgcatccacatcctggggctgaaccctcaaagatgatgtttcccagttaccatttcatatctaaagcctggaagttttgtgacatgtccgaggcccccagccagcagctcgtccctgtcctaacttggtacgggtccagcatcaccgctgaccagaatatgacagaagggatctcagtgacccactcatctgattgtgtgcccag

SEQ ID NO: 517879 - DNA, 917 bp, Homo sapiens
gcaaagaaagttgttgaaaatgatattaactgcgagtgtaaatgcagaagacacatagtagcttctgcatttacactcgcagttatatcctagcaaagaaagttgttgaaaatgataagtaccctctggagtagaaaaaccggaagtgatgaaccagcctgtcatgtatatatgaatgatcggtgttatatggtttctcatcagcaagtaaaactgtctgaggacttacaataccattccagaggttcacaagaaatacaaggaagatgagcctctgtttacaagcagccttggggtccatcctgtgatgagcttgaatcaaattgtggaaagctgtcttcttcctgagctgaactgtgggagatggcttatctttgataacatgggagcagattctttccatgaaccatctgcattcctaatgattttcagaggccagacatttattacatgatgtcatccagctgattggtatgagatgcaagatgctggaaattacattcagcactcaactgatgaagaacatacttcttgtgccttctgcattcagctgagacaaagaagacagcataatccgatgagagctcccaaacaggcattcaaggccccaccccacaatccagaaagacgacaggtcaaggctaggtcggaacccaacatacccagggcatggcacaaataaaacaaaacaaaacaaaatactccacaactcacacggggcagacaagaacaatacgcacaagcgaatggcgaacacaacaagaaccgggtgcagtagccactcacggggacaacggcgaaccaccagagggacgcagaacacacgacaagaaggaacaaccacaactaactacacaagcaaccacagacgcaaggaaagaaccacaagatacccatcgcagacagaccaacgcgac

SEQ ID NO: 517880 - DNA, 363 bp, Homo sapiens
gagctcggtacccatccttcccttttttacgtattacatattttataaatttatcttggctggctcatctccctcactattatataagctccaaaacaaggatttttgctggtttggttactggtatgtcccaccgcctaaaacaaaaagtggaataacctaggggctcaaaagggatgtgttggatgaatgaaaactttaccaaagcctttttttccagggccaaggagaatttgtaaaaattttaagccccattctctcctttgggagcacaaattcccttttctggcttaaaacttcaagcctttttgttaacccgaatttttgccccccattttttttaaaaacgggccccaacaaagg

SEQ ID NO: 517881 - DNA, 289 bp, Homo sapiens
  misc_feature (25)..(25): n is a, c, g, or t
  misc_feature (111)..(111): n is a, c, g, or t
atagttcataagaccacagcatgantttcaattagcttttctcactgtgtgaagggggaaaaaaagaaaaaagaaaaatcagaccttggagaacagggttgttggaaagcnttttcaatgcctgcacatagttttttcaccagggcaaaactgcaataagatggagaatgggcccaagaatcaaatgctctttaagttagcagttctgatgttagttgtctatttgaagaaaagtgccacatggagagattatttgtgggttagaaatcttaggtccaagttcccagtt

SEQ ID NO: 517882 - DNA, 167 bp, Homo sapiens
ggtagtatgattaatagacattatgcctgatgagcgaagtaccacattatgtaataatatattcaccataggagggtgacgtacgataaatgtgctcttagagccaagtttcaaatgtaatatatattatcatttctaactggtgattgaaactggaagaggttgac

SEQ ID NO: 517883 - DNA, 291 bp, Homo sapiens
  misc_feature (37)..(37): n is a, c, g, or t
  misc_feature (87)..(87): n is a, c, g, or t
  misc_feature (147)..(147): n is a, c, g, or t
  misc_feature (149)..(149): n is a, c, g, or t
  misc_feature (253)..(253): n is a, c, g, or t
ctctgttgcccaggctggagtgcagtgatgtgatctnggctcactgcaacctctgcctcctgggctcaagcagtcctcccgcctcancctcccgagtggctggttctatgagcagccaccaccacacccagctaatttttgtatttntngtggagacggtttcaccatgttgctcaggctggtctcaaaaactcctgagctgaagcaatccatccacctgtgtcaggctcaccaagtgctggggattgcaggngtcaccacttgcgcccggccatggttgggtttttttaa

SEQ ID NO: 517884 - DNA, 161 bp, Homo sapiens
tctactgcctgtgttcccagctactcgcaaggctgaggcaggggaatggagccaacccgcaagacggagcttgcttgcagagagccgagatggctccactgacactccagcactgaacgataaagcagagactctgtctcaaagaaaagaaacgcaaagag

SEQ ID NO: 517885 - DNA, 164 bp, Homo sapiens
atctcatacaggatacccagacggttcgaccagagttgggctgcaggactcggaaactgcctatgggcactgagctattccttccggcggctggtgaactccttgcgatctcactgtcgcaggctcgcatcacctactctccattgacccactacccgatctcc

SEQ ID NO: 517886 - DNA, 961 bp, Homo sapiens
cttcgtgagacagaacactggtgactgggcaaaactcacccctgcaacccgctcaaagcaatgggataggcaaaagcactcattatcaactatatgtcagtccataggacaccgtagcatgcggagcccatgtcgacgcgacgtcacatggcatcatgatctcagtcataatagcaggagcgcaattcagcatacgagcatcaagaacgccatgtgataaacattttagcaccaatcggatggctaggtcgccgaatggggaaaagaggctccgataccacagatagtgccctcagcgctcttgggagataggagtagataaacctggcagtcggatagaaccggtcgggtattcgtaggtaacttaggatcattccccctatgatcgcacacaatgtgcgcaccaagcgagggatcagtaacctcatgtgggcccattcatcgcatgacgaataggcacctccagtagcagccacatgcagcacgtaagattcctaaaccacacaagtagaactatcaccgagtggcatccattcgttcaagaggcttagaacaatagatcagaattggtacccatgaactgatgatgtagcctgccatgagactgcacagcgagtgacaactcacgaaccaggtacattgagaaatggacccataacaaacttgatgagcacatgcaaccacagacgagaggcgcagtgaccacatcacctgcagacagaccagcaccaagacgacgagaaacagatcgagacacacaaacgtaacagagagaaccagcaaaggatacacaaacaaacacagaggcggcaacaaatcccaggtaggcaacccaggaagcaacataaccaaggacacgccaccaagcagaagcagtagacagccgacacacatcggagacaaaagggcaccaggacaagagcaacaagacaccccgtgacagcacacacacaagaggcca

SEQ ID NO: 517887 - DNA, 209 bp, Homo sapiens
tccttgtctttacatggagaatctccctgagatgcttgcccgcagatagccttgcctgttttttaacccagcacacgccgctcctcctctgataataacctctgcgctgctcttacctccgtgcgcccatctacaagttacacacgacttccactattcggccacatcccactccaattaaatcgtatatatatactaggtattaatat

SEQ ID NO: 517888 - DNA, 612 bp, Homo sapiens
  misc_feature (30)..(30): n is a, c, g, or t
  misc_feature (39)..(39): n is a, c, g, or t
gacaagggacttgcagcataggaatacccngaatgtgtnggcatggggactgcaccaatcttccaacttcaaaggactgctgctgcagtagctgcccagtctggaatccttgatagaacaatgtgtctgattatgaggacccaaggacccataaaaaagtatgatggttataccctcgtgccccactggtaactggctaccaaccgagtgattcttgctgagtttgactacacagctcagcccctggaaaccttcccttttgatcagagtaaagagcggaattactatgtacctaatgaaggctgacatgatgccattcctgtactggaatatgatgctcagaggctactggggaggtccagccttcttgcgaaagctgtttcatctgggcatgaattaaagatggctcacagcttgcttttcttggatggcttctggatcaaaatcgcagttactgattgacatgacagatacaaaggactcagaacctcaccctttaaggaggttggacatggtgacctttctaggcctctgaatagctatcatgtggacaacccagaacgagtctttggaaacatccaagtgaaataataaaactctattttctaaata

SEQ ID NO: 517889 - DNA, 665 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtgggaagtcttgctggtgggtag

SEQ ID NO: 517890 - DNA, 832 bp, Homo sapiens
gtgaggtcactgccgggctcggcgtgagtcgctgcggggctgacgagggtggcagtgcggcgaggattgacggcctggtcagcacccataatgacttcagcaaataatagccaatcgcagattacaactacaagtgaaacaaaaaatgccaggaagaaattacaagcacctttatgccgggcatttagacacaaactgggcacacaacagcacattacaaccacaccaggatatggcacaacatatagaagacagcaatgggtgtccctgcaacgagaaatttcacctccctattccgcacaatggggaatttctcacggcacacacaggacagcaaaggcaaagctaaaagagtcttcctaaaaaaaccagagcaggaaaaacacaaaaaaggaggcataaaatcttatgcattaatgaggcatgggcaaaacttgatgtggaccgtatccttgatgagctttgccaccagcacgatagctacccatgcagtcgtctgtctcaaggactcacgagtccggaagacgatgccgcttcatgtagattcacaaaaggctctgtatttaacaagaagacgggcaataaaatacttcaaaacaaggaccgcataattgatgaagccaaattgggcgttgctaccacaatcagggcatggatgcccgatccaatataaatcccggggttggccaacgaaacagcagcgtcaggcctaatttaaggactgcaaacaacttggctggtcggccgcaatctgcatggccactcaaccagctgccttgcagcacaagttatacaacgcttgttccaacaaggggcggccatggcttgccca

SEQ ID NO: 517891 - DNA, 110 bp, Homo sapiens
ggacccttatgctacgagaagagaatggctgttgcagtagcgtcagagcagctccagtgctggggattcggacggagagcgcgagactcgtgcggctgagcgcgcccgac

SEQ ID NO: 517892 - DNA, 443 bp, Homo sapiens
ggatccccatggtcctcagctgcatcctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaaggtgagaggctttgggggccagacattatctatcccaggccatctccaaaaggcagtatcctttactcagccttgaagtaggagggtctgtcccccttaaaacagtagtggacctcaaacaacttcttcgtctaatagctgagaccatcgtgcactcgaa

SEQ ID NO: 517893 - DNA, 327 bp, Homo sapiens
ggcgatgtcggtgcatgttggcacacagaagcagcattggcatgaccagtgtgggtcctggttaggggaagagaactgggtttgacaacaacagggtatctctgaggttataaaaagttgggttctgatcatttggagatgaggtccctatggatagggcaccatatctaaaggttcaccatttacattgcaaatatacattcagttctctgagagtgagcagagaaggcagaggttctcagtcttctgacaaggtcctggagcatcaggggagagcccattcttacaaaactccacaccagcatgcaagcccttacatggcacgcg

SEQ ID NO: 517894 - DNA, 4490 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517895 - DNA, 4536 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaagggtaagggccgcggcggccccgcgcgggggagggcccacaacgctgcttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517896 - DNA, 236 bp, Homo sapiens
cgagtgcagtaccctcgataaggccaatgatgatgagcattcttcatgtgttttgtggctgcataaatgtcttcttttgagaagtgtctgttcatgtccttcgcccactttttgatggggttgtttgtttttttcttgtaaatttgtttgagttcattgtagattctggatatagtgtcacaggtctttgaggctctgttcattaaattttatgattctgtgtggcccttatcgag

SEQ ID NO: 517897 - DNA, 224 bp, Homo sapiens
  misc_feature (42)..(42): n is a, c, g, or t
  misc_feature (100)..(100): n is a, c, g, or t
cattgatggtgctgactgcttagggtggtggtgctgaaggtngggtgacagtggtaatttcagtgattttggttttgtttggtttctttaagagacaggntctcattctgtcactcaggttggagtgcagtggtacgatcatagttcactgcagccttgacttcccgggctcaagcaatccttctgcctcagtctttccagtagctaggaatatcaagagggtc

SEQ ID NO: 517898 - DNA, 1314 bp, Homo sapiens
  misc_feature (349)..(349): n is a, c, g, or t
  misc_feature (378)..(378): n is a, c, g, or t
ggagggacccagggctgaagggggtcggggcgccagcggtgcaaggatagtccttatactagcggaaaatttttcccggtcagtcaagatcaccttcaaagtgacatctgcgagtgcacacaggtcggagcggtgcataaaagtgtcgcgcgactggcggactgacgtgcgggacacacgagtgtccgggctcgcgtcaagttatcacagtacaggggccagctactcggcgagacagaaggcagtcgagggtccgagcccaccgaggtccaaccctcggtacaccatgcgctcgtcctgtcccaggcggagggcttcgggcacccggcaatctcgtggtaagaccaangtgacgtactcgcgagcagctgctgacgnaacctgtggcgtctggtacgggaggcgcacgtgcaaagcgtgcccgcggctgcttcctatacttaggcgagctgctcacggcgccgcggcgcgtacaccaggtcgggggaaatgcacacgcgcccatgcgcccattagggcgcaacgcgtacccccatagccgccaaactgaaggcgaaactggccgtgtcgaagggcacctgaagaccgcccttagtggacactctggtcaacttagctggacggcaaagagagtgccgccggggggtaagagtccggaatgtggccactggtagagcccccttggtggggaggattaggcaacccaatacgcgaagccgggctatagacgccgtaccgtatgcaattggacgcctcccgatttagagggcacgccacattggagtggaaggccccccgccaatgaggaagccactcccaattggcggccacctttgtgtggtctaaccccgtttttcctaagaggagatgggcaaaaccaaaatacaaaggtgtctcagggccccgagagggggacacttagaggggggagcgcaaagaagcggtggagccgccagacgacaagcgggaaaagggggccgttggaaagaagacagatacaccgcccctggtacctccgtaaaaagtcgggcccccaagacaggataaaacgcccaaacaatcccgaggagcgggcaatagacatggaagccgccacaccgattaccccgccaaatgaggttatccccatttataccggaccacaatggacggaagacacgggcgggggcgcaacacgcggaatcagggggagcttccacactgggggaggggccgtagggtcaccccaaacagaacacccgcctagatgggaacggaacgggagcccgaagggggggccttgggggggcggacgggggggcccacactggaaag

SEQ ID NO: 517899 - DNA, 4388 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517900 - DNA, 4605 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagcaggtgggtgcatggccttaggagtgatgggggattagaatttgggatttccctcttctggggtcaggggatgagggtaacatcctcccttcctatcccctaccccctcccacagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517901 - DNA, 4089 bp, Homo sapiens
agctggctcagctcccgccatgctcagcactggctcccttttctggcacaggagacaaaggggcatccagggacgaaaccccttttaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517902 - DNA, 4872 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacaggttggggagactctcgctgctttctgctcctcaaggggatctgctcatcctcatggggtttctcgttttgcctgaggcttcctgctacctttaattccaagtaacttccaatgaagtatgttgcatgctgactccgatccttgctctaaatctttcttaagtatccctcttaactccaaagctggccctaatcccacctttattcttaattctaacgaacctggttagaactgagtttgttccaaacctaacctttacccattcctcttcaggagcccttagttccctttcattattcagtttctccatctctacctgtctgttggactgagtgcagtctgcaaaaccctgttacctcttctgtctgctgccttctttgcagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517903 - DNA, 4326 bp, Homo sapiens
gtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaagggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517904 - DNA, 715 bp, Homo sapiens
gctcattctcctgaggctgacaatccgtatgccaaggtagatgtgtcagtggccacgtggaagaagacattccattctcaacaaattgaactacggagtcatgctacgcacagaatccatagaatgctgttggcggaaccatgctgtggcagtactgaggagcatgcaatggttaataccccggttcgtaggatctaccgataaaacaaatgttgaccaaagatccagaagctacccagttctcaatgcaccttgatgtctccggaagtgcattggggttcttctctcgtcatatctcttgttggtcgcctgagctgatctgtacattccgacaattgcgccgtgcagtcccgtgtaccgtggggttgacagtacagaagaaattatgggaaatagaacagggggcctccttgcgtgtggcatgtaagccgacatatgctgaccatgctgtagtcggggaggcctgacgactggggttaattctgtaattgagcatccttgtatgttcacttcgtagttaccctcgttaatgcagtacgccaagaaggtttgtgtaccgtcattgccagtgcatcacataaatagtgcgtagagaccttgtggactacacagtatcagccgctgttaacagtgtaactgaaaggtacgaccttggtcccattgcttggctcgtgaagacggggacgggaagaccgcacccgccaagttggtgaca

SEQ ID NO: 517905 - DNA, 134 bp, Homo sapiens
cttgctgatcttgtgcattatattcaaaatgaaatttaaaattggtatctttctaaaattctgacagtactatgtagtgattttgaggccttggactgtcatacaaaaatcagtatatagttttatagggagta

SEQ ID NO: 517906 - DNA, 149 bp, Homo sapiens
cggtcccctccaacatctcatacctccttccaacatctcatgacgaatcagtggaagaagagggcattgaggaaggcatccagcaagatgaggacatctatgaggaaggaagctatgagatgttggaagggggatgagatgttggaagg

SEQ ID NO: 517907 - DNA, 3561 bp, Homo sapiens
ggatccccatggtcctcagctgcatcctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactgactggatcccaggcctgcccttcacccaggccccgtccccgaggccgacccccagctcaagcgctggggcctgctgccagccctccaccttccccaccccttgggccatcactgggctaggaacccctttgcccctctctgcagctcctctcttcaagaagggccctttgtctttctccactcccacacacctttcccaccaagccttgaagactgtgctggtgagaagaagtctgggtgggagatggctggcagggtcttccaagtaccttcctcccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttagagagggatgaaaatgagccctgggagggaggaagggacgaggaggggtggctgcatgttaccgtcccctacctctccccacgtggagggtggagcagttatgagggaggaagtcaactgctgttcagcctcagaataaaggtgccgttcactggctcagttacctcctgtgtaccggcatcttgtgttgggaatgttcccccctccctagggaccaaggaccacccctacaaaaagagtaatggttgggtgatactccctcaagccaaagaggagctccccaacctgttctagggacccaggtaacctagaagggtgggagagaatacaatgggccagatgtggtggaagcccagctctggggctcaggttcctggaagacttctactaccctccctcctcaaggcctggatacagactaaatttgtataagtcaggcaggggacctagtcagggtcttgggagctaccttgtcgttgggaccagagcaaaatagtggagggcaggctagggaaatgtgggcacatcccccctcccaggaggggccggggagagtggcagtttgcatggcgaaccccccacttcctctttgctgccccttcactttcttgctgcccctttcccagtctctcttcacacccactcctggtctgtcctgatcccctcttctgtatcaggtttattggttgtacatataaattatactttcctt

SEQ ID NO: 517908 - DNA, 923 bp, Homo sapiens
  misc_feature (646)..(646): n is a, c, g, or t
acagactggtctgactcctgatgctccactactggatccctgcttgcctctggacattaaagatgagatccagcaaaacgggcagaccctgtaccttcaggggacaggagactttgacctgtgtcgagagaccctgcagcctttcatgaacaaaaccaatgagacccagacttccctcaatggcgtctaccagcctccaatccacttccagaacagtgaattctacggcttctctgagttctactactgcaccgaggatgtcttgcgaatggggggagactacaatgctgctagattcactcaagctgccaaggattactgtgcaacaaagtggtcgatcctgcgggaacgctttgaccgaggactctatgcctctcatgccgacctccatcgactgaagtatcagtgtttcaaatcagcctggatgttcgaggtgttccacaaaggcttctcctttcctgtcacctacaaaaacctgaagacggccttgcaggtgtatgacaaggaagtacagtggaccctgggggccatcctttaccggaccgcttcctgcccttgagagacatccggcaggaggtgttccgagctggccacgcgcactggcggggcgtgtcttcgtctacaaccactatctgttcttccggtngcttcctggtcgtccttctgtccatcccttctcttcctgcttgggtggggccatcaccgaggggccccgaactggtctctgtgggatggaggaaggctgcctcccaaggcctgggcccttgtggacgcacttgggttgcctgaagaaacttcgaaagcctttaccccggtttggttcccccgtcgttgccctccttgttaaaacctgttgtccctgtgcggcgcctgggccctccggcggaagagtctccccgtatctatgggagggccgggtctat

SEQ ID NO: 517909 - DNA, 430 bp, Homo sapiens
cctgttgtccttcccagtttctccccaacctccccttttccctagtttataagacaggagaaaagggagaaagcaaaaagttggaaagaaacagaagaaagataaatagctagacgaccttggcgccaccacctggccctggtggttagaatgataataatattaacccctgaccaaaactactggtgttatctgtaaattccagacattgtgtgagaaagcactgtaaaactttttgtactgttagctgatgtaggtagcccacagtcacattcctcacacttacttgatctattatgactctttcacgtagaccccttagagttgtaagcccttcaaagggctaggaatttctttttcggggagctcggctcttaagatgcgagtctgctgatgctcccggccaaataaaccccctcttccttcttta

SEQ ID NO: 517910 - DNA, 407 bp, Homo sapiens
tgaggagctgaggcagagattgtgaaccaggaggcggaggttgcagtgagctgagattgcaccaccccgctccagcctgggtgacagtgagactccgtcataaaaaaaaaaaaagggaatgtttcctagccctctgaagcctttcgatcaatgattgggaccaggcaaatttccggtaatatttggtagtgattttcaattccatttttatctccagagttttttcaaattaatgttcaatggcattcctccttgagggacatagggccattacacttctctttcattttacaaacgtttgcttgccattggccggtggtttgctctctttttatccacaattccaaccccttatgtggctcctttggtggtgacgtcgtgtccctcacgcaggcttgcaaaccagg

SEQ ID NO: 517911 - DNA, 152 bp, Homo sapiens
cgattagacttattttgtagtggctgcatcacatatttttcactagaattattttggaaatagctgaatgtaatagcaggtaggaagaagcaagcaaagtgagagcttatcttcatccagtcattgcccatctgggactccatttggataac

SEQ ID NO: 517912 - DNA, 1013 bp, Homo sapiens
tgagctctcctatttcaccctgttggccctttccctccttcccctatcagccagaacatctctggctcacgggccattctactagagtcactcgcaagtcccaagagcttcctgtctcctgggccacaccttaaaggacttagccgtacgacaatagccctttatgagtgaagactacctctgttgcagacgtctcacggaacgaacttagcctagaagtccattgtccgaagccccccatcgcaggggtccagtagaacctcccgccaagtacgtctagacaactgaggacggcacgactggcattagatacgcctcacactcattctcgaccgcctgacgacactacagtagcgctaccccttcctgtgtacttatccctactgaggcataattataacaagctccatctgccatacgacaaacgagaccgtaaaatcgctcatgtgcatactcttcaatcgagcacacatagccctcgtagtaacagaccattctcatcctataccccctgaagcgttcaccggcgcagtcattcctcatacatcgcccacggacttacagtcctcaattactagttctgcctagcaagagctccagagagctacagaacagcagctcagcagtcggcatcataatcctctcgtcaaggacgttcaaacgtctactccgcactaatagctttaggagtgactctttagcaagcctcgcgcaaccttgcgccttaccgcccgccacttattaacctactgggagaactctctgtgctagtaaccacggtctcctgatcaaatatcactctcctacttacaggactcaacatactagtgcacagccctatactcccttctacatatttaccacaacacaatggggctcactcacccaccacattaacaacataaaccctcattcacacgagaacaccaacatctatacacctatcccccatgtcagctacccctcaaccccagtcatcgtcctcgcttcgtttcttgtctttgttttcttgc

SEQ ID NO: 517913 - DNA, 1713 bp, Homo sapiens
  misc_feature (107)..(107): n is a, c, g, or t
  misc_feature (1530)..(1530): n is a, c, g, or t
tctacacggccggtttaatcgggttcttatattcaaaagaaagcgtgctccaaaagtgattgcgaccttttagtggcacataactcaaattataagaagttttatgncagcgaggctttctttctccctcgtgtagtgaggtttcttctcgtgcgaggctttttttctcaagggggccgtggttatatcatgtggagataagccgtgcctgtgcctttatttctctcccaccgagagaggcttatcatctcgtgcttctctttacaccaccaacacagagcgacgccttttctttctcctttctcttatcaaccttcacccacaagctctttttttgtgacactgtgacaaacaccgcgccgccctttcttcctacaactcgtgaatgtgtggggcgtgtggaaagtagtgccccggcgtgtgctgttgtccagacaagctggtggcccttttatatcccaacccgcgggaaaaaaccatgtgggatgaaatacccccgtggggcccgtggggcccgaacaaaaacaagtgggggtgtttctcccggggagcgcactatgtgcggctccataatgggcaaatatattgtggggggaatataaaaggctttatacaaaacacatgtggtatatctctctccaaagagttttttctactacaacggggagagacatttaccattctactatttaagaaggggcagcccttcttttggcgacgatgtggggaactatcttctcctattgtggacgagaagagagggtgctcctccaacaaaaggggggggcctccttatgatgggggagaaacatcatctcatgtaggaggcgcttatttacacaacagaagaaaatcatcctgtcgacatataaaagaccatctcccggtggttatctacaacaaatccgaacttcctgataggggctgccattgttgcgacgcaaacagatgtcgtggcaaccggataacaacccatccgttgtgcaaacggggagcaacaacgacccggcgcaaatataaacccagcgccacaaaaagtgtgggcaccgggcgaaaccaaagcgtgacacacactgtcagatcagaacaatccgacccggagaaaagaaacgcaacgaacacatagtaatacgacggggcgccacaaacaagaggcgcgcacaagaaacaacaagcgggtcgccccccacaacaagttggcgcccccaagcccacagcgggaacgacccaagcagcgctttgacaaacagaattgtgcttatcaaccaacccgctgaggtacttatatacccagtttcataaaggtcaagagaagattatatactatcccgcagcggagcaatttactttctccgttagaaagcacgagccctgtagtaaaactgaaaatcgactcgataataatacaccgtcacacaatgtatagcagacactgagtaatagtcacaaacggggctgtcccctccgtgtaggactaggtacaatatcggcgcgaacaacagcgatatctacatacaactcattggagcnccttttagcgcagagaagactcatacaatacgctaagaaaaaagagcgtgtccatccatcttttgtgtactatactatactcaccacgggaataacaaggattactatgaagcggagcgcaacaaacaaccgctcatgagaggattcattctagtcaagccaacccacaaacgacttagtata

SEQ ID NO: 517914 - DNA, 174 bp, Homo sapiens
gccggtaccgatagtgtcatgcaattttttttgctgtttacaatgaattcgcccgtgtggcttgggggatcagaaggattcctaaactgtcatttcatttattggtaggtcatgattgctgagggttatgctttggatttttcatacctataaagtcaatcttgagttgatcag

SEQ ID NO: 517915 - DNA, 136 bp, Homo sapiens
ttataaggttatgaatctatttaattgctccgactgggctagagaatacggaccctgaaatacatatatttcataagggtcagttaccaaatggattgtttcaaatggcaattttttaccctaacctggttatgga

SEQ ID NO: 517916 - DNA, 1064 bp, Homo sapiens
  misc_feature (2)..(2): n is a, c, g, or t
  misc_feature (74)..(74): n is a, c, g, or t
  misc_feature (81)..(81): n is a, c, g, or t
  misc_feature (83)..(83): n is a, c, g, or t
  misc_feature (88)..(88): n is a, c, g, or t
  misc_feature (90)..(90): n is a, c, g, or t
  misc_feature (104)..(107): n is a, c, g, or t
  misc_feature (115)..(115): n is a, c, g, or t
  misc_feature (128)..(129): n is a, c, g, or t
  misc_feature (132)..(132): n is a, c, g, or t
  misc_feature (154)..(154): n is a, c, g, or t
  misc_feature (157)..(157): n is a, c, g, or t
  misc_feature (171)..(171): n is a, c, g, or t
  misc_feature (174)..(174): n is a, c, g, or t
  misc_feature (181)..(181): n is a, c, g, or t
  misc_feature (187)..(187): n is a, c, g, or t
  misc_feature (194)..(194): n is a, c, g, or t
  misc_feature (215)..(215): n is a, c, g, or t
  misc_feature (233)..(233): n is a, c, g, or t
  misc_feature (236)..(236): n is a, c, g, or t
  misc_feature (238)..(238): n is a, c, g, or t
  misc_feature (254)..(255): n is a, c, g, or t
  misc_feature (265)..(265): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (281)..(281): n is a, c, g, or t
  misc_feature (290)..(290): n is a, c, g, or t
  misc_feature (293)..(293): n is a, c, g, or t
  misc_feature (409)..(409): n is a, c, g, or t
  misc_feature (416)..(416): n is a, c, g, or t
  misc_feature (457)..(457): n is a, c, g, or t
  misc_feature (487)..(487): n is a, c, g, or t
  misc_feature (496)..(496): n is a, c, g, or t
  misc_feature (1041)..(1041): n is a, c, g, or t
tntatagcatttaaaatatcatccaacaaaggacaatgaagtttacatctgggggggtatacataacttggggnatttggngngcgtngngcccactgagtaannnntttggtgntggaagtttcttnnaanttaccaaactaaaacaaaaggntgnatgatacaaaaggnggngtatttnggtgtnatctgtnaattggcttttaaaaaaaggnaacacatcctgtttcccnggncngtgggtgggcgggggnngggtgcggcngtgtgngtnttanggnatttctcangtnttctcaaatgggtgcagggtgggggtggggtggggggaaattgatagaaaaactttgctatagacaccacaacaaacaataaatttagataatttaaaatttaaaaaaaaaaaggngaggggnggcatttcggcggcaaagtgctcaataaaaagtatattgtngggggtaatacaagaaaattggggtaggangggggcggnaaaatgggtcagcggggtgggcggaggcctcaaagggaatatggcgttgtcgttctgggggggataacacgttctggatctggaactgcccggaataactttggttctcttgtatttacatctttgaagaccatgatcgaagcaatatttccacaacgatagcagtaattaggagcagaccatactgtcaccagcttctcatcaaacataaatttatagccttcgtgcactagttgatgtgctctgcagatgagttttaagttgttgatatgaacaaactcatttgtgacctttgctccaaaaagccaacctgctcctcggggactgatagcccaggtatccacatcttcaggatctgaccaaaccagatcacaaaatgctcctttatgaggaatttcctgattccgttcgatggttcgaatttgatccagttttttgatatcaggagataaaccaccatggacacacaaaatctgctcatctattaaagctgctactgtgagcatgttaaaactttggtacagtatctccaggcattagcattncatatttggtttggcactcatca

SEQ ID NO: 517917 - DNA, 453 bp, Homo sapiens
tggtcacacgaaattttacaatgccaaacccaggccttgctgactcctaagaaaggttaccgtgaacaccatatcccctgcatgttaacacggctcacgagacagggcacggaacttagcttcagggtcatgcacgctacggaaacgggcaggcactagagccgtgtaaatgagagcccactgtggctcctcctaccgcacaaggactgccccagtgcctgtgcacaagtaccatggccgtggctgaagggccgggcagtcactgaggctggactttgagtctttccctgttgtgattgcatggtactgcagggtagaaggccttcctaatagctgtgggtcgcgagccacatccccagcggcttgggtcaccaattgggaaagggttgcctggctttagggcgcccacgagtcggggccccgtcttggctgcttacagaagcggtccttcct

SEQ ID NO: 517918 - DNA, 887 bp, Homo sapiens
ggccgcggggctggcggtggctgattggacttggtgggtcccgggcctaggtgctggggctgccgccatggagtaacctgttctgtgccgcaagaatgcagagcctgctgtcacggagcagtgacaaggccatcctgcaactgaagcagcagcgggacaacgctgagtgcagtaccaggaagaggatctgcccagcagctggagctgcgagctgcgccctggccctggcatgtctgcttgcggtgactggcagggaatggaactgggccaagctgctgctcaatgaatgaatgcgataccaggagcagctcctggacatggactggagaaccagatcagcaggcctggaggccatggttcagagtattgatgttcacccaggatctgaacatgaaagtgatggaggggctcgcaggttttggaaatgagttgtcttgaacaacggatgcaaccagtgtgattgtcccattgcaagaggtggacgagtggatcctgtgcaccgaggactgccagggatggccttgttggcagtaccatgccggccaatagacgagctcctggcatggaagcttcactccaggagtgatggcaatgacgccatcctggcaggagcctgatgcgcagtcacactcacggaaaccaaaatcggaagctgccagaaggggttcgcttcccgagccccctttcctgacggaccgatccccagaaaaacggtacccttgtcaacgggcccaaggccgcaggggcagcgccggcagcttggatggcatgacttcgctataacgtggtgccagtcgacctatgctggggaccttcacgtggggaatgccccctgtggacttgatggacccaacaagaggagctttgcagtcaacgaggcaggccca

SEQ ID NO: 517919 - DNA, 399 bp, Homo sapiens
cgcagctttatcccaacgattttccccttctctttttggtaaaaccgccacagctatcattattactagcataaaaggtggcctcttttggtttttaaattaattgagcaaggcaattgcaggctgtgcagcctttgattgccagttggtgatccaacttcatggttcttagcccttattcaaaatggagtcgctctggttagaatgcttcccacgtatctcccctttcccttttacaagaggacccttaatcctaggggtttcaggatgaaggtccatgctgaatgggggcaatgatactcctgcctaactattagggtctcttgtattcagggtagagaggcactcagtcagaaagcattggtccgttaagcatctgtaggtaaaacactcagcctc

SEQ ID NO: 517920 - DNA, 181 bp, Homo sapiens
cacgagcgccccagtgtcattggaatttatattttacggaataggctttgcatgttaaaattcacaagttgttgaaactggtactcaacagatctgcatttcttacacgagaggcattaaggaattggcaggacttaacttggggtgggaggagataacatagggagaatgggagagttgg

SEQ ID NO: 517921 - DNA, 83 bp, Homo sapiens
gcacgaggctctattccatgaacctgggctaatgggatactgtaaaaaaaatgaaaaaacttccgggggaggccgtctcgcat

SEQ ID NO: 517922 - DNA, 646 bp, Homo sapiens
caacgcgttggtcccgatgtgctggatccgaatctgacgccggagtggtgaaagaacgattattgtcgccgcgctttcgtaaccgtcagtttgctggattactgctcgatcaggcgtttctggctgggcttggcaattatttgcgggtggagatcctctggcaggttgggttgactggaaatcataaagcgaaagatctcaatgcggcgcaactggatgcactcgcacacgcgttactggagattcctcgattttcctacgctacgcggaggcaggtggatgagaataagcatcatggggcgctgtttcgctttaaggtttttcatcgagatggcgaaccgtgcgaacgttgtggcagcatcattgagaaaaccacgctgtcatctcgcccgttttactggtgccctggctgccagcactaggccgaccgcttcggcgcataggttgaaataaaccgcgcaatggcaggccctgtcagcaaaatactgaacaggcgtagggtttgcatcgccataatgagcgccatatcggcattgctcctgcggcgatgaccgcaacgtaatcaagcccgccgggtggttggccaagtaagcagtcataaatcatgggataaccggttagccccaagccataccgacaatagccg

SEQ ID NO: 517923 - DNA, 169 bp, Homo sapiens
aaaataagctgagaatgaacatcatcatcaaacacagcattccaatgaagtctggcaatgaattgtgacacaaactgaactttaatttgctctgtgtccacatgatcttctgagcctaaaagttcctgtttcctgttaatgatggtgatgtatctgtctcttgatataa

SEQ ID NO: 517924 - DNA, 393 bp, Homo sapiens
  misc_feature (279)..(280): n is a, c, g, or t
ttttctttttgagatggagtcttgctccgtctgtcgcccaggctagagtgcagtggcgcattcttggctcactgcaagctccacctcccgggttcacagcattctgcctcagcctcccaagtagctgggactacaggcgcccaccaccacgcctggctaattttttgtatttttagtagagacgcggtttcactgtgttagccaggatggtcttgatctcctgacctcgtgatctgcccgccttggcctctcaaagtgctgggattacaggcgtgacanncagtgcctggccctaaaatgtgctttaagtgccaaggtatacatctgatttcaactacttagtatgaaaaaagaatgtaaactatcttattaagattttaaaataatttttac

SEQ ID NO: 517925 - DNA, 782 bp, Homo sapiens
taaatagagacagggtcttactatgttgcccaggatggtcttcagctctggcgccttaaaccccctgcctctaccttcattccaaacccctctcggccgggtgctggctatgcttgtaatcccagatttggaggccaaggcaggaggatcgttggaggccaggaggtcaataccagccgtgggcaacatagtaagaccctgtctctattaaaaaaaaaaaataaacccttttttcccacacaaaacaacccaaattcctctaaaatcataatccttataatccctcgtgatctcgtggtataataacctctagtggggaattgcgggatcatccgtatccctccttgtcgtcgtccaaatcatgaaaatgttggggccataagtcaatgtcaatgcccgtcacataaaaagccgaggaccgaggtcccacaggggaagcacgctggaagctgggaaaccggtgtctctggacttcaacaccgggtttctaacaggtggtagactgggggatgggtggaggggccaacaggatagagctgaggcgacctatgccaaatgaggaaagtacagacaaggggggggcttaggagcaaggggacccatatccaaacgggcaaaaaagacaggccaaggtggacctggggacacataacgcaaagggagggacggcaaaaaggcggccaggtacgcagcgcgggaagaattgaagcaggcccgtgggaaggaggcgccaggccgcgctgaattggcgactgggtgcccattaaaagtctaggaagaaa

SEQ ID NO: 517926 - DNA, 174 bp, Homo sapiens
tcgttgttccaccgacagaccgttgtaacgctggagcacgcctgcgcagcgggtgcagagggtcttctgatgtttggcgagcgtgacttttacatacacgcaatcgcagtgttcgcagatatcaatgggctgagggtcgccataagtcccactccatgcgctatacgttacgcg

SEQ ID NO: 517927 - DNA, 845 bp, Homo sapiens
tgtaccctacatgtgtctgagtgaatggctttgaatctggactcaagccatgactcagcccgtggccagtgagggctcagacatgtgtgctctgacaagagtcttgaaggtgggtgtgaacgtgcctttgatgctgaaacagactctgtgaaatgaatagccagtgagtccctgatcatgacttgtgaagatattggatgtgaatgatgtgatgtggtgacactggtcaccgaacccatgtgatgccccctctgtggtgcagatcatgagtgctccactgattcaccgcaattggcaccacttgggccacccagttgagtgctatgcatttgccatgcaatctacaatgccaatgtaccacaccatgagttgttaccatgaacataaatgctgctgactatcctgaccttgtgaccccagccattataggcaagacagtgaatccatccaagaacacacacaacaaaaacacatcattacccatctgtgaacaagcccgaaatgtggccattttgctgtcaacatgcggagaatgtatgaacaactgctctttcacagaagcccaatgccgcttcttgaagcgaagcgtgccttactgaacacttcctgcggcagtaatgagacagctctagatcttacccacaggtttgggaacctgcaatcacgatggtcctggtgaaatttgcagtccatgcatcggaattcccagagtttaagcacatgccttaccacacgggtcccgttgcactttgtgccctcgaactaggatcatatggacatccccgtggcatttcttgcaaaacgaccataccatagcaaacatggagagtccgacaccaaatctg

SEQ ID NO: 517928 - DNA, 186 bp, Homo sapiens
  misc_feature (121)..(121): n is a, c, g, or t
tatcgggggcactgtccattgtgtgggtgggcaatcacggggttcttcttcaaaaggttacatttaagcttcaaaaggttacatttaaacataaaagaggaaccaagcataagagccaggnagacaaaaagacggtccaggcagaaagaaaagcacttccaaaggccctgaggcaggacagcatgt

SEQ ID NO: 517929 - DNA, 480 bp, Homo sapiens
cacattctgggtacggaaaaggagaattcaagtgtgacccctcatgagggcaacgtgttactgatgatggagaatgacactaccacgtaagtagaacagtggcagaaggaatatctcggtgccttttgctcctgcgctatgctttggacgccagcgtggctgtcgctgtgacaacggcctgcagacctggtgggtgaagcccggtctccgaaggcgctactggccgtcgcttcacacagtattctcagagataccatcagagaacaaacactaatgttaattgcccaattgagtgcttcatgcctttagatgtacaggctgacagagaagattcccgagagtaaatcatctttccaatccagaggaacaagcatgtcttctctgccaggatccatctaaactggagtgatgttagcagacccagcttagagttcttctttctttcttaagccctttgctctggaggaagttctccagctt

SEQ ID NO: 517930 - DNA, 132 bp, Homo sapiens
tgtggctcatgtgatcctctgttaggatttaaagtggactcattccaattacatggccctccagaagaagctgaaggggacagaggatgaggtggaaaagtattctgaatcctgtgaatgtgagtgcccagt

SEQ ID NO: 517931 - DNA, 147 bp, Homo sapiens
ctcgagctctagcttgtttaacagtggaacggcgctctgtgctggcagtgtgggctcactagtggcctgtctgcacatgtaaccacgatgctgtgatgtatgcactgacttggtactccttgtgaagaccaggtcttgatgttctgg

SEQ ID NO: 517932 - DNA, 494 bp, Homo sapiens
gtcatatttattctcttttgtaactgctgtctttacaataaagaaatcatctgcctttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaacaaaaaaaaacaacaaaacaaaataaaaaaaccataaaaataacccaacataataagccttaaaagaacatgctactaaagccatcctaccactaaagagtataggcaccaaaccaaatagccctatccaacatgcagcccagaattgaaaagcgaaagctcaaatagcaaccttttaatccaaaagtaaacgtcaaaaaaaactttaaataaattaagctatcatctaaatacattgtgccgaactcgataaaaatgcacaaaaaatcaatactatctaaaaaaattaggctaaaacggcagcccaagatttaaacaccaacaca

SEQ ID NO: 517933 - DNA, 245 bp, Homo sapiens
cttctagaaaacgaccacatctacaacgttatcgtaacagaccatgcatttgtaataatcttcttcatagtaatacccatcataatcgtgtctcagtaactcactatttcctctaataatcgtagaccatgatttggcgtatcgccgcataaacatcatatgctactgactattacctccctctctcctactcctgctcacatatgctatagtgcagtcctggacagaaacaggttgaacagtct

SEQ ID NO: 517934 - DNA, 369 bp, Homo sapiens
ctcattaaaattcagatatatttcctctgttattgacttataatccacttaggttaataactctggcaataaaaaggaagtttagcttatttggcagttaatctgagctggttcctagagactaccactcattaatgtcttgggtgataagagctctgtttaattaattatacagagttatctagaaaattcagaaacatgataaatttacaacttatcagcttcaagttcagaagtccttttttctgtttccctagtagcataaatcattttttaaaaatccatacaaaatgttaagaatggcctcatatcatatgaaaaaattaactcgagtggatcaaagacctaagcctaagagtgaaaactata

SEQ ID NO: 517935 - DNA, 121 bp, Homo sapiens
gggggggggttttttaaggttttttttccccggggggttttcccccaaagcttggccctttgaaaattaaagggggggggggttggggtttttccccaaaaaaaggtttttttccctttta

SEQ ID NO: 517936 - DNA, 850 bp, Homo sapiens
aataacatacgattcgcacgtaagaatatggtagaacggtctacaatactagcaaccatgtggaaggcatataatatcccccaggagggactccagtggaagtaagcatggatgatcctggtgaagtaatgcagctcaaaagctcacctgaccagctgtacagttcctgttgctggtttaacataatgtaattgcacattgggggaacaaaaaaaaatcaaaactctggtctcgcttggcctcagaaggaggagctctcggtgcctgattccctttcattgacggttaatccatagaccctccgctcactgactccctgccactctttttttttctctgccgccgactggtatcaatcatactcatacgtgatgagagaggccctcctcataatcaggtatataacctctcaaaaaaaacatagaaacaacatgtccttttataggcgttgttccaaaaaaacgccaagttcacgattttcaacccatatttcttccaccttctcactaacagcttttattttacccttttttcacaacgtgggtatgccgcttgtactgtaacgatatcatgtgtccaccccaacgccgaactgtggaacgctcaacctatattatccacgtgaaactcaattgcacacttttaccacgtttcagaactgcatcactttcctttacaaccacttacctataccaaccgtatacatagtactttcttataactcgtatgatccaccaactttcccaccaataacatatagacgtttcccacctacgcaaccaacagttggattattaactagtacctataaatccttcgccatagttaccattccgtgcctacactctac

SEQ ID NO: 517937 - DNA, 163 bp, Homo sapiens
  misc_feature (106)..(106): n is a, c, g, or t
cacaagttttggaggcgctgtggactggcccaggaggtacgaggcccactcatcctcaacccccatggaggcaacgttggcaggcagcctgcgcctgggagggtcntggggcagcccgtggcacttacccttgggtagggttttcagggaggctcacggtgta

SEQ ID NO: 517938 - DNA, 138 bp, Homo sapiens
cgagctggtggggttgtattgaatctgtagatcaatttggggagtattgctgtcttaacaatattaagtcttccggctgggtgccatggctcatgcttatagtcccaaccgatcgcctacagatcgccaaccagatcg

SEQ ID NO: 517939 - DNA, 793 bp, Homo sapiens
  misc_feature (98)..(98): n is a, c, g, or t
ctgtaaaaaaagacagtctgaaaaaaaaaggctgtccccgaaaacagattgtttgcaaaaaaaagttttgccgcccaacccccccttgttttcaaaanaaagccgggctctaccaccacacaatgtgcccccccagcttgtcccccgcccgccccccacactgtgggaaaacaaacacgcgtgtttttagtaaaaaaaagagaggtcctcccaaagaagtgatgaatttttgcccgcattattacacctcggcggcgcattatattgccaagaacaaatttatgcccccctaatatcgccactgcgacataacaacggaagattttctctataatttctgcggtgccactcaagcataattttctacacaatattccactcataattatgttcctcagccgccccacagatccaccgacactactcgggcattcttgcggagaaacaagggtagatcttttatattgcaacactcactgtcagtgtatacctacacccacgtccccacacacatcgtatttctatacaaagaacaactttcccaatggcgcttcccaacaattgaaggataatgttacaactgttatgatgtttgtcattaaaccagttgccacctttacaaatatttgtcccccctgaaatatttctacccgcactctattttctattattgagcatttaaattgagtacacctaagagccccggcagtacctcttctcccgcggcgccgctgttctattattcgaacccactaaaaatttatattgttgtccccaaccaatcaataaacaa

SEQ ID NO: 517940 - DNA, 821 bp, Homo sapiens
gcaaggccattgctagaaaaggtcgtccacttgatcagcatctggaaagcaggctgccgataaccacttgtccttgcttgtagactcagctcacctgtatataaaaactgttctgtggcattctgggaaacagctatttactactcaggtacttcatggtcctgttgatctgagttcacctttctgatacctgtttcaaccagttgtcccccgaagggggcaactgttaagcttaacctctgagtaatttgagacagatcaatatttgaatggttgccccatttgttttacctgtactgtatctgggtcatctcaaatggggtctaaacaccagctacttgggcatacccagaatgttgccattccctccaattccacctagtttattcattcctgtcctagtaaaggggctctttctttcagtgtctgatactctgtgctatggggagcttaaaacagaattttacaaagagctaattgtgggtccttcctttggaagccatagttaccctgccaaagaaagagtagaacaaatcgggttcaactcccgtgtgtcggctcaggcaaaagacctcttgtggaggtctccatacattcgaggtggagcggatgatagcccttaagagggtgggttaagccaatgggaacttttccctagaagtaagggcccctcgtggccagggtttcactcagggccattcttccagggagcgaattatggatctatggcttaaaagaggcccagtaaatattggggggaggcgggcacccagaatttatatggctattggttatttttcccctataataggagaggccca

SEQ ID NO: 517941 - DNA, 133 bp, Homo sapiens
ggaccggaagaatcctggatggtgattatagtctcggctctccttgtactcaactgattttgcaaacgcttctgttttctgtaacagttcctgcttttctgtctgtagtttggtgatcaccacaggatcttcc

SEQ ID NO: 517942 - DNA, 1288 bp, Homo sapiens
agcggagatgcgtcctggcaaggagacggcggagttgctgcggggttagttgcccttgatgactgcttcttctcgtacatgaggcatagtctacctcccacctccagctctcgaaaggagcttgtcctgagggacagtgatcagaggctccttttcttatctgatcagcgatatcagcccgagattcgtgaagacactgtgactccagattatcaaagagatagataatgactatcacggtgtcaaatgaaagactaataatcgagttatgtagcgtgctagtgaagacatgggaccgacgttcatgtaatggaagaagcttgggtcactgccagaatatgtcagtcacttatagtctaattgaccatccatggatgcgccatggatgagtatgtatgcgtgccccgagagtggattgcaacgaggtgtcaacatgaacctgagacatgcgcttaataagtgctcttgtcgatgtataagaaagacccattgtaagaagtgataccatgaggcaatgacgaaggcatgtcagcttatctggatttctcacacccaggttcaatcaagagctgcgttcccatggtaaactattgcgcatggagaaagagttgacggccgaaacgtagtcgtaaaggttataatgaacgcataggatcgtttcgataactatggagagcgtgtataacttcagatgctctgagtatgaccggactctgagggcatgaggctaaaaagcaaagaacctggagtttgttatatcatttccccgcgccaggtaaagtgtgaccccaggcaatgtaaactgacggatcacggcaattactcaaaaggaaaccacttatttctctgttggaagcactgtgctgagtcattaacacgtaaagggcacaacctggagtctcgtaaaaaccgacgtggaggttaaacgctttggtgggacaaggtgcaactatgaacgtcaccatttgcagggaacgaaatatctaatgttacgggaaagtcttaccagaatggcatgcgatttaccccgttcttagttgaattgtgcttagacaagaaacgtacatgatggaactttctgggatcgccgcccaaattaaaggctacaaggtgggacaccacgaaatgtgcttaccagatggtttctataggatggggccggtatagttgtgaatagctatagcgcgcttcacccacatatattcatctgtgttaccacgtaataaccacacgttgtcgagcaggaaatgtgtgggggctctcgaaagtgtagatctccccagaacta

SEQ ID NO: 517943 - DNA, 451 bp, Homo sapiens
  misc_feature (304)..(304): n is a, c, g, or t
atgttccaaccagtccatggtttctagcacactaacagtggtttcatgtacttgctgtctctgattctggtctggtccgattctctatgagaatttctcaacgatggctcatgccggtcagtatcagtgcttccatcgtgccatcttggattcacttctctttcctttctatttactcccaaaagggagtcattcatcctgatgtcctcaatggctgtgatatggctgggtgattcccaaatacatagctccaacccccaaatttccccaagattttagatctggtatggtataacctaatggnacatctctagggacagttccgtatagagtcaattcatcggcccaaccaagtatgtccctccggaattcctctccgggttacttcatcacaatctacataggctcaccagctagaaacatttatgagcttacattccttcttcccagg

SEQ ID NO: 517944 - DNA, 329 bp, Homo sapiens
  misc_feature (15)..(15): n is a, c, g, or t
  misc_feature (39)..(39): n is a, c, g, or t
  misc_feature (60)..(60): n is a, c, g, or t
  misc_feature (85)..(85): n is a, c, g, or t
  misc_feature (124)..(124): n is a, c, g, or t
  misc_feature (138)..(142): n is a, c, g, or t
  misc_feature (154)..(154): n is a, c, g, or t
  misc_feature (180)..(180): n is a, c, g, or t
  misc_feature (184)..(184): n is a, c, g, or t
  misc_feature (197)..(197): n is a, c, g, or t
  misc_feature (199)..(199): n is a, c, g, or t
  misc_feature (213)..(213): n is a, c, g, or t
  misc_feature (227)..(227): n is a, c, g, or t
  misc_feature (231)..(231): n is a, c, g, or t
  misc_feature (238)..(238): n is a, c, g, or t
  misc_feature (249)..(249): n is a, c, g, or t
  misc_feature (261)..(261): n is a, c, g, or t
  misc_feature (271)..(271): n is a, c, g, or t
  misc_feature (275)..(275): n is a, c, g, or t
  misc_feature (288)..(288): n is a, c, g, or t
  misc_feature (299)..(299): n is a, c, g, or t
  misc_feature (301)..(301): n is a, c, g, or t
tgacctcagacactnctctggctaatattttaataagcncacagcagataattctgagancatgggtgaggggtggtgcatgttnagatttaaattggcataaagctgcatactttttgtctanctgtttgatttcannnnntaatatagtatnccaattttgtgactgttaccatgtgnaagncctgttgaaatgnanaattgtctgccccncaatcaagaatgtntgtntaaagtntgaataaatcncatatcaaatgncaaacttttncatntgaatgattttcncaaagaacatngnaaagtcaataaatcctcttaatttccac

SEQ ID NO: 517945 - DNA, 1184 bp, Homo sapiens
ggcgacgactttgtcaagaacctggatgtagtctgcaggtgggagtatcaccttatcaagatggaagcaagggttatgtccgatcgcttgcagaagtatagggatgatggatactactcacactggtaatacctagccaaggcagctaggaagcgaatctaagccatcgagtttgcattcggcctctcccgtatcgagacttgtaccactggacttgtctagtcgcccacgagaaggcttcttcgacatagtccttgtagctgtcactccagcctatcgtggggaactcgcacatcgtatcagtcctgaatgggaaaaccacgggtctcgagctgtgcatcactcacgtccgtctggcttggcgtgcgatgttacatctgtcctggattctcggggaagcgaagctcagtgtagggatgatggggagacccgttcagcgtggccgatcataagtgactcggcgtgccatggcgagggcgtcctacacgcgctagtgcaacatgtgaggtgattctaggtgcgaggaattcacttgacagtaatgtgcacaagcgagatcgttgtcgcagagagaacgatcaagatagggctaatagcacgcgagggcttgggcaaagcgatgggctcgcgactggtatcggaaggagaaaggaaagggcccatcgcccgggagaacgcattgtctgtcgcctctgggcttctcgcggtgagacgagcgcaagtatcgagattaacccttgttattggggagaactcgcgaaggcacctcggaagggggagagagggccattcgaaggggaattctggggccccctgatagaactctccattgggcccaaattggcgccgaaccatgggttggggacactatgctttggtggacgcaggttggatccactttttgctttggcaccgacctaagagcccctaggcatacccgccgaacaccgtggctccctttggtcaatcttccttggaggcgcattctttttttggaccccataggggattacctttggaaggggacgggggacatggcgatgcgatcaggggaaacgtttgatccccgtttccctggtggggggctgggggcccggagtgtacatgggccaactggggacagtgcctcggtcaaaggggtcccgccgtcactcgtggcccttgggatgtcttggcccgtcacc

SEQ ID NO: 517946 - DNA, 222 bp, Homo sapiens
gcgagtgccatcacttcttaagaagtctggatggacgaagttgttgcgcaacacttcgtccacccggatttgacttcaagaagtgtgtggtcattatggcaacaacttcgtccatacagaccttccattcggatctcatagtagtttggaccctcggcgtgtgcaacaacttcgtccattgtgatctgatttgaagaagtgtgtggagcctcggcgtgtgca

SEQ ID NO: 517947 - DNA, 245 bp, Homo sapiens
gtgaattctggtacaggtataggatctgagtctgtcactgtctgaggaagtaggatctgaccctggtgtgggtatctgggatctgtccatgtctgaagaggtaggatctggcccattaggactatgaggctctgggtctgtcagtatcttaggaggtaggatccgggtgcaggtacaaggatctggatctgtcagtgtcttaggaggtaagatgtggccctggtatgaggatctgagtctgtcca

SEQ ID NO: 517948 - DNA, 568 bp, Homo sapiens
gcagcaccgggacatataagacgtcagtatctagatagtgaataattaagtaagtgaaaaatttggtaagtttaccttggtaccctttgaactgaccaatgctcataatgtagacagcggaaagtgttttcattcaggcaaatcatacctgcatccaatgtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatacgtttgggaaatgtcaaagctgatgcctttaaaaatgcattgaaacactatgggaatatcaaactatgaaaaagacaagattttccaatctatatgttttccactttgaagaatacatatatatatagctgattataaaggttacagatatgcattgtcaagcattcaggaggtacagagaaattcttacacgattctcattgttgacagcacttgctgagaatgctgac

SEQ ID NO: 517949 - DNA, 294 bp, Homo sapiens
ctaaggatcccggcgttgcgtgtattcggtgaaagcgcttgtgaaggtcgcctttattctcttgtctttcgtacaggtaggaatggaagtaattaaagccgacctgaattactcccggtctgaactcagatcacgtacgacttcagtcgttcaacaaacgaccctttgagcggctgcaccatcgggatgtcctgatccaacatcgagtccggtaattgcaatagctctgctggactctagaataggattgcgctgttatccctagggtaacttgttccgttggtcaagttattg

SEQ ID NO: 517950 - DNA, 906 bp, Homo sapiens
ttgtgactggggagtatgggcggcactccctctacaaaatgcttggggtacttcagcctggtcgggcttctcctggctgcactccctgttaaggagattactaccaggccatcaacgtgctggagaacatcgaactgaacaagaagagtatgtattcccgtgtgccagagtgccaggtcaaccacatactataatgtagggttagcatatttgatgattgcgtcgtgtaccaggatgccatccgggtcttcgccaaacatcctcctctacatccaggggaccaagagcatgttccagaggaccacgtacaagtatgagatgattaacaagcagaatgagcagatgcatgcgctcgtggcattgccctcacgatgtaccccatgcgtattggatgagagcattcaacctccagactgcgggagcaaaatatggggacaaagatgttgcggcatgcaggaaatggtgacccacaagtctatggagaacttttcaggtaactcctgacccaagttcctgttgccggtagttgcccaaattatgattatgtgcaacccaactaggcaaaaagagcctttcctggacgcagctgaaggtgttcttgctgagtaacagcaagcggccagctttcaaccatccgcaggtccctgaagctctaacagcatgctttggcaagcttggtgctcctggacctccagagcagagtacggaaccggtctgtctcaagagagatgagaactcgttgaacacgaggattcagcctgatgggaatacgcgctcgagtgatcactgatagactgacagcatggacacaggccggaagggattaaccgcgacaaatgggatacccaaatagtgcactgtacactgactggttcgaggattgacaaacagtataatagggtgatc

SEQ ID NO: 517951 - DNA, 374 bp, Homo sapiens
  misc_feature (21)..(22): n is a, c, g, or t
  misc_feature (30)..(30): n is a, c, g, or t
  misc_feature (32)..(33): n is a, c, g, or t
  misc_feature (35)..(35): n is a, c, g, or t
  misc_feature (37)..(37): n is a, c, g, or t
  misc_feature (43)..(43): n is a, c, g, or t
  misc_feature (45)..(45): n is a, c, g, or t
  misc_feature (48)..(48): n is a, c, g, or t
  misc_feature (53)..(53): n is a, c, g, or t
  misc_feature (60)..(60): n is a, c, g, or t
  misc_feature (83)..(83): n is a, c, g, or t
  misc_feature (86)..(86): n is a, c, g, or t
  misc_feature (90)..(90): n is a, c, g, or t
  misc_feature (143)..(143): n is a, c, g, or t
  misc_feature (165)..(165): n is a, c, g, or t
tctcgtgacatggttccttanncgcacccnannananggggcnangantgagntgaatangtgagtcatgtatacgaggtgtngtnaatngaagtagttatctaatcccaacgctgcagcaagagatgagacatgattctgtnattaaggctaaaatactgcatntctagcaattattctcctttctgatatccccttacactcaagtgtgcagtacttaaaatagagcctggattgcctataattgtggctttttacaccctttcttggctatgaaatagttcatttcatacctcttggctttatacaacgatgtattgaatttagagaaggggcatgtgctatcttgcccacttacaaatgtagttctcggc

SEQ ID NO: 517952 - DNA, 536 bp, Homo sapiens
  misc_feature (185)..(185): n is a, c, g, or t
  misc_feature (201)..(201): n is a, c, g, or t
  misc_feature (210)..(210): n is a, c, g, or t
  misc_feature (218)..(218): n is a, c, g, or t
  misc_feature (231)..(231): n is a, c, g, or t
  misc_feature (244)..(244): n is a, c, g, or t
  misc_feature (324)..(325): n is a, c, g, or t
  misc_feature (356)..(356): n is a, c, g, or t
  misc_feature (414)..(414): n is a, c, g, or t
  misc_feature (524)..(526): n is a, c, g, or t
atgagaacctgccccctgagagtccctatctgtatggcctgcaccccaacgcagagattggctttctgacggtcacctcagagaagctgttccgcactgtcctggaaatgcagccaaaagagacggactcgggggcaggcacgggagtgtcccgcgaggagaaggtgaaggccagtgctggacgnacatcctggagaaganttccggagnactttcanacatggctgagantcatggcaaaggncagcggaaaagacacccactatgtggtagtcgccctttcaagagatgtgaaagagatgaactatccttgaccaacgaaanntgcagcctgttcgctcataggaatgctgaancctgggagctgaaggagagaacatgaccattcacagaccgacagtggaagatctgatnacagcgagctcttcttactatagacaccgtgccatagatacgtaggagtgggcccgaggaccatacccactaccatcgacggcgccaggcgagcctggggtacgcagacnnntgatagactc

SEQ ID NO: 517953 - DNA, 191 bp, Homo sapiens
acagtgtagccaaatcatgccattgcactccagcctaggcgacagagcaagatccaccctgccacccaaaaaaagattataccaatgagtaaggtaaacagagatgtcagagactgtactgtataagggggagttttcagtggcttgatcccatgcatttctttccagacaacaatccctattaagtatgt

SEQ ID NO: 517954 - DNA, 480 bp, Homo sapiens
  misc_feature (18)..(18): n is a, c, g, or t
  misc_feature (48)..(49): n is a, c, g, or t
  misc_feature (184)..(184): n is a, c, g, or t
  misc_feature (201)..(201): n is a, c, g, or t
  misc_feature (248)..(248): n is a, c, g, or t
  misc_feature (255)..(255): n is a, c, g, or t
  misc_feature (258)..(258): n is a, c, g, or t
  misc_feature (270)..(270): n is a, c, g, or t
  misc_feature (272)..(272): n is a, c, g, or t
  misc_feature (274)..(274): n is a, c, g, or t
  misc_feature (283)..(283): n is a, c, g, or t
  misc_feature (293)..(293): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (312)..(312): n is a, c, g, or t
  misc_feature (316)..(318): n is a, c, g, or t
  misc_feature (320)..(320): n is a, c, g, or t
  misc_feature (323)..(323): n is a, c, g, or t
  misc_feature (326)..(327): n is a, c, g, or t
  misc_feature (361)..(361): n is a, c, g, or t
  misc_feature (377)..(377): n is a, c, g, or t
  misc_feature (407)..(407): n is a, c, g, or t
  misc_feature (421)..(421): n is a, c, g, or t
ttttttttctgccgctcnagatcctttctttttcttgctttctttctnnctccatttctctttgtttttcctgctccttctccagctctttctccttttcctgctgtctctctctgtctttttccctctccttctctcgctcctgttcttgttctttttcaagttctttctcacgctcccgttntttttctcgctcccttnccctaatttcctctggagatggttgtttttccaggatgccaagcttntcatccnatngtttcagtttcncngncaagcgccntcctttggtnttccnttnttcntcttccncttnnngncgnttnncagcacgtctactgctgcagaaattctgaatggnggcttcgctttgcttncatattcatcttcataagtactttgctgcnttggaagggggggnctgggctttcaaggactgctggcaactggaaggtggatgcttctgtgcgccacttttgg

SEQ ID NO: 517955 - DNA, 544 bp, Homo sapiens
ttttgatgtgaccctacctggttcctggagacctacacacaacaaacaggactttgctgatgcctatggagtatccgtcacctgctccgtagcaatgtgggagccctggtcggcagtattgtaaggatattgccatcgtccataggggaatcatccacttctggtattagtttggctacctctctgtcaactggaaccatcccccatccactgatctgcgtttacagatcgccgtgatgagctatggaaatccccatcaccatccagtgcgatttgtgtctgacatggagaatcctccccttccatgctgagttctgtggaaaaacgattaccctgacacctgggtttgctccatgaaccctgatcctgaacaggaccggtgtgaggcttctgaacaaaacgcagaaggttcccctgggaacattcagaaaggacatgaagacgcaggaagagaagcagaaacaactgacagagaaaattcgccagcagcaggagaagctggaggcccttcagaaaatcacacccatccgctcccaagcagacc

SEQ ID NO: 517956 - DNA, 828 bp, Homo sapiens
aaggtcttcctgctacgtcataagcagcttagagctcctggatggctgaggactacatgatcgtgtacctgaacggtgccacgccccgtgcggagtgatgcctggaatcggctggactgaagaagtgctaccagatgatcgaccgtggagtgttgcaggaaaaacctgaagtccttgatcatcgtccacccctcgatggttcattcggactgtgctggccatctctcgaccctttcatcagcgatcaagttcatcaaacaagatccagtacagtgcacagctatggaagacctggagcaactcatcccatatggaacacgatccagatcccagactgcgtcctgcaatacagaagaggaaagactgaaggccaggagggagagcgcagaggccccagaccggagtaagagcatgcaccaggactgaagagaagccagaggtggacaccagttggaaaacaggtctgctctggtctcaagaagatcaggaaccaaagccattccagcccctgacacagatcaagctgatgcacacagaggaaccaacgaaacacaaaccactaagggtcacgataatgtccatagaagcgcgaagatagagacataacaaacggacatgggcgaacacatgcaagaagcccagaagaacccgcaggcaaaacgggcgctggggcccccagaatcataatcctgcaccaactgaagacccaacgaccaggggtgaagaccaaccgaacactctgaaaacccaaaacacaaacaagggagaacagcaagaagagaacaacaagacaaataagaaccaaaaagggccaactaaacgcaaact

SEQ ID NO: 517957 - DNA, 315 bp, Homo sapiens
  misc_feature (18)..(18): n is a, c, g, or t
  misc_feature (48)..(49): n is a, c, g, or t
ttttttttctgccgctcnagatcctttctttttcttgctttctttctnnctccatttctctttgtttttcctgctccttctccagctctttctccttttcctgctgtctctctctgtctttttccctctccttctctcgctcctctaatttttccctttccttctccagctcacattccttttcttgtcctttcatcttttgtagttctttctccttttctttctgccgctctagctctttatctttttcctgctctctttcattctccaattcctcttggatctccccgcccctcctccagctctttctccttt

SEQ ID NO: 517958 - DNA, 352 bp, Homo sapiens
tagagacagagttttgctctgtcgcccaggctggagtagagtggcacgatcttggctcactgcaacttctgccttccaggttcaagtgattctcctgcctcagcctcccgagtagctggattgcagtactacaccaccacacctggctaatttttgtatttttagtggagacaggggtttcgtcatgttggccaggctggcctcaaactcctgacctcaagggatctacccaccttgggctcctaaagtgctgggattacaggcatgagccatcacacctggcccgattccccaaactcttattcattctgcagtacccatctctgggaacccctcccccagagagtctctc

SEQ ID NO: 517959 - DNA, 441 bp, Homo sapiens
cggcacgaggccaaaccatatacccacatatagtgtatgcgatagagatagagacctgtcgcactagatatagtaccgcaaggggaaagatgaaaaattataaccaagcataatatatcaaggactaacccctataccttctgcataatgagattaactagaaataactttgcaaggagagcgcaaagctatagacaccccgaaaccagacgagctacctatagaacacggtaaaagagcacacaccggtatgtagcaaaatagtgggaagaattataggtagaggcgacaaacctacacgagcctgtggatagctggttgtgcaagatagaatcttagatcaactttaaatttggccacagaaccctctaaatacccttgtgaatttaactgtgagagcgaggaacaggtctttggacactatgccttgtatagagagtg

SEQ ID NO: 517960 - DNA, 502 bp, Homo sapiens
taacccctctttagctttttgcgctcaaaaaccaatttaaaccccccccccttgtaaacagggggggcaggtgacaaaaggcaaaaccgcacagaagcaagcctgtggagaccaccacgtctcctgtgccccccgccattttactcgcccgtgatggaggatgttttgttttacattctgctccctgtgtggctggggtgagagttcgagggttgagacgccctcgctggggggagacacggggccagctagagccccacctgttgagaagaacgctacaaacagcgggagacttgcgaaacaaggacccacagagactcggcgcgcccgcgagcgcaacattcacggggagacaacaccacgagggcacgagggcacacccaagaaaagtctgacgcaggggagcgaaaggcgggagggagtgaagaacagggaatacaacaaagagcggtaacagacgaacgcggcgcacgaacaacacacacaagagagggggggccac

SEQ ID NO: 517961 - DNA, 1062 bp, Homo sapiens
gaggtgtcaccatcacacgactataattattactcaggatccttgagactttgaggtcgctagttttgtgcagtgctcactgaagagcttcttactggatgtcatgagtgcctcgcatcaagttcgtagttgcttgctacagtgttgtaagctcgtactgcaacctctatcggttcgacgagattaccaatatgtcgctaattagaaagtccttggatccctatctgttctgagttgctggtggacatcgctggtttacgtgaactcgtacgatcaataggggcgaaagaagagcaatcttcctcagattagagtagttcgctcctgtgtcgatatggatagtgatcgtcaaagagtaataagcacttactaggtgggcacgtctgctttggctgactcggaagccgtcagtgcttgcgtgtcattggtctatgtgacttttgatgcttatgatatgagaactttcccagcgactatacccactacgtaaacgatatgtgtagacgcgtttacgtacgcttcgatggtctgactacgctcctttgcacatggacaaaccagcactggagggcatgcatgtttgcttggctgctttgatacgcccctatggaggatggaacttacggggtagacgttgtccctctgtgaaaagcggacgggcggtggctccccatcactctttcttgtttcctcatgcgcgccaacacatgctgctttaatcgttggttacctactagtgggtattttaaattagccgcgtagaaagcgctgccgggagttcaggctcttcgtcataaacgttctcgtggttatatagcgctcttggttccatgccatcgtgtggacacatacggtagtggggagcttgtgtgcccaatgagccccccttttgtggaagggtctcctagcgtggtcctgaagtggtttttccttcccctttaatggggctggttcctgtgcgagaccctttggggcgttccttttagacgaagggccttcctgttccccttctcaatggggccttgcccccgtttcttcccggcttgggtcccccatttcctg

SEQ ID NO: 517962 - DNA, 993 bp, Homo sapiens
atcccaactgagctgaccaggctcctgtagcactcccaggacccccgtgctcatggggctgtctcctactaacgcccaaagagatgaccaggaggaacccctgtccgagagcagggggccctgtgttgacctgtggtgtcaagttcaaggtgctcactggagcagcttctgcaggtcctacaacaaggaccacgccctcactacattcgctgtatcaattcccaacagccagggccagagcagcagaccttgtgctcccaagaggagtgtcctgtagccacgtctggaggcctgtggcctcgtggagaccatccatattccagtgctgtgtggcttccccattccgggtctctcaccgaaactttgtataactgatacaagttactaataaggcttcatccttgcacatgctctgtccccgacagcccagtatctgtgcaaagggctccctgaatggtgtccacacagcgaggaagccatgcttgaagctctcatccaggatcagttctccacattctgggcggtcctaactcaggcagtagccataactggtgactcgtctgaggccatgccagtccccatgcactgtggcaggaccaaggtgttcatgactgacactatgctggagcttctggaatgtgggcgtgccggtgctggagcatgtgcccgctgatccacggtggcgtggagggcgacaccggaccgagagcacgagccgagtgggggccgtcatgtcattcagggcaggcattcgtccttgttaactcggaaccattcctgaggtggtgggcttgcccagtcataagcgtgctgccgaactgagattgaatggcgctgcctgaacaccgactggctgccaaacccttctccacaccgttcgataccccggaacagcgctgagggaaaacctgctcgcgatctcagcagaatttcggccacaacacgagctcaccccggccgcatacaaagagtgtcacccgggaataaaatgta

SEQ ID NO: 517963 - DNA, 530 bp, Homo sapiens
gcatgaacacgtgccaggcacctgccacgccttcttgagtgggaaagtgttttcctattcttgagttttaagagttctttatatatttttgttaacagtcctttatcaaatgtgtcttttgcaaatattttttccttgtttgtgacttttcattctcttgacagtatcttttgcaaagcagtttttaattttaatgaagtctggcctatcaattatttctttcatggatcatgcttttgatgctgtatctaaaagtaatctggctgggcgcggtggcttatgcctgtaattccagcacttggggaggacaagatgggtggatcacctgaggtcaggagtttgataccagcctgtacaacatggtgaaaccctgtctctactaaaaacacaaaattagccgggcgtattgacacatgcctgtaatcccagctacttgggaggctgaggcagaagaatcacttgagaccggggtgtggggggtttcagtgagccaagatcgcgccactacactccaggctgggtgacagagt

SEQ ID NO: 517964 - DNA, 614 bp, Homo sapiens
  misc_feature (116)..(117): n is a, c, g, or t
aagacaaacagaccacccacacatgtagacacaacccgaacaggttataggaggacacactccctagttaaagcggctatacgagctaccatcctgctagggagagcctgaaagcnnaatgctgacttgactagctctggtcaatgaaagaaatcaccagtggaaaggctaccagggggctttctcaaaagagagggacagtaaactgcaagatgaacaactcaatgccatccaggtctggatgagaaagaacagtcgagagactgagtttcaggagtggaaacactcaaagcatcatcttccactttcttctccggctgctaggaagaagggaaaaacacagaccttctgaggacctgcggagcaaaccactggcttcagaaaagcaaacagggacttccctctgcgcagcaggaagcagttagcctagtcggaggcttgactgaagaaacaaatgtatccactgataatgggcaagagcctgaggctctggagccaagggggaaccctaaaaagctgattcaagtaagagaaccaaggatcatgcaattccacatggccacctcgaagcaggaatccgttaatgatagtaaaggactgatgaaaatccaaaa

SEQ ID NO: 517965 - DNA, 194 bp, Homo sapiens
ggatgatcgagccgtccgtctttggctattatgaatatgcgtggttaacttgagttatacaagtctctcttccagatgctactttaggttcttttgtggtatattgtcgaggagtacaagtggctagatcatatgatagttctatttgtcatttttgtagagaagccgccatactgtttgccgaagcttgatca

SEQ ID NO: 517966 - DNA, 430 bp, Homo sapiens
gaaacgatactgatacatttttatattaatactagaatacatagtttgcattagggttcatactttgtggtgtacattctgcgggttttgacgaaggtatggtggcatatattcattgttactgtatcatgtagaatagttttagtgccctaaaaatcccctttgcgtcacctctttcattttcccctctccctgaacaccaggcaatcactaatctttttctgtgtccacatttttgccttttccagaatgtcatgtagttagaatcatctagtgtgcggtcttttcagagtggcttctttcacttagtaatatccttttaagattcctcaagtctttccatggcttgatagctaatttctttttattactgaatgatattcctttgtatgacgtaccacaattcatttatccattctcctgctgaagg

SEQ ID NO: 517967 - DNA, 877 bp, Homo sapiens
  misc_feature (116)..(117): n is a, c, g, or t
  misc_feature (847)..(847): n is a, c, g, or t
aagacaaacagaccacccacacatgtagacacaacccgaacaggttataggaggacacactccctagttaaagcggctatacgagctaccatcctgctagggagagcctgaaagcnnaatgctgacttgactagctctggtcaatgaaagaaatcaccagtggaaaggctaccagggggctttctcaaaagagagggacagtaaactgcaagatgaacaactcaatgccatccaggtctggatgagaaagaacagtcgagagactgagtttcaggagtggaaacactcaaagcatcatcttccactttcttctccggctgctaggaagaagggaaaaacacagaccttctgaggacctgcacgaccacaaccaccgcccccacaaaagcccccagggaccctgcgtgtcgcacagacggaacccagcaacgccagaccggaagctccgaatgaaccaaacacatgccatcaactgaaagcggggcagcacacaccaacttacacccccccacgtataaccgccacccttccgattataacgataccaccccaacgacccacgcacatccacaacccagcgtcctacacagcagcggcccgaggagtatatccctgactacgccatgcagtcttaacacaaagcgccccccacgccgtaatacgcccaagaacgcattgacgtcagcacacaccgcactagcctacaatatacatgcacgcccaatcaccgctgacacacaccagactcaacaccacacccctccgccaagcacgacacacgaaaccggaccgcccgtatatgcaacgtcccaccgcccacacctccgtcctgccacctcgagccacnccacacgaatcaccacgatgtctcagagat

SEQ ID NO: 517968 - DNA, 135 bp, Homo sapiens
tccggtccaataattcattcttcggtctatctgacgtgcatagcttcggtaactattatttccattcctgaattgagtgcaaaccttttcctgacactgacagctgtctaatttattttcttcaaagttgacaaa

SEQ ID NO: 517969 - DNA, 649 bp, Homo sapiens
ataaaaaaaggtaagttaatttgctaaaactgtggcaaactttaaaattaacatccttggtgttaaaataaaactccgtttcttcagggcaagaccaaaaattcatgcattcctttctttcacttcccctcaaagcaacaggggaagcaacctctgttggtgtgagttttggcagtacaaagagtgttttcatataaacccatgaatttcacgtattagaaaatggatctggcaaactcacattgtaatctcctccaaacactctccagtgctgattagcttttgaattctgtcacaactgctagtagacatagcacaatttcaattttttggccatctatgtaattactaaaaatgtttgttgaggcagtacagtaccatggtagatatgtgattttgagtgaagtaacttgaaatatgactctccttatggtgaaacaagttatttctgtctttctgtgtctcagattcctaatgtgtaaaatggaagtaatattgcgtggcttagagcttgggctatactagatgctaaaataatgttagttgttcctatgcccctagttattctaagagctatcagtaagacccctgcccaaagtccatatattcctacctcaatatgtcccccctaagcacaggaactagcagc

SEQ ID NO: 517970 - DNA, 125 bp, Homo sapiens
gcctcttccacgcgggctgcgccctgggatgccatgcatgctgggtccccctgggggcggggccggtgtttcccagctagcggttgctccctacctgggagctcctctcacgtagccctgacgga

SEQ ID NO: 517971 - DNA, 699 bp, Homo sapiens
  misc_feature (23)..(23): n is a, c, g, or t
  misc_feature (68)..(68): n is a, c, g, or t
  misc_feature (98)..(98): n is a, c, g, or t
  misc_feature (107)..(107): n is a, c, g, or t
  misc_feature (114)..(114): n is a, c, g, or t
  misc_feature (127)..(127): n is a, c, g, or t
  misc_feature (162)..(162): n is a, c, g, or t
  misc_feature (293)..(293): n is a, c, g, or t
  misc_feature (357)..(358): n is a, c, g, or t
  misc_feature (429)..(429): n is a, c, g, or t
  misc_feature (434)..(434): n is a, c, g, or t
  misc_feature (608)..(608): n is a, c, g, or t
  misc_feature (673)..(673): n is a, c, g, or t
  misc_feature (680)..(680): n is a, c, g, or t
gtcgccttagtaccatggcccantctctccgacaccctgtacgagcggttcgggaatcctgcacgggnaccgcgcagcgcccccagttcctggagacngtggattcncagatcngcttgaagaactntgatcccccgaaggaccagcgcttttcgggcaccntcaggcttaagtcccctccccgccctaagttctctgtgtgtgtcctgggggacccagcagccactgtgacgaggctaaggccctggatatcccccacatggacatcgaggcgctggaaaaactccaccagnattaaaaactggtccagaagctggcccagaagtatgatgcgtttttggcctcagagtctctganncagcacgattccccgatcctcggccccggtttaaataaggcacggaaagttcccttccctgctcacacacncacgnaaacactggtggcccaagtggatgaggtgaagtccaccatccagttcccaatgaagaaaggtgttatgtctggctgtagctgttggtcacgtgaagatgacagacgatgagcttgtgtataacattcacctggctgtcaacttcttggtgtccttgctccagaaaaactggccngaatgtccgggccttatatatccagagcaccctgggccagcccccgcgcctatattaaggcaccnttgaatnaattctattacccagttta

SEQ ID NO: 517972 - DNA, 505 bp, Homo sapiens
cagaccaagtttgagaccctccaggcccatgcttgccagcctggacctggactgcgtcatcgctgaggtcaaatcacagataatgagcgccatggcctcatgcggccgggctgagggctgaaccctggtaccacgaccaagtttgagaccctccaggcccactgcgtgcgaagcatgggcgacgacctccggaatacccggaaggagattatccggagatgaagccgggcagtacagacggctgcgcggctgagatctgccaacaatcaatgaaccatgcgtgcaatcgtcttggaggccgcactcgccgaggccagcgggcgcgtgcggtcggctcgcgctcaaagactgccccgagccaacgcgacagaggagctagcaaagcgcggcctggcaggcgggcgccaagccgggatctgcgcacgggcaccctggcgtgcacgtacccagtgcacctccatgacgacctgacgcccgggcctggaacctcgacacctatcgccag

SEQ ID NO: 517973 - DNA, 121 bp, Homo sapiens
atcaattgtgctcgattttgttgatgattgaatcactagtgtataggagcaaggattaatatcaggcctgggataataccaggctgcttgagaataaactcagtctcctataataccagtc

SEQ ID NO: 517974 - DNA, 200 bp, Homo sapiens
aacagagtgtcctcactaagagagggacctgcatcaccctctgccaggcttgtgactctcttagctggggaggtgggagggcaggcgaagctgactctgttgatctaccatgcctggcctccctcagagccatgtaacgaaccctagaaaggagagaacgggcgtcaggggtgcacagtccacagctgaagagcaaggtt

SEQ ID NO: 517975 - DNA, 373 bp, Homo sapiens
atcagagttgttgcacaggtatccatggatatgaaccacacgctaggcgcagtggtcagatatatcatcacacataaacatatccaagaaatctatgtaggacaatttctccaccatgacaaggatacttacaggtagaaatcttacttttaaggcaattagcccattgacaaaaggtttactgtcttaaagctgtctttctgagatctaattccaaggacttctccacagctacgtgagatgcctcacaccattaggtgatgctttggacagaacagagtattatcatcttgtgtataaagcaattccttggattcggctcctcaccactttctatgccagtctcccatttatgtccctagtaatgcctatg

SEQ ID NO: 517976 - DNA, 418 bp, Homo sapiens
taaatctacttccagctgaacaacacaggcaaccataagcaagggaacgaactgcctatcacactgtctcctcttcattccctcctatggccaatatgtttttgggatgagcagcgagcattcagacattcgcatagctacgagccccgtgccctctgtcctgccatatgtgggttatatatttcatctctatttttatggaggcggagtctcgatctgtagcccaggatagagtgcagcgtcacgatcctggctcactgcaacctctgcctcccggattcaaatgattctcctgctcagccttccaagatgctgggataacaggcgtgagccacccggtgcccggacgagaaggaaacactaactcattctatgaggacagcattgccttgtaacaagggccagacaaagggcaaca

SEQ ID NO: 517977 - DNA, 469 bp, Homo sapiens
  misc_feature (3)..(3): n is a, c, g, or t
  misc_feature (6)..(6): n is a, c, g, or t
  misc_feature (24)..(24): n is a, c, g, or t
  misc_feature (49)..(49): n is a, c, g, or t
  misc_feature (151)..(151): n is a, c, g, or t
  misc_feature (224)..(224): n is a, c, g, or t
  misc_feature (279)..(279): n is a, c, g, or t
  misc_feature (294)..(294): n is a, c, g, or t
  misc_feature (307)..(307): n is a, c, g, or t
  misc_feature (361)..(361): n is a, c, g, or t
  misc_feature (388)..(388): n is a, c, g, or t
  misc_feature (420)..(420): n is a, c, g, or t
  misc_feature (459)..(459): n is a, c, g, or t
agnctncagacgctgaaggaccgnagtgaccacctcacttgaagctttnccacaggacagtgctgacagacaagagtgggcgacagtggaagctgaagtccttccagaccagggacaaccagggcattctctatgaagctgcacccacctncaccctcacctgtgactcaggaccacagaagcaaaagttctcactcaaactggatgccaaggatgggcgcttnttcaatgagcagaacttcttccagcgggccgcaagcctctgcaagtcaacaagtngaagaagctgtactngaccccactgctngccatccctacctgcatgggtttcggtgttcaccagggcaaatacaggttcttnggtgttacccagcctgggggagggagncttcagtcggccctgggtttcagcccaaagcntgtgttgtcagagaggtttgtgttgcaggttgccttccngttgctggat

SEQ ID NO: 517978 - DNA, 388 bp, Homo sapiens
  misc_feature (15)..(15): n is a, c, g, or t
  misc_feature (26)..(26): n is a, c, g, or t
  misc_feature (63)..(63): n is a, c, g, or t
  misc_feature (79)..(79): n is a, c, g, or t
  misc_feature (302)..(302): n is a, c, g, or t
  misc_feature (329)..(329): n is a, c, g, or t
  misc_feature (354)..(355): n is a, c, g, or t
tacccagcttgttanccctttaaaantttcctgttaattaggaacttttgaaaatttagacancctgagcaaacatggnaaaaaccttatctctacccaaatacaaaaattgtctggtccattgggtctcacgcctgtaatccccagtactttgggaggcccagggtggatggatggcttgagtctaggagttcaagactagcctgggcaacatagcgagatcccatctctagaaaaaaaaaagaacacaaaaattagctggacgtggtggtacatgtctgtggtcccagctcctccagggntgaggtggagtgtcccttgagccttgnaggcgaatgttgctataagcctagnncgtgccacgtgccttccagcctgggtgacagag

SEQ ID NO: 517979 - DNA, 3605 bp, Homo sapiens
aggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaataaaataaaataaaataaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagtcacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttactttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaagttctctctgtttt

SEQ ID NO: 517980 - DNA, 955 bp, Homo sapiens
  misc_feature (23)..(23): n is a, c, g, or t
  misc_feature (47)..(47): n is a, c, g, or t
  misc_feature (955)..(955): n is a, c, g, or t
taaaaaaaaaaaaatataataanaaaactcaccaactctaaaaagantagtcaaagaaacccaacgagagctggcagaaccacctcctggcatcaaagcccaaccagatgagagcaacgcccgttattttcatgtggtcattgctgaccctcaggattccccctttgagggagggacttttaaacttgaactattccttctagaataatacccactggcagcccataacgcacactccatgacctaaatttatcatccctaatgcacgacaatgccggcacgactccgccgatatctcgggaaacatgccccggcctcaatatctgcagatccccccccttgtagtatccgtcctagcccaagagaagctgctaccaatacagatgacccattagttgtattagtccacgttgcactctcatatgcacgagatctcatagcataaaagaagtcaagagttcgcacctactccatccgccctcgcaatcctttccattcacttcgcattctcattggtgtattatcttatgttgtgatctgatgtaatcacctcataccttacgcgagagtggtctacgccacacagctctcgcctccttctctcccgagcggccgccccgttctcggacagccccgcccgcacgcccgctagatctctcgtctctgcttatctttgcgtcatcgcttccccttaccgcctctcgcccgtcctctaacattctgtccgctttattgcgactttatacatacattgagtgcggactcgttgatatttatctccctcttcacgcgtccatatacagtgcgtattgtcatgatcttcagccatttagttatcgcaagccgcgatgttattctacttgcccacgcgccgccacattctaatttcatatgatctacaccctatcgccgctctattactcatccaccacagattgtattatgatgtgtccan

SEQ ID NO: 517981 - DNA, 890 bp, Homo sapiens
  misc_feature (242)..(242): n is a, c, g, or t
ccctttccaatgtggtggtggcccggtgccgtgcccctccccatccgcccccggaatgataattgccgtggggcgcgtgcccccgtcgccgccccagcctgtcccctgtaagggctcgtgcagggtgggataccgtcgcttccttatggtggatgaacgacccgggcgggacaggtgtgtgtgtcttatgtgagaggcatgtaagtcgcgcacggaagtgtcttgtatttgaagcgagaggngcgtcagacggtccgctcgacgtaatgctcctccgccccagcagaaggaaagatatgtcagcatctttcttttaacaaagaacaaatagacctccgcgggaagctctgggagggcaacttccttcttgcatatatcccccccccgtagggaattggttctcaccctccccttagataacacctccactatgggtgggcgaacacaccagccccctgcgtcttgaaaggaagaagtatattctttcttaaacagaagaggggagaattatgtgagatcagggtgagatacatatagacagatgcgtcatctatttcttgatatgatatggcttatggataacgtgtagatatagatatatacacccccatttctataggtgcatgccacataaaagatcgtcgccacaccgccgcaacattatatcatatagaggagtacttctcgcacgccgcacatggacacatccttatgtacggtgcgccatgtgaccatcatgttgatgtctaagagcatataccctcgacgaggcaccgctacccaatagagcaaagatgataattgctagaccgatgttactatgggaagatgatctaaacgaggtacaatcgccggaagaattggggttttcccaaacacaacaaaacaca

SEQ ID NO: 517982 - DNA, 536 bp, Homo sapiens
  misc_feature (50)..(51): n is a, c, g, or t
  misc_feature (53)..(54): n is a, c, g, or t
  misc_feature (280)..(280): n is a, c, g, or t
  misc_feature (380)..(380): n is a, c, g, or t
  misc_feature (390)..(390): n is a, c, g, or t
  misc_feature (403)..(403): n is a, c, g, or t
  misc_feature (414)..(414): n is a, c, g, or t
  misc_feature (417)..(417): n is a, c, g, or t
  misc_feature (432)..(432): n is a, c, g, or t
atacccgaccatgcctgcaccagatcctacctcctcagacatgaacaganntnnatcctcatactcatgccagatcttacctggagacatgacagacccagatcctcataccaaggccagagcctaccttcgcagacattaaaagacccagatgcttatatctgcgccaaatcctacttccccagacatggacagagccagatcctcatactcatgccagatcctacctcctcagacatgaagagacccagatccttataccagggccaggttctacctncttagatgtgggcagaccaagaaactagtatgtgtaccaaatcctacctccgtagacatgagcggacccagatcctcacacctgtgccagattccacctncttagacatntacagactcagancctcataccanggncagatcctacctccnagatactgactgcccgatacttgtactggcacgcagatactatctcatcagatactgagagacccatatgttccgaattctgatataacagtcagatcctacct

SEQ ID NO: 517983 - DNA, 135 bp, Homo sapiens
ggagggccgctgataagcttccaaatgatgcccacaaccattatcctattgaaagaggggactgatagctccaaggcatccccaagcttgtgagtacatcagtgcctgccagtgattgctgagctgtagactacc

SEQ ID NO: 517984 - DNA, 1075 bp, Homo sapiens
aatcaatcaggtaattaggatattcatcacatattgtggggcacatgtgatatttgatacatgaatacaagcataataatcaaatcaaggcaattaggatattcatctcaaacgtttatcatttctttgtgttgggaacattccaaatcttctagctattttgaaatatacaataaattatcattaactatcatcaccctatgctgctattaaacactagaacttatttattctctctgactgtatttttgtacctattatccaccctctcttcatccccaccccctactctttcttgactctagtaaccatcattctactctgtctccttgtttttagctcacacatatggaggagaacatgcaatatttgtctttctgtgcctggcttatttcacttatcatgatggcctccagttccatccatgttgctgcaaatgacagaatttcattatattttttatggctgaataatattccatggtgtatatatactacactatatccatttatctgctgatggacacttaggttgcattcatattttggctgttggaagtgctgcaataaacatgggaatacagatatctcttcagtatatggatatcctttctttaggatatatacccagcagtgggatcgttggatcatattggtagatctagttaagatagagggacctccatactggtttccatagtcactgtacctatttgaaatggcgcataatttgaaaataaccatccatcgttcgggaatcccacttcccacggtcccaggtcctgcagcaaacggacaaagcgcgaatccaacggggggtcaacaccacaccatcacaggctaactctgtaaacacacctggcctggaatacggggccatggccacgcaaagcttgtcccaagaaagcactaagagctcttctaatgctaagacggggtatacagacacacaagacgagaagagcattacccaagtcatcacagatcacaggccaaaacagcgcgcacaatagcacaccccacgagggcacccacacgtggtgtcacaaagcggcacccgtgataggacacacaga

SEQ ID NO: 517985 - DNA, 671 bp, Homo sapiens
  misc_feature (32)..(32): n is a, c, g, or t
  misc_feature (53)..(53): n is a, c, g, or t
  misc_feature (60)..(60): n is a, c, g, or t
  misc_feature (66)..(66): n is a, c, g, or t
  misc_feature (84)..(84): n is a, c, g, or t
  misc_feature (100)..(100): n is a, c, g, or t
  misc_feature (103)..(104): n is a, c, g, or t
  misc_feature (113)..(113): n is a, c, g, or t
  misc_feature (194)..(194): n is a, c, g, or t
  misc_feature (415)..(415): n is a, c, g, or t
  misc_feature (515)..(515): n is a, c, g, or t
  misc_feature (525)..(525): n is a, c, g, or t
  misc_feature (538)..(538): n is a, c, g, or t
  misc_feature (549)..(549): n is a, c, g, or t
  misc_feature (552)..(552): n is a, c, g, or t
  misc_feature (567)..(567): n is a, c, g, or t
acgagatactactgttagatactgacagaccngatctcaaaatcctaatgggncagatcntacatncagacatggatagacccngatcctcaaaacaggnccnnatcctaccncctcagacactgacagacccagatcctcatacctgtaccacagccaaccttctcagacatggagagacccagatcctcatncctgtactagattcattcctcctcagatattgacagacccagatcctcataccaaggccagagcctaccttcgcagacattaaaagacccagatgcttatatctgcgccaaatcctacttccccagacatggacagagccagatcctcatactcatgccagatcctacctcctcagacatgaagagacccagatccttataccagggccaggttctacctncttagatgtgggcagaccaagaaactagtatgtgtaccaaatcctacctccgtagacatgagcggacccagatcctcacacctgtgccagattccacctncttagacatntacagactcagancctcataccanggncagatcctacctccnagatactgactgcccgatacttgtactggcacgcagatactatctcatcagatactgagagacccatatgttccgaattctgatataacagtcagatcctacct

SEQ ID NO: 517986 - DNA, 403 bp, Homo sapiens
  misc_feature (82)..(82): n is a, c, g, or t
  misc_feature (92)..(92): n is a, c, g, or t
  misc_feature (328)..(328): n is a, c, g, or t
cttcttggtacacctgtctgcgtctcctttgacctcctctgccatgttgcgacacagaacaaaatcctttgctaggaatcgnggccatgctntgaacttctaagtctgtggaactgtgagctgaataaaccctttttctttataagttatctagtttcagataggcttttatagcagcagaaaatggactaagatcccagtcctctgcgcaaattattgttctaactcttcttaaccgttggttacacctagagtaccaactctttgatttaaaagcaatttgagagtatctataattcttagtttgaaaattaacttattttctttntcttatatggagactgaaattagcaggcgaagtcacgtctctgttcttctatgttgattctgcaccaccagacag

SEQ ID NO: 517987 - DNA, 1201 bp, Homo sapiens
gccgtcatctactctaccatctttgcaggcacgactcatcacgagcgctaagctcgcacttgattttttacctgagtaggcctagaaataaacatgctagcttttattccagttctaagcaagaaaaataaactcctcgttcctacagaagctgcctatcaagtatttcctccgacggcaagactaactcgtaatcctatagatccttctaatcagctatcctcttcgacacatatactctccggacgaaggaacgcatagcgcaattgactgaccaaagtcgaatactcattgcatttaaataatcataatggctatcacgctagatgaaacactagcgaatagcgcccctttcacttctggagtcccagaggtttacccaaggcgaccccgtctgagatccaggtcctggctgtctatactcacgatgaccaaaaatctaggcccgccatctcaattgcatataccaggatctctccctcactaaagcggtaatgccttcttccttcacttctcgtcaagtctttagtcgcatccgatagcgaggcacgtctgacggtgggattgaagacataagcccaagggttagcaaaaattcgtttaggctattacgtccgttccaatttaccgcagataagggcattggacttacattagacagttccttaaccgtcacaaaccctctgtaaacaatttaaacgcaatttcctattgaattgttacaccttgatgctaactacttgaatcgcttagaaggttgaattaagccgagaaattgcccttcaacttaaattccaaatctaaaaagcgtcccatggcaaccccaacagaaagcctttactataactataatctcgcgcaacctcttgaaagaccacaggcttaagccactgggagctcttaaagaggacgccctttaaaaatttccccattaaccacgcacgttaccgttacttggcccttaaaggaagggcgccctgcccccggggttaaaccgcgcggctttttggggccccaaaagtgggggccacatctattccgagcagaaatttccccaaaagaaacagagatacgcgtgcgcaaaatgatccccacagcaatttgaattaggccacacaaattggcacgtttacaccacgggagatagtgtccgacacactatagttcccgcctttttagtaccataaacaacggttatata

SEQ ID NO: 517988 - DNA, 249 bp, Homo sapiens
gaagaaatatcaggcggaggcgcactacccgcctgtcctcgccgatcttacaacatcagcttcgtggcgctcgccctctacggcttcatcggcggggccttcagccgcgtgggctacggccgacgcatcgccttcgtcggcgcgggcgcagcggtgacgcgtatcgtcggcttcgcggtgcaggcggcctgcggcaatgcgccggcgctgaacctgctccagtacctcattcccatcatccccatcgtc

SEQ ID NO: 517989 - DNA, 328 bp, Homo sapiens
gcatagaaattgaaacctggcgcgatagatatagtaccgcaagggaaagatgacaaattataaccaagctatatatagcaaggattatcccctataccttctgcataatgaattaactataattcactttgctaggagagccaaagctaagacccccgaaaccatacgagctacctaggaacagctaaaatagcacacccgtctatgtagcaaaatagtgcgaagatttataggtagaggcgacgaacctaccgagcctggtcatagcttgttcccctgcataaaatctaagttcaactttagatttgcccacagaaccctctaaatc

SEQ ID NO: 517990 - DNA, 774 bp, Homo sapiens
gcaccatcttcagatctgttcctctggagcttgacttgggggtggggatggcaagtccatggtgtgtgttagtggacccaggcattgggggaagggaggcgaaggcctgaggtttccatcttcattctctttgttattaggagaaggtgaggcatgggccaattcccatttcctgcccttccagtgccacaacacgcctttcctgaatcctttcagggggggttcggggacatgggggttccactccattggggttcccactttttggaggttccaggaacattatctagtcccgttaccaaatccccctataaaggttaaacgttttccgcccctttttaaaacccctttggtgcccgctttgggaagcccccacaggggcggggggccccatattggcgggggcaacacccctttaggggaggcggttcaaccattgtcctatcccccccttactataaaaggcacggtttcttcggggcaaacaggtgcgggaaatccgggccctcttacgggtgcggggggcacacaaccaaaacacggggggcgttattcgtgggggagtagacagcgcagggtaattcggcacgtcgcgcgttcttttacgatgggggagaccccccattattttggcggcgggcggaagaccagcggcgaccgccgtattctattcaaacagcggttcaaatgttatccgcaacagagcgtactagcactagctgcaccgcactcgacaacagcgcacgccagcgtatgtaccccctatcgtataca

SEQ ID NO: 517991 - DNA, 233 bp, Homo sapiens
  misc_feature (39)..(39): n is a, c, g, or t
  misc_feature (71)..(71): n is a, c, g, or t
  misc_feature (74)..(74): n is a, c, g, or t
  misc_feature (139)..(139): n is a, c, g, or t
  misc_feature (211)..(211): n is a, c, g, or t
  misc_feature (219)..(219): n is a, c, g, or t
cccgtgagcaccgagcccccttctccttgcccttttctntccgttcaccctaaacaccaccggcgaggcgngcnttttggaccttccgtagcttccctagcaaggcgtttctctgggcgcgctctgtagccaacctcanattcggtgcccggaaaatcgagcctttggccaacggctacttcacgggaccaaccttccggggcggtaaacnaggttgantccgccggcaagaa

SEQ ID NO: 517992 - DNA, 420 bp, Homo sapiens
aaatccagtgaatcgactcgtgtacctgcttggttgggagggacatgtctgagcttggggtctctggggccatctggagaggagaaaccctccaggaaaggcctccagtattttaaaaacactcgcaaagaaggcaaatgtggccaggagtggtggctcacacctataatcccagcactttgaaaggccaaggtgggcagatcacaaggtcaggagttcgagaccagcctgaccaacatggaaccctgtctgtactaaaaatacaaaaattagctgggcgtggtggcacgtgcctgtaatcccagctactcaggaggctgaggcaggagactcacttgaacctgggaggtggagattgcagtgagctgagatcacaccactgcactccagcctgggcaacagagcaagcaagactgtctc

SEQ ID NO: 517993 - DNA, 360 bp, Homo sapiens
tccacacagtcttgctgtcacctaggctggtgtgcagtggcacgatctcggctcaccgcaacttctgcctcccggttcaagtgattctcctgcctcagcctcccaagtagctggggctacaggcgtccaccaccacgatcgaatgatttttgtattttttggtagagacggggtttcgccatgctggccaggctggtctcgaactcctgacctcaagtgatccacttgcctcggcctcccaaagtgctgggattacaggtgtgagccaccacgcccagcctttttcttaattttttaaaattctaggctacatggttcatcgtcgacgcggccgcgaatttattagtagtcgacccgtga

SEQ ID NO: 517994 - DNA, 454 bp, Homo sapiens
aagaggatccccacagtgggaggaaagtgatatcgagatgggcctctcgcttgggacacttacctgaccatgagttacgtacagaatccactggtttactatcattaactccgttgtatgtaggtcttcttacctgtcaggtatactgagcatgattatcattcggaccctccggaaggacattgccaaatacaacaaggaggatgacattgaagacaccatggaggagtctgggtggaagttgctgcacggtgagatcttacaggcacccccagtaccccatgatcctcagctcactgctaggaactcaggcattcagtctgattctcgtatgatcctcatcgtcatccttgtagccatgcttgggatgctgtcgccctccatccgggtagctctcatgaccacaggctgcttcctcttcatgttcatgggggtgtttggaggattttctgct

SEQ ID NO: 517995 - DNA, 932 bp, Homo sapiens
accaaggggcgcagagccccctccgtgcgggcgaggatccgcgcgcggccgactcctctccccaggggttcgccccgcgtaagcgggggcaagacagacgaaagggaagggtcgcgcacgagcagcaacagccactgggggaaagaaaacggccgacaccgggggggtagacgctgcgcgaaagcccgctgaaagttcctcgggccaagacgcgccgtccgaacaccggtcggggagccggcgtgcagacgcgtccgtcgcctcgcacgcccgggagacacttgcgggggcagcatcaatcatcccgggggccacgtgtggataaaagccggcctggcagccgccccaacagcggggacaaaagagggggggttttctcctcgaaaacgcaggcgggaggcatgggggcccaacaccacgagtgggccagggacgcagtgagtcccccacagcaaggagggtgccgccttgtcgcgcgaggacccccgcgcccgcgaggatggggtccggtcgcccctctcgaaccgccagatcggagagccactcgccgccgagggccgaaattcccccccgaaaacgttcttgtccgaaaggcggtgcacttcctccacagagcagaagtacttccgtggagggccccagcccccatgagagggatacatttccttgagctcccacgaagtacagagacaaaatatagtaagtacgagggaaaacaggcgccaacagagttgctcactagaaactttcgggggtttcctcccacatgtttccgccaaagaccgaatagcaattctcttcacgtctcccgaggcgaagcatcgaagcgaagtcgttgttttctgggtcgcgatatgaaaatattactcctcgagccctaatctggggttttcaaattcttaaaacccattaaaacgcaggcccacataaca

SEQ ID NO: 517996 - DNA, 143 bp, Homo sapiens
ctatccctattaatcattacggcggtcctagaaaccaacaaaatagaaccgcacgtcctattcaattattccatgctaatgtatccgagcaaaggcctgctttgaacactctaattttttcaaagtaaaagtcctggatcccc

SEQ ID NO: 517997 - DNA, 589 bp, Homo sapiens
ctgataggacctgaagtaagtttttttttattatggcgaattataaacaaagctggacaaaacatcctctgctcactgggacatctccccccacaggatacattgaatgggaaatggactcatatgatgacaggcaatagcattgatagatattgccaaggtaaacctgcccacctcccaaagagtttaactagtatccactcacaacacctgattacagaatacctgtcctcttctccttggaggacaactaaaatgatcatgtatattcttttatcccagcctgatgtgcggaaaatacgatatataatggccactctgatcatcagtgagacagctatttctggtcagagcttattgaccttttagaatttctgtactgagagaacatcaacactcatcccaaccaatccgtcgtccacacttactaccagtgttacagcaacgctggtgagacacaaagccaaaatccaatatcggggcaccaggcagcataggaatgaacagaacgaattataaatataagtaaacctcaagttgtatgccaaaaataacattcctaaagggaccccaggcaaacgtgatgaga

SEQ ID NO: 517998 - DNA, 663 bp, Homo sapiens
  misc_feature (29)..(29): n is a, c, g, or t
ggtgttccccccacacgttgggggggcgncaactatcagcgccgcccatcaagttggtatgtaggggcattaatcgtggggccgccgtagtaataagggtgtccaataactctttcttcgtctctctgttggtgtgtccatcataagaagacaccacttcgtggcaccagccgtgcgtcataaatctcagttgtgttctgctcctacacaatacacatcgcgactcgtctggtcttgtagacaaaaaggcgccgcgcccggcgtctgctctcttcaaaagatcgcaccagacagagagatgacagatgagctgcacgacacccgccccgcgacacacgcgtctcacatcacagcagtgcgacgacgccccccgagagacacactctctctcgtcactgcgactgcggactagacgtgtgtgcgatgagacagaagattagtctctcacactattgtttgtgcggtgtgtgtctttggggagagaggtcggagataaatacagcgcgcctctcggagagagagaaacagcggctttcgacgccgtgttgcgactctctcttctatttgctttcttttgctcgctctcgagagggtaattaaacgctatttttctcacttcatgtcccacaaataacaacaaacacacaagaacaaaaagaaaac

SEQ ID NO: 517999 - DNA, 190 bp, Homo sapiens
cgcaggaaggcgtgctgagatcggcgtgaaggcgattgatcaggggcgcttctccggcttcgtcaacgcatgctgaaagtcgggagcgctggaggtgatggtgccgcaggggcgcttcggctaccagccgcaggcagagcgccacggcaactacctggcgatcgcggccggctcgggcatcacgccgatg

SEQ ID NO: 518000 - DNA, 378 bp, Homo sapiens
  misc_feature (89)..(89): n is a, c, g, or t
  misc_feature (94)..(94): n is a, c, g, or t
  misc_feature (162)..(162): n is a, c, g, or t
  misc_feature (189)..(189): n is a, c, g, or t
  misc_feature (215)..(215): n is a, c, g, or t
  misc_feature (309)..(309): n is a, c, g, or t
  misc_feature (359)..(359): n is a, c, g, or t
tccaagctaaggaacggtttggggcagtgtcgttcccggagtcggccgccgttacccgctcaccagctacgcgacgctcaaggtccgcngaggncggcatcggggcgctgcgggacggtgaggccctgctgaggactccggcaagtgtgggtcgcggcgacngcggggctaaggccatgggtccgcgcncgtcttgaccacggccggggcttggnatttcctggccttcctgttgagccgtgtaaacgcggggtgatgacggcgccgacctctttggcactgttgtgagagcgaagttgagcgcgaganagaacgccagcttacagtttttttttgggttatgttcgtcatgaagcccngcgcttttcagttgttgca

SEQ ID NO: 518001 - DNA, 397 bp, Homo sapiens
  misc_feature (280)..(280): n is a, c, g, or t
  misc_feature (335)..(335): n is a, c, g, or t
ccgcacattttacaggcatgagcaccgcgcccagcgagctaatcattattacagtagccctatgctgatagtcttggcttctgtcctttgttacaacagacccaatcggtagggtctctgggctctgtgtgtcgcataccttcagatctgtgtggtggctcattggcccttgacgtgtgggaaggcatttgctccttgctgctcagaccctctggtgactccccttctccccgcttctcccaaactcctgaggcccagggacctgggaattcagtggccntgtggttggggtttggacccgggccctgccaccggctggcacgcctgaccttganacacatttcctaaacgtagcctgagtttccggttttctacttctgtaaaattggtgcggccg

SEQ ID NO: 518002 - DNA, 995 bp, Homo sapiens
ccagacgtcggcgtgactgagatgggtcgcctcggcttcctgactcggaagcgcagtaggaggcggatcgtgggaaggtgaagagttaccctaaggatgagccgtacatgacggtccacctgacagacttcctgggatagaaggatgtcatgagtcacatcgtgcgggaagtaagacagggcgggatccaaggtgaagaagaaggaggtggtggaggctgagaccatagtaagagatggtagccgaagtggtggttggtgggacattggtgggctatgtggaaatcccgtcagaggcctcgagtagtcttcagcgacatgtctttgcttgatcgacttccagtgatggaatgctatgaggagtttgctataaagaataggaataaaggcttagaacgaaggacttgtaccaaagtaagtgcaaagaaatgggagggatgaggatgggaaagaaggagttggagaaggagttcaggcgagcatgaaagaagtactggaagtcaatccaggtcatggtccacactcgcagatgcgcgctgcttcctcctgggccagatgaaggaccatcctggatgaagatacaggtgaacggaggcacctgtggacgggaagctggacgggccgcgagaggcttggaggagcaaggtacctgtgaagcaaggagtaggggcacgatgagatggatcgaggcaatggggtgacaagggcgagggtctccaagggggcaccagcaggagggctgcccaggaagacgcacgaggaccaccgagggcgcgcaggggctgtatggggcatgggatctgtctgtggctcctggggcacagtgacatacggaacaacgagggatataagaaagacggcagcggactacagcagagtgctcaagcgtctgttaagctaccggacctggtgtgacacgcaaacagctaatcggggagacgagaaagagccgaggaggaagaagaaaaaccggacacgaaacaaggaagaaacagg

SEQ ID NO: 518003 - DNA, 183 bp, Homo sapiens
  misc_feature (128)..(128): n is a, c, g, or t
tacgatcaggagttaccttaatgcgttactaaccaaactccattcattgtaattctgcagcgtgctgccacacgacattctgagggctcgtcataactatcctctgtgtgatttttttccccaaaaangataagaaagctgaggatatcaggaattaccagcagcagtttggggctatttcca

SEQ ID NO: 518004 - DNA, 99 bp, Homo sapiens
gggtgcggccgggacaggctcagtgccacatgcactcttcccgaaagcacttacagtgtgacaatgcctcctgggcaatgctggtgcctccagctcttg

SEQ ID NO: 518005 - DNA, 110 bp, Homo sapiens
cggagagacttgctcactctgaaaaacttgactaacattgatatccgtaagactagttttccattctatgcctgaaacttgtcagtggcccgacaagatgacatatttga

SEQ ID NO: 518006 - DNA, 371 bp, Homo sapiens
gcgtttgagcaaaggacttagcataaaggccatattagtggattattcaaaacgacgacgtgcattggcttctacgcgcgttgcgctgtttctaccgataccacgcgacgaccaaccggccatagtgcaatagcggcaattttaaagttcgcaatgccgacaggaatgccaatgattgaaatacattgtgcgatgcccgttgcaatgtgcatcaggcataaccaccagccaaagaaaatcagccagaaaatattcaataccgtaccgccagtattcagcagcacatttttgccagccgggttcagttcatcgacatgaatagcttcattgccataaggcaccagagacagtttagtgatctcccagcagga

SEQ ID NO: 518007 - DNA, 569 bp, Homo sapiens
  misc_feature (127)..(127): n is a, c, g, or t
aaaacagcaactggccccccaccccccaaaaaaaagacttgaaagggaacttcaacatatatacgcaaatatatctgaaggtcaataagcatatgaaaaggtgcttcatcaattttactcaccaggnaacttccattttttttttaaaatttcttttctctctcttttaattgagacagaatctcgctctgtcacccaggctggagcgcagtgatgcaatcttggctcactgcaacctccgccgcccaggttcaagcaattctcctgcctcagcctccagagtagcttgggttacaggagtgcactaccatgcccagctgttgttcatttaacaactgggttgtttgtcgttttattatgattatttggtagtgttctttatgggatacatagagacataaatatatgtttttatgattagtacctttatgtctaagaagcctttgcctgctcagaagtcatgaagatattcttctatattttcttttagatgctttattgtttgagcttgcaaatttatgtctgtgattcatcttttactaatgtttgagtgtgatctggccgggtac

SEQ ID NO: 518008 - DNA, 153 bp, Homo sapiens
cagacaggcaatctgatttagtgctaccccttttcctagtctgagttctagcttggtgacattctttatggagagaggctaaggtacaggttatccacttccttctcttttgtacttgctgcgttggagtgggagccacgaacggaaaaccgg

SEQ ID NO: 518009 - DNA, 393 bp, Homo sapiens
  misc_feature (4)..(4): n is a, c, g, or t
  misc_feature (332)..(332): n is a, c, g, or t
  misc_feature (334)..(334): n is a, c, g, or t
gcgngccctccttgcagaaaaaaaaaattttttttttgagatggagtttcatttttgttgcccaggctggatctcagctcactgcgggctccgcttcctaggttcaagtgattctcctgcctcagcctttttagtagctgggattacaggcacccacctacgagtgaggacatgtggggtttaactttgtttctggcttgttttaattaaccaaatgtcttccagttccatccatgttgctaccaatgacaggatttcattactttatggctaaatatttaatagtattccatttgtatatatatatatacacacacacacacacacacacnanattttctttattcagtcagtaattgatgagcatctgggctgtttacatatttttggact

SEQ ID NO: 518010 - DNA, 786 bp, Homo sapiens
  misc_feature (237)..(237): n is a, c, g, or t
actgagcatcgtgagaagcttgtgctagcataagagtccatcggagtcgacgaaacctgatgactacacccaatgatgtctgtgagctctttactgacatcaggacggtggaaggtcccaatggttccctcgtgcatttgggtctccaattgtggacagagatgtcttgtgttccagtatagctccaactgatgcaagccagtttcggtgttccttcccaattgtgggagtcctccngttcatccctagatgcaagaatatgccaacatccgctaatccgggtcgagcttgcatactcgaggcatggtgtgcgagtatgtataaccgagcatgcaatccctaatagataggctggtgtaccagcataggtagattgcatgagtggtattcgcacaacgaccatacacgcctgtccagggcagcacatatggacaatgtattctcttgttaccagcgaagcggttacaatggagacacgagttaatcccaataggattctctgtgacctggggaataccactcttctagtggtgtcaagttgcctgggtggccccacgggtttccagggcaggagcacactgccggccagtgatgtgcatttgcagcaggagcaccttcagacaccttcagggaaaccctattctgctagcaactagaccccactttacagagtgctggggccagaaataccgactcaggagaggtgcagtttaccagaaagcctccagagagtgacactgagagtttcaaagtcagcagaagaaaaaagtcaagccagatgtccaa

SEQ ID NO: 518011 - DNA, 374 bp, Homo sapiens
gacgatctccagcaaattcataccggcatcatgctctcaacacgcttgctgaatgatgttaatcagcctgaagaagcgctgcgcaagaaaagggcctgatcatgagtgaaaaaagcattgttcaggaagcgcgggatattcagctggcaatggaattgatcaccctgggcgctcgtttgcagatgctggaaagcgaaacacagttaagtcgcggacgcctgataaaactttataaagaactgcgcggaagcccaccgccgaaaggcatgctgccattctcaaccgactggtttatgacctgggaacaaaacgttcatgcttcgatgttctgtaatgcatggcagtttttactgaaaaccggtttgtgtagtggc

SEQ ID NO: 518012 - DNA, 411 bp, Homo sapiens
cgctcgtatctatggtttcgctttccacagtttgttacctcagtcaactgccagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaactt

SEQ ID NO: 518013 - DNA, 313 bp, Homo sapiens
  misc_feature (178)..(178): n is a, c, g, or t
  misc_feature (196)..(196): n is a, c, g, or t
agatcctggtatgtgtctcgattctgcagaagtccaggatcactgaacaggtacataataagaaaattaagaataaacaatgatgtacaaaagattagatgtttatcattatctgaaataacttcatacactttatcgaatatatttagttatgatattattctcagtgactcacagncattctcatttaacaggncattgatggagaagaggccaggggggaaaaaaaagcaaattcacaggatggccagggttgttatttcatatggaataaaggtcaacatcttgttaatgggcggagtatgccttcttc

SEQ ID NO: 518014 - DNA, 205 bp, Homo sapiens
ttacatgatcaatcgagctcggtacctgaacattcgtgtccctccgacagctcggcagtccctcctgggctcccgccgtggccgctcactccttgtatttagccaagagtgtttctaccaccaacattgctggacatttcaatgatgagtctcccctggggctacgccggatcctctaacagtccacagactccctcaacatgcg

SEQ ID NO: 518015 - DNA, 275 bp, Homo sapiens
tgagagtgactgagaccatcacacagtgataatgcttggtggggctggctgccatgccaaatccctgtatatttatacaagatatacatgtgatgttcagggtgtgacccgaggcccactccaccctccatgccccagtgagtgtggcacaagaaatgccgtctctcaccatgggctgaccccatggggcgcttgggcagggttgccctcaggcaggtgttgggcaatccactggcctaggaaagcctatggttaagtgtactagggaaagccaa

SEQ ID NO: 518016 - DNA, 396 bp, Homo sapiens
  misc_feature (140)..(140): n is a, c, g, or t
  misc_feature (252)..(252): n is a, c, g, or t
  misc_feature (309)..(309): n is a, c, g, or t
  misc_feature (330)..(330): n is a, c, g, or t
gccccccccccccccccccccaagccccagagagagaaaggcagaggtttaaattctctttctggcccagggtaagtaaaaaattaagaggttaaagccaggggccttgtaaaacccccccccttttttgcttcaatatnctaattccctgtgtagcttttgttcattgccatttatttaaaccaaaaatgttgtataaccccaatactaaatgtactacttgagcttcgctgagttaagttatgaaacttncaaatccttcatcatgtcagttccaatgaggtggggatggagaagacaattgttgcntatgaaagaaagctttagctntctctgttttgtaagctttaagcgcaacatttcttggttccaataaagcattttccaagaaaaaaa

SEQ ID NO: 518017 - DNA, 232 bp, Homo sapiens
ttaaaaagctacccgcgtacttaaattatgggtaaatagcgttggtgtccgtatttacagacttgaaatgtatcaagtcctgagcagtcccgatgtaaatccgagaccagctgactgggagtcttggtctcagtttttaaaagggaggtcccatgacggcaggctggctgctatgaacttgagttgttttcattctttcccacatgtactatttgctgcgggtcgcttttaa

SEQ ID NO: 518018 - DNA, 686 bp, Homo sapiens
tgtgctcgatgtgctggactggggcctgcgtgtgcgcccagtgcgctctgtgcgcatgccgtgtgctgccggtgttttttgtctgttggctgtgctgtgccgtgctgtgctgtgctgtgcagctgtgctgtgaagcacgcatgtgtccctgcatgtagtgctatgtggtctgagatgacctggagacttgtgtgagctccatgcgttgccgaccactccatgaatgtgcccaacactcacacgagacagaacttagccagcctactactaacctaacacttaatgcaatccacctgagacacattgctgagaagagacctagtgggttccccaagagggcacattgttagcctatgccattgggtatccacttagcaaagtgaacaacaacgtcgttggacgccacttttgcaccgtgaatatattcgagccatgcacaattaattgagcctcgcgctcgctgctctcttgggaaaacaccgatatgggccaagcgcacctagtctgacccatataatattacttaaaaacccttcaaggcaggcacaatagtacaccactttgtggaaacccccttggtggccctccaccgctttaactccttccaaaacttatgggtttggccatataaccccttggatcccgggttaccgcaaccctagggatacatttggccatgactacca

SEQ ID NO: 518019 - DNA, 197 bp, Homo sapiens
  misc_feature (29)..(29): n is a, c, g, or t
  misc_feature (140)..(140): n is a, c, g, or t
  misc_feature (177)..(177): n is a, c, g, or t
cattattcgtctactctcttaataaactnggctttcactgcggacttgccctgaattctttcttgcgcgagatccaagaacactctcttggggtctggatcgggaccgcctttttttttttttttttttttttttttganacagcgtctcattctgttgccccggctagagtgcagnggcgcgatcttggctcactg

SEQ ID NO: 518020 - DNA, 493 bp, Homo sapiens
  misc_feature (187)..(187): n is a, c, g, or t
tctatattaaagtggtttttttttctccccccccctagggcccccttgtttttttaaaaaatagggaagaaagaaccctttttgggacccggcggtggccccctccaaacttcattatttttgtggggttttcttcctggggggggcagccccttgggtcccctttgaacccctttgcctttgaaanttaatttccccccaaaaaaaggccccttgtttgttggtttttggcccgttggggaaaatgcctgtttttttatgccccgggacccccaatgtcccatataaattggcttttttttttaaaaaattttaaaagttggggaaagggtttttttttggcccgcttaaaaattgaaaaaggttttttcccccccctttaataaatgtttaggccgatgtaagggaatttttgggtttttttagaaaatgtccaaatcctgaatttttccaaataaactggggggtttttaaaatccccccaggggtttta

SEQ ID NO: 518021 - DNA, 306 bp, Homo sapiens
caacacaaaagcggacaaaagcgggggaagaccgcttagagctgctgaagctttccacctttgccctcattatcactcctggggaccctcacttggttatctcctctgggtgtgcgacgcggctctttgaagccctggaggtcggggccgtcccggtcgtgctgggggagcaagtgcagcttccttaccaagacatgctgcagtggagcgaggctgccctggtggtgcccaagccgcgagtgaccgaggtccacttcctgttacgaagtctctcggacagcgacctcctagctccgcttttgtgtt

SEQ ID NO: 518022 - DNA, 427 bp, Homo sapiens
  misc_feature (9)..(9): n is a, c, g, or t
  misc_feature (45)..(45): n is a, c, g, or t
  misc_feature (210)..(210): n is a, c, g, or t
  misc_feature (229)..(229): n is a, c, g, or t
  misc_feature (413)..(413): n is a, c, g, or t
ttatagtgnccttcccttacagctttgttgttatagatcaaatangataatgaagtgtaccctgctttgtaaatccatgaaagcagtaatttttaaatacccttttttcaagaaccttccttaagaatctgatgaaaggcccaggcatgaatggcttatgccctgtgatcccagcactttgggaggccaaggcaggtggatcacttgagncccaggagttcaagactancctgggcaacatggtaaaactccgtctctacaacaacaacaaaaaaattagccgggcatggtggtatgcacctgtaatcccagctactcaggaggctgaggcagaaaaatcgtttgaacccagaaggcagaggttgcagtggaacccaggttatgccactgcactccatcgtgggcgacagagntagactctgtctca

SEQ ID NO: 518023 - DNA, 317 bp, Homo sapiens
aactgtttcggatgagggtggcttggactaaggtggtggccacggaagacaaaaggatgtggacatgaaaatatctaggaggtgaaaatacccactgggatttattggacaggctgactgctgacttttggcttgagcacctggaccacaacctgtaaaaggagcattatttaagaggtggagtgttccgagatttgggcatgttgaatgtggcaatgcttatgaaatggctaatgggtctgtgaagtaagcaggtgggtctatacaggcctctttccttatgcttcaaacccattagccatcccaagcaattgccg

SEQ ID NO: 518024 - DNA, 349 bp, Homo sapiens
  misc_feature (30)..(30): n is a, c, g, or t
  misc_feature (59)..(59): n is a, c, g, or t
  misc_feature (123)..(123): n is a, c, g, or t
  misc_feature (294)..(294): n is a, c, g, or t
gtcgacgcaggacctgaccaccaccaggancccagaactgtggagtcagtggcagcatnagcgcccccttggaaagctttaggcaccagctgcaacccattcgagcagccacgtaggctaacnccagcaaagccacaggaacggggctacctgaggccttgggggccaatccctgctccagtgtgtccgtgagcaggcacacgaagtcaaaagagattattcttttcccacagataccttttctttcccatggacccttttaacagcatctgctttcatttcccttcacctttnccagggttgatcttgaggttaaatttttgaagttaaaattaaaagctgtgttttg

SEQ ID NO: 518025 - DNA, 572 bp, Homo sapiens
  misc_feature (530)..(530): n is a, c, g, or t
  misc_feature (549)..(550): n is a, c, g, or t
  misc_feature (553)..(553): n is a, c, g, or t
  misc_feature (562)..(562): n is a, c, g, or t
  misc_feature (570)..(570): n is a, c, g, or t
cctccccccccccccccaaaaaaaaaagcttctttcttttttttttaataaaaaaaaaaaaaggagaaaaaacccccccccgggagggtagagagaggcccccctccccaaaaaaaaaaaaaaaaaaggaagtgagcggggggggcgcccgtttttttttttttctgtggggggagggggggtgtgtttcccccccgggggggccccccccccccccccctttgggggggggggggaattttttttttttaaaaaaaaaaagggggggggggggccccccttaaaaaaaaaaaaaaaaaaaatctccccccgcccccccgggggggggggtggagaaaccccccccaaaggggattccccccccccccggggggaattttgtggggggggaacccccccccccctttaaaacccctttttccaaatttttgggaggcggccccctttggtttctttgtggcaaaaaaacctcccttttaccccaagtctcccgactttggcacaaggcagcagcttttccccagctggcnacatctgtaaacagcttannccnttagcaagnaagagtcngg

SEQ ID NO: 518026 - DNA, 217 bp, Homo sapiens
  misc_feature (213)..(213): n is a, c, g, or t
gtactttttctatgtgtgaaattttctgattccatcagaaatatacagtcattgaagagggccttcataatgctacaaagggagtagacagaagataggtttaaagaaggagaaattcatcatctactacatctaggcattataactggtaatgctgtatgatctaagagcacagctaccgtaagtctccagtcctattttctggtactcagntcag

SEQ ID NO: 518027 - DNA, 498 bp, Homo sapiens
  misc_feature (9)..(9): n is a, c, g, or t
  misc_feature (16)..(16): n is a, c, g, or t
  misc_feature (51)..(51): n is a, c, g, or t
  misc_feature (63)..(63): n is a, c, g, or t
  misc_feature (105)..(105): n is a, c, g, or t
  misc_feature (123)..(123): n is a, c, g, or t
  misc_feature (172)..(172): n is a, c, g, or t
  misc_feature (468)..(468): n is a, c, g, or t
  misc_feature (489)..(490): n is a, c, g, or t
  misc_feature (498)..(498): n is a, c, g, or t
aaaagtgtnaaaattncccccattggaaagctattttcccaaggaccttanaaggcatgcctnaatctttccttaactcatttttccttttgtctccctccttanctgtgtgttttcaaaaanagccctatccttcaggctcaactaattcctttccctctgcttgatcaantctgttgttcaagtgactgaacagactgggggtggtggctcatgccctacaatccctagcattttgggaggccaaagcatgaggatcacttgagccccaggagtttgagaccagtttgagaccagcttgggcaacgtagtgagactaccatctctacaaaaacattaaaaacttagttaggtatggtggcatgcacctgtggtccctgctctttgggaggctgaggtaggaggatcacttgagcctggcaggtcgaggctgcagtgagccatgatcacaccactgcattccagccnggattacaggagactctgtcnnaccaaaan

SEQ ID NO: 518028 - DNA, 401 bp, Homo sapiens
cttttggggtctttgctcacgggggcgatccattctaagctaataaacatgtagagcgagcagtggatgtagcaaaaacagaggagatgcagttgctactaaaaagagaggagcctttatctgatgatgatgcaagttacacagattccgaagaggctcattctgttaatccttctagcgttgatgaaaatattgactctgaaccagagacagactctctcatatgagaaagcacacagatacttcccatcaaacacctattccatctgcccttgatgagtataacttcaaagatcattatgatgaacaatattaataggacgactgatgatatgtcatattctgaggaaagaacaacgaaaagataatgaacctgaggcagacaatactcatttatttgc

SEQ ID NO: 518029 - DNA, 639 bp, Homo sapiens
agcggagaaagactgagaggagggaaagccgcgtaggtgggagtaccagcggcgcgaagggtcgagggggaaccctcgtcggtgcagatgaggagggtgggctttcagaactagtcccccctcgcacccgcccgccctcccggctggggtctcggtgcctgctcgagcggctccagcacgcccggaagagggagccttctggacgtcggctggctcagggcgggccggttggctgtaaccaggctccctggcccgagtgcgggaccagagcgcggggcggtgcggagtccgcggaccgacggcaggggctgcgagcgaacacggcgcggcgcggcacggcggacgagttagggccggggcgaaggcgagcgccgtgggctcccgaacagcaacacagggcgagctaggtgttcgggctgacggcggagctgttgcctggacggcagcagcaacacggagctcggcacacaacgccacagccgttcgttcggggacaatacatatcaggttctccggaaactccgcacacgctgtcacattggacgcaagcagaatttacgtgaataactgacgaactaggtcctccatcctcacgctactacgcacttttggaacttgtctttccacataaggaatctg

SEQ ID NO: 518030 - DNA, 104 bp, Homo sapiens
gtcctggggatcttagtaagggcaggagttagcggtacaaagttgacagccctcatcaggtcttcaatgtaacctggggggttaccaacttaatgtcaggacaa

SEQ ID NO: 518031 - DNA, 769 bp, Homo sapiens
gtgatgatgccggcaggttagcggtggtagctggcattatggtgatgtggtcaaggctgtgcacaggccctgcggtgttttcgcagcccagtgtcattccatcaccgagattgtaccccatcaacgcactgcaggtcgtgccatggagggcatatgaggtgaccaccatggatgaggcctgtctaagcgagggcgacatctttgtcaacaccacaggctgtattgacgatctaatccttggccggactttgagcagatgacggatgatgccattgtgtgtaacattggacactttgacgtggcaagatcgagtgtcgcagtggctcaacgagaacgccgtggagaaggtgaacatcacgccgcaggtggaccggtatcggtgggaagtaatgggctgccgccatcatcctgctggccgagggtcggctggtcaagctgggttgtgccatgggccaccccaggttcgtgatgagtaactccgttcagccaaccaggtgatggcgccaggatcgaggctgtggactccatccagacaaggtagtcccgtatggggcttcagttttccgtgcccaagacagcgtggatgaggcagtgtgctgaagcccacctgggcaatcctgaggtgtgacgtttgagcaagtctaactgagaagcaaggccagctacctgggcatgtcctgtgaatggcccccttcaagccggatcactaccgctactgagaggcaggtctgcgttttcaacgcctccagatggtgtcttgtccaagccc

SEQ ID NO: 518032 - DNA, 491 bp, Homo sapiens
gaacccagtaacaccaatggtagggaggaggcacctctcagggaacaaaagtgggtgagggcagccaggggctttctctggactcaggagagaaacatcagcaactgccttcccatggggtgcaggtctcctgtggccctctgtacctagccactcctcgggccaacggtagcaaatgcagcctccaccctcatcccggctcaggcctctctggttccctccctgactctccaatactcactgtgtgcccttgagtaaattcctcctcctcttagacctcagtttccccacccattggcttagagaggggaactagatgatcttcaaacccccctgctccagcgcttgtttcctaaactccgccaggggctcctgggtcacagcctctgtctcctgggagggagtgaggactgggagacttggggcttgaaatctttgggagaagacagctcccttgttcattcagaataattctttcaaaggtcaaaaaa

SEQ ID NO: 518033 - DNA, 399 bp, Homo sapiens
  misc_feature (322)..(322): n is a, c, g, or t
  misc_feature (389)..(389): n is a, c, g, or t
agcaaagcattgcttataaaaatgaaagattaaaaatgtagatgtctaacactggacccccatttgcaaagaaacaggctgccatagaaacactgtagagctttttagtttgtgcaagatatgaaaatgtgtttttttttttgggtaacctgagaaaattaaaggagaccattttgaattgcagaggtggtatgacttggtgagattggaacagggcttatacttgctttgcctctgacctgggataaattactttgctcagtttaccttatctgtaaaatggaggcattttaatacttgccccccattagatgccttaganatgtgaacaagcattttgaattcttatggaaggaaggcagttgtgggaaatttcaccagtgttgatnaaattaaatt

SEQ ID NO: 518034 - DNA, 906 bp, Homo sapiens
  misc_feature (649)..(649): n is a, c, g, or t
  misc_feature (906)..(906): n is a, c, g, or t
ggaacgcgcccaccgagcctatctgggctgcgtcttctcgccgctgctcttcgtggccaacgccccaatccttgcgtgtccttgcaagtcccaccccaactcagccttgtgtccctcgatccagtctccgatttccatttcccacctaaacggctacccggtgtctgttccccgccggtgtgtcctcgccccttgtgcgctgagtgtccccctgttagcctcgacccatggcgctgcaagacgctgcaagagctcgtgggtgacttccgaagatcctgtctcattccccgaggagctgagtctggctttcgtctacggctcggggtgtcccgccagggacagggcccagttcaaggaccagaacgaaatgctattgcgggccttttgtgttcacaggtacgatgaccgctgtctgcatggctttcaaagcacctgaagcaaacacctgggaggtcccctactctttcccttaaaagtttgagggccccagacttatcacgtccatccagagtaacttaatggcgctggagttcactaccatcatggatcatgtgtaccatggtcggctctctcacctctggagttattaggcactaagtctgatggagatctctcaaagtggaattacttataatggctgacgattcanaaaccggtgaaattattcagtgacgggctgtattcttgataaggctgggtgaattgagagtgtgtgccggttctcatgcccgaaaggttttgaaaggctttaaagtgggtctctataggattcgaggtggtggagatccacatggtttggggcatagactctgggcttggtcaggacacggggtgacaggggataaccgagtcagaatgagacaatagcgaaggaatggccggggggctatttttctggttgtattn

SEQ ID NO: 518035 - DNA, 320 bp, Homo sapiens
tcttgaagtcctgacctcaaggtctccacccgccttggcctcccaaaatgctgggattacaggcatgggccatcacacccagcctgatgttactactataactgttttggggtaccacgaaccatgcccatataagatggcaaacttaacaaatgttgtctgtgttctgactaccctaccaacaagcttccctgtctctgtctctctcctcaggcctccctattcattccttgagacataaaagtattgtaattaggtcaattaataaccctcttaagtatccaaatgaaaggaagagtcatagtcgacgcggccgcgaa

SEQ ID NO: 518036 - DNA, 163 bp, Homo sapiens
gagtgatgaggtcggtacccaagaagacactctgggctcccaaagtctggattccagcctccaggttcctatttgggcatatttacataatttcacatttttatgctaaagtttttttttttcggtctgtcgcccaggttggagtgcagtggtgcgatctcgg

SEQ ID NO: 518037 - DNA, 161 bp, Homo sapiens
tatgctgatggagagagctcctcggttatgtggacatgcttaggtgtagctatgaagccccttcgctggccacgggttatggtagcatacttgagctcagcctctgactgcgagcaagttctaggcacaagcagccagtgctaaagccagaaccgaggccc

SEQ ID NO: 518038 - DNA, 593 bp, Homo sapiens
catggtggctcgtgcctgtaatcccagcactttgggaggctaaagcaggtggatcacctgaggtcaggagttcaagaccagcctggccaacatgacgaaaccccatcactaactaaaaaatagaaaaattaggccgggcgtggtggtgggcacctgtgatcacagctacttgagaggctgaggcaggagaatcgcttgaacctgcgaggcgtaggttgcagtgagccaagatcgccccgattgcactccagtctgggcgacaagaacgaaactgtctcgaggaaaacaaaaaagaaatacaaaacttagcatggtggcatgcacctgtagtcccagctacttgggaggctaaggcaggaggatcgcttgagcctgggaagtagaggctgcagtgagccaagaccgtgccactgtactctagcctggttgagaccctgtcccaaaaaaaagagtgggccaaagcactcaacagatcccttacgaaaccagatacacagatggcaaacaagcatatgaaaagatactccacatcatatgtcagcagggaaatgcaaactagaacaatgagatgccacacacacctatcagaatgg

SEQ ID NO: 518039 - DNA, 116 bp, Homo sapiens
ggaggtgctctgaggatcccttgggagccttaccctgtaccgagctctaaccctaaccagtgctcttttcacagccatcatctttccctggcaggtggtgaaaagaggcactggtt

SEQ ID NO: 518040 - DNA, 927 bp, Homo sapiens
tggtggtttcataggcgtgtttttcccgggtgcgaagcgtgtggctacctgttttgatccccccccgggggagcaacacactcgcccacctctttctgctctggctgtactccccatttttggagatttctttgagggtcacacgtgcgccccccttctcgtcccgtttgctttgcccccccctttttgtgtcctgtgtttgcgtcgcttttccgcctcactcgaagaggtgggtccactcatgtgtacgcacaacgggcgggtgtttgtacgaaaaatggctgcggctccatgtagacgaaagggcgcttttttctctccttggtgttgtctctccctttctcttccacatcatgtgcgatcgccaccgcccgtatttgtgtccccctccctacaacccttgtgaagcccccggtccacggagagtgacctcgtggggctcacaatgcctcacccaaacccttttccttctcctcctggcccttgggtgtctcttctcaaggccctctctttgcgttttatatctgtgagatccctccctctgttgactctcacgcggcgctctgtttgtctatatgccctctctgtgtgcgctctcctgaaatcttttcagcgcggctcgtctccgcgcggtgtcctcgtgcttatgagagccctgtttctcccacagcctctttctgtccctgcacgcccctcgtgaaagggcggtttctcgcaccctggccttctcgtgtgtgttggctgagctgtacttctgtgccgtgctaggctggagggagggacagggatcgggaggcacatggtgtttcccgctcccccgccctttcgttgaggccccaccaccctgcccccttttactttgcattgaacggcctgctcccaagatcctctttattagggcacccgagagcctttttgcacctttta

SEQ ID NO: 518041 - DNA, 974 bp, Homo sapiens
cgtgtcccccggggataagaattggcttctcaaatagcccacatttgggaagtggtgcctccataacgttccacagtgataaattggctcccgtaaataaggtaactttgaccccccccccaaatggggaaaaccctgatatattaggattgtaccccgagtgagggcccccaaatatgggggtgccaccaacctgggtaacccttttggccaaagatagaaagggtgtatataccacccactctgtgagaaatttttcgcgcgaagggctccccagggatgccccccaagagtcccctcttcctgtgtcacagggatctctggaaactcgtagactatagattgtgttttctggagaaaccggaacctttttgtctcccacgtccccccctgtctcctaaataagttcccccagagtcctggaacttggggccaccacgtggtcacagtgtagatttgtttccccgcccctgggccacaagatattttagtgaaagcctaaatggtagagggcctcggagagaaggtgaagatcccccagagtcccccgacactgtataagaaggttttttgtttataggcggcctataaagggggagagaaacactgagaaagtggtgttgtacacttcttttttcttataaaggggttgggtctctgttctctaaagtgtaagcctaattgtgttctctgtggttgccaatcacttgttgttacattccagagaccacctgtgggtgtacactgtgggttatatggcgctatggtacctggtatattggcgtcttgggtgaaacaaatatatttgtgtgtgaaagaggtaatggtatagtggcgcttctttttgtaacctgttagatagctgaattaatctgttctcacactttccaatctccccttcttgtctccccattttacccacgatagctactggaccttgaaatttattaaactgcccccgggccgtggtggat

SEQ ID NO: 518042 - DNA, 644 bp, Homo sapiens
  misc_feature (220)..(220): n is a, c, g, or t
tgcgaacgtaagccagatagtgtaatctgggctttgacgcacgagagcccgttcagagcggagtttgtaggcggccccagaccgccgcctgtcctagcgagggaacacagcacgccttcgtagatgtattttacagggtaaagagccgttttgggtgagccctttactttccttgaacttctttgcgggtatcctcatgggcgcatgtgtatgtccccgncgcgccgaagtgttggtgtcacctgaacgagttgtcacaacagatagcagtttctcctctccagcaggcatcacggtaaaagctgtactgttaggagcaaagtgacaaacaatacatggtggtgataaatccagcaacgggcccaattgggctggtaattcagtattacagagcctgatggagattatattatgggctgggtgcgctggtaggagcagtatttttggggcatacggtctgttttgaagctatatatagtgagccggaaggagaggccctctttgtgttatgtcctctcgctgcagcaacccgactgcgattattccacggcggctggctaaataacgtttttatcaaaaatttgattcgaggcagatcctataaaaataaaaaaacaacaacaagcaaaaacacgacataaata

SEQ ID NO: 518043 - DNA, 101 bp, Homo sapiens
gcccaaaggtatacaggcataaggttgagggtggttggaggagaggagctttcaactaggggtgaatagtaaatatagacactgaagaaaagagtgcttgg

SEQ ID NO: 518044 - DNA, 874 bp, Homo sapiens
gcgtgtaaaagcttcttggattcatttcattgatatacagccactatttatattttagatcagtggccttatgggccactgttcagggtactgaccatcagtgtcagcattagggtacaggatttttgtaacttatagggtataacttttatggacacatgtgaatcttgttcgtgtaaaattgaaattactttctcttgtactctgatgatgggtgttaaaagttaaaagagcatccggattaaggtatggggactgatccacggattatgtaagtgaaattgatagcatataaagataactatgtggcttaaacataaaatgaataataaggaaaaatttatagaaaagggagaaaaaataatacaaaaagaaaaagcggtaacgaacaatgtacagcaaaaccaccacaatgtctgggacaccacagggaacacacaggtggcaccagggaaaaaaacaccacaaacatcccccccagtgggcgcaagaaacacaacgttcgaccacagagataaaaaaaacggagaggcgacaatatcccccacagtagaggaaaccacagtggctgccacacagccacaacaaacgcacaggaggaagttgcacaaacaacgcagctcaaaaacaaaagccggatcccacaacagagatgaaccaacaagacaaaacaggggacgcgacacacaaaaaaaaagcgcccaagagtaaggcacacaactaaccaaaacagcagacaaacaaaaatcaacagaaaaacacaacaaaaaaacaaaccccacagagcaacctgagcgcgcaccatcagacaccaaacaaagagcctccaacaaacaacaacagaagctgcccgcgcgcccacagacaacgaaag

SEQ ID NO: 518045 - DNA, 292 bp, Homo sapiens
acagatgggctcagatagattaattaggttaatttagcaaatgctctgatatgttgcacaagtcttctcccctgagactactcgatttgaagcacagacacaagagatgcgcgtgtgtcagactatgtcttatagagatgcaggccactctcctcccacagggccttgggactggcaggacaaacactgctacatgccctcccaatggctggagtcacggtcaggagcgactggggtggaaaatatggaacaaagccacaactactacttcatttttggcatttgtccatgt

SEQ ID NO: 518046 - DNA, 999 bp, Homo sapiens
tgctttgggtttgtactcgtgctgctcgtgtgttctctgtaacaccgtcattggattgtctgaacttgtatctttcatacgtacagtgcttgcctgcaaacccgtgtggtagattcgaataggataatgatctgtgacactccgtgttgcctaaaaatatatcttatttcggttcatgagcttaaaggccggacgatctattcatgcaccttgaaaggtaggtgtatgtagtgtgagtcctgatactgtattcttttcatatatacgtatcggcccagtgcaggagcgtatgcccgagatcggaatctgtagttcgactcattgggtagttgctcagtggcaaatacaccttatagaccgtacaagttaaatctccttgtacctctgtccacgttccgtatcatgtctagccatgctcacctgttgcacacgattaggctcgactatgtaaatcaagtgctaccaagaagatgactttgtgtatgcagttgtcgggccctgaacgaggctgcactctgtattgtctataacgatacgtcagcttgttaggtagacatgtacagttagcagttgaatgtgaaggagcgatagcgaaaacgtgtaagaatcctgtggaaggaggactgacccttgtaggtcgcttggcaaggtaccacctagctgtggtatacctaggtggcgatgcctgatgagtggcctgataggtgatctaggtgtgatgatgactactggtgcagcttcgccttcgattttgccgacctgctaaatgtggctgttcataacctaatcgtattttctgtcaaaatctcttctcctgtcacacttgtgcttatttaaactgtttcctgctggaacaaggctctaatcccctggtcgcacacactcttcgcaggggatttgtcaaattaaagtaagcagactcatcgtttgtccaccagaaataatatagaagcgtctcggcacaaaaaacaacgggcggccacagaaaaaggggtgaaa

SEQ ID NO: 518047 - DNA, 145 bp, Homo sapiens
cgacggcgaattctttcacgcgttgtcggatccgacgcggttgaagctgcgggagttcatcctggccgccgaacgcacctccggggagtgtgtcgagcacgccggcatctcccagccgcgggtgtcggtgcacctgtcctgcctg

SEQ ID NO: 518048 - DNA, 489 bp, Homo sapiens
  misc_feature (117)..(117): n is a, c, g, or t
aacaaggaatgagcttacatcgttaacatgcaaataaatgacccttgtagcacagcggggcaccctcccagtgtgaggcgaggctgctgaggggagggcgtgtgagggtgaatgcgnacggtgcaggcgcagctctcggtccagcgccaggacatgggacagcatttacccaagtcagcactgctcctcttggcacctgaaacaactcaactcaccatttactggagctcagagaaagttcattgagaggctggcttcaaacgcagttaaaagacccgagagatttctttaggccagtaataacaagttaggaaaatacagcaggaaaaactcttcatcagcacaaaacgtgctggaataagataactgacgatcggtcagagctgatgcagggaacgccccggctccaggatggctccaggaccaggctcggggtccgggatgcagaggcccaggtggcagatgccgcgctaacctgacgcggccgca

SEQ ID NO: 518049 - DNA, 338 bp, Homo sapiens
  misc_feature (7)..(7): n is a, c, g, or t
  misc_feature (9)..(9): n is a, c, g, or t
  misc_feature (53)..(53): n is a, c, g, or t
  misc_feature (64)..(64): n is a, c, g, or t
  misc_feature (111)..(111): n is a, c, g, or t
  misc_feature (139)..(139): n is a, c, g, or t
  misc_feature (163)..(163): n is a, c, g, or t
  misc_feature (170)..(170): n is a, c, g, or t
  misc_feature (184)..(184): n is a, c, g, or t
  misc_feature (210)..(210): n is a, c, g, or t
  misc_feature (220)..(220): n is a, c, g, or t
  misc_feature (227)..(227): n is a, c, g, or t
  misc_feature (230)..(230): n is a, c, g, or t
  misc_feature (288)..(288): n is a, c, g, or t
  misc_feature (293)..(293): n is a, c, g, or t
tgtattncngtcatattgccaactggaaagtcaaaattttctaacaactttangtaagtttttngacgacttagtgctgtttttaatccagtttagaaagtaacttaattntaataccgctactaaaaattcgaaaatntcttctttaatcacattcaatacngttaaangaacaacactaatngacattgcgcgggctttttctccctncgtttaaaangtcattngtngagcaagagttgtatagtattatctacttactcgcggctgttaatttttcattacagngtttngtaaatgtatccacgagaccatgatgcattgttttgtgctcaact

SEQ ID NO: 518050 - DNA, 709 bp, Homo sapiens
gtcggcggacgtgctgccgagtagtccggaagcgaagcagcgatggcggagagtcgactgaggaggcggcaacggcgggcgccggggcgggggccccggggcgagcagcgtgctggtgtagtggcgttagcggcagcggcggcgggttcgggccgcctttcctgccggatgtgtgggcggcggcaggcggctagctgggctggggcccgggggccgcggggagcggcctggctccagatgcccagggctcccgcccgtcagccggctgcccaacggggccgctgcatgcttagccaacgtgggaaccccaactgctcaagctcacgacgtgggaacgggcgagacgcaaccggcagccggcaagtggtctaactccgggattcaagggcgggaattatcagtgttccactttgatacatcggacgccctccttccaaggcgaactggtccgtatgttacccgtgaattaccttgttggaccatggagctaaaggattccattgccatgtgatcaaccagtgccccattgtgacgacgtcgcgttatgaaacggcgggtatatcgttccagttgtatcggatgtcatcagggtgtccaggcccggacgtaatcccaatccaagccgaccttcaggggtccaaaccttgcatggaccaaccggggcgccaaaaattttaaaccgaacctaaaggcgtttgggaaaagaggg

SEQ ID NO: 518051 - DNA, 234 bp, Homo sapiens
cactgtgcagaggatacgcacgttgggctgtgaagtgctgggcgttacggtggactctcagttcacccactggcttggatcaacaccccccggaaagagggaggctatgggcccctgacacatccccctgctcgctgactgtgaccagacgctatgtcatgaggattactggcgtgcttgaaacacgcgatgcaagtggatggcactggggatcctactacgatgtcgaccctg

SEQ ID NO: 518052 - DNA, 174 bp, Homo sapiens
tgtggtgttacgtgatacagtgagtaaaagagcccatctttcatcattcagaaggtgcatgggttttgctacttggttaactgtcagtccttggagcccattacaaacctcctgcacttagagctcagctgaaaaatgtgttctgcaagagaaacccggttgaaatagagagag

SEQ ID NO: 518053 - DNA, 413 bp, Homo sapiens
ggtcttcctttgtctagagtgaaatagtatccaaaatttctctcttcatgtgctgccttttctctaatactttggctagagagagaaggcttttattggggattttatttttctgtactcatgggcatttctgcattgccggactgtcttcttctctccacattgcagagcattcttttcttctttttctttctttttttttaagatggtgtttccctttgtctcccaggctggagtgcagtggtgtgatatcggctcactgcaacctctgcctcccaggttcaagtgattcttcgcctcagcctcctgagtagctgggatttcagggatgcgccaccatgcccttctaatttttgtatttttagtagagacggggttttaccatgctggccaggctgctctcaaactcctgg

SEQ ID NO: 518054 - DNA, 323 bp, Homo sapiens
gcacacctgtggctggaaagtggtctattccggggacaccatgccctgcaaggctctgggccggatggggaaagatgccaccctcctgatacatgaagccaccctgaaagatggttcggaagaggaagcagtggaaaagacacacagcacatcgtcccaagccatcagcatggggatgcggatgaacacggagttcattatgctgaaccacttcatccatcgctatgccaaggtcccatctcttcagcctcaacttcagcgagaaagcgggagtcgcctttgaccacatgaaggtatgctctggagactttccatcactgccc

SEQ ID NO: 518055 - DNA, 107 bp, Homo sapiens
cgagcgccctggtggtgggtgagtgagccccattgtgttgtggtaaatatgtagagggagtatagggctgtgtacggagggctcgttacggaagggctcgttacgga

SEQ ID NO: 518056 - DNA, 518 bp, Homo sapiens
ccgagatcacaccactgcactccagcctgggcaacggagcgagacaacgtcgagagatagatatgtatatatctccaagaggtattttctgtaacacatgtgggaaaaaagagaaaaaaaaaaattcaaagaaaaatgattttggaagtaaaaaaataatgaacataaaagtccaagaggtcagctgaaaacgatgggaaggtccggggaggggggcagccgagggagggctgggaaactccataggcggtccccccgacacctggtaccgggctggccctcatctgtattctgggcaattatcctttacaaggggtctgcaaccctggggcagtacgggtccggggcctggttaggaaccaggcgtgacatcaggacgcaagcagcaggcgaacaagcatccccacaaagctctgccccgacagatcagggggagcatacgattctcacagaagcgtgaaccccagtgtgaacggcacacgcgagggatggagggtgaagcccctcctgagactcta

SEQ ID NO: 518057 - DNA, 430 bp, Homo sapiens
  misc_feature (18)..(18): n is a, c, g, or t
  misc_feature (34)..(34): n is a, c, g, or t
  misc_feature (49)..(49): n is a, c, g, or t
  misc_feature (88)..(88): n is a, c, g, or t
tacctcctcttctggacnagagaggacttgaggnccgagatcatggagnatcatggaggcccaggcattttccaaccttcagaagaanaaatgatgtgcactagctgcctataggagtcttcctttttacactaaaaaaacaagtctcgggccaggcacagtgctcatgcctgtaatcccagcactttgggaggccgaggtgggtggatccacctgaggtcaggagttcgagaccagtctggtcaacatggcggaaccccatctctactgaaaatacaaaaattagccgggtgtggtggcgcgtgcctgtagtcccagttactcggaggctaaggcgggagaatcgcttgaaccctggaggcagacattgcagtgagccgagatcatgctactgcataccagcctgggcaacagacaagattccctctta

SEQ ID NO: 518058 - DNA, 132 bp, Homo sapiens
agcggggaacagtcactttggctaggaacctagcaaaagtgaacaaataggattacatgagaggtgaaaaagcttatgtacagcaaaggaaacaatcaacaaagggatggttcgccgctggggtacggagct

SEQ ID NO: 518059 - DNA, 235 bp, Homo sapiens
  misc_feature (40)..(40): n is a, c, g, or t
aggatcctgagcgggagttgtgacgtacaggtggctaaantgcacaaagattatgtcccaggacacttccccaccaaaactcctgatgatgaaggccaggccctcacggggcacttcttcggttcaggaagaacttcaggccctcaaaaagcttcttgtgcttctcctgcgcctccagctccttcctgcggtcttcctcctgcgctgacatctccccatcggtgggaaactcatc

SEQ ID NO: 518060 - DNA, 112 bp, Homo sapiens
  misc_feature (42)..(42): n is a, c, g, or t
  misc_feature (84)..(84): n is a, c, g, or t
  misc_feature (88)..(89): n is a, c, g, or t
  misc_feature (99)..(99): n is a, c, g, or t
attttattcaatctttcctagaatttataatgaacatttgtnttttaatatggtagttatattacagttttaccttacgagcgntagnncatttggtgnataagattaacat

SEQ ID NO: 518061 - DNA, 702 bp, Homo sapiens
gggacccaggggaggtaataaatcatgggggtggttacgcccacactgctgttctcatgatactgagttctcacaagatcctgtgtgtttgataaggggcttatgccccctttagctcaacacttcttccgtgccatcatgtgaagaaggacgtgttacgtttccccgttctgccacgattgtaagtttcctgaggccttcccagcgtatgtggaactgtgagttaattaaacctctttcctttataaattacccagtcatgggcagtccgtttacagcagcatgagaatggactaatacactcctcaaagtgttgtggacagattgttgcaccgttggaactaccagctgatgcacacaaatcgtggcgtcaatgtagtatattggcccagcaaggcaacagaactgaagcttccaggatggaaagaaccatgtgattcgtccgtcagtaacgtagtataagaactacattcaaagatagggcaccgaaggacagcagataacactgagagagcatgggacaggcacaaaggaaggaaatgccaaaagatcgagggaagatctaaccaaggacgtaagtagaggataacacaagaaggaagctggaacagggacctgatgccaggcaatgcccgatggagaacctcggagaccccaacagaatgaggggaaatactccacacagcccacccgggtgcatat

SEQ ID NO: 518062 - DNA, 136 bp, Homo sapiens
agcgtccacatcacagaagcatgcactgcatcagcctagattgtataaaaaaaacaaaaccagtgcaggaccaggtatgcagacagcctgctcactcgagagcgagtccaggctcttaacttctgacatgctgagt

SEQ ID NO: 518063 - DNA, 149 bp, Homo sapiens
tccccacaatcccacctcaggctctcttactagaatgccaagaagagtattatgagatctagcgaagtaaagttcatgtttaaaaaaacgagagcaagaacaactgagcactaccggtgtacccacaattccctggacacgaatgttca

SEQ ID NO: 518064 - DNA, 383 bp, Homo sapiens
aggagggtacaatggagcggcattaaatgtgtaatgcacagtgctactccgcttgatgcaaataacacgagtgtgtttataagtggcacttatagggtatatagcgcggttagcctgttgagagtcagtaccctcgtatttgccgtgtaggtgctagactggagtgttaaaggctcaagaaatgtcatgcagagaaaaaaccttatgaggatatacatgggctcacccagtatcggaggcctctttgcacaggtggtgtgcgggcgccttgctaagagcgttctcgtgttaccgcgcgccagccttggtataagtttagtgtttgatatagtcggcagagtatgacacgctttatgatgtcacagtatattcactctcgtgcc

SEQ ID NO: 518065 - DNA, 219 bp, Homo sapiens
taggctcggaccgtgttggctcccaggtggctgggattacaggtgctgtgcacacgcccagctaattttttgtatttttagtagaaatggggtttgttagccggtatggtactcaatctcctgagacttcgtgatccagccgcctcggcctcccaaagttctgggattacaggcttgagccactgcacctgggaggccatcacacctgggaggccatcc

SEQ ID NO: 518066 - DNA, 187 bp, Homo sapiens
acagtatacccagaatggcagaaactaggtttcccagagtggaaagagagaggagactattcaacaaacggagtatttattgagcgcctactatgtgccaggcactgttctagaccccccccagaagaaaaaacaaaaaacaagatagaggcagcaaacacaaacttctgaggagagaggaaagggg

SEQ ID NO: 518067 - DNA, 142 bp, Homo sapiens
ggccagtgtcatggctgcccagtgcacataggataatagatagatactcccccacaggtacgaacctactagacatgggtaggctatagctactatgccatgactatcactagaggctagtcatatgctagcctatgcgccc

SEQ ID NO: 518068 - DNA, 1409 bp, Homo sapiens
  misc_feature (795)..(795): n is a, c, g, or t
  misc_feature (809)..(810): n is a, c, g, or t
  misc_feature (827)..(827): n is a, c, g, or t
  misc_feature (830)..(831): n is a, c, g, or t
  misc_feature (834)..(834): n is a, c, g, or t
ctgagaactgctttttacacagatctggaagaggcattaatgagatggtatcgaatgctcagtgtctaaatgtaccagttaatggtccgatgttacgtctaaaagctaatgattttgcccagaaactgggccataatgattttaagtgcagtaatggttggctggatcgttttaaatccaggtatggtttagtattcagagctcaacctgtagaagctacaggtgtaccagtagacccttcgactgtctggtaccaaaatgtacttccttattatttaaatgattatcatcctaaaaatgtttttaatataaaagagactgggctgctttatcgaatgttacctaccaatacatttgcatttaaaggcgaaacatgttcagttggaaagttatgcaaagacagaataactctggtggttggcacaaacatggatggctcagagaaacttcctttgcttgtcattggaaaaaagagaactccacattgtttcaaaggtttaaaatcattgcctgtgtgttatgaagctaacagaatggcatggatgacctccgatgtatttgaacaatggatgcgaaagcttgatgaggaatttcaagcccagcaacgaagagtggtgattttgttgagtcttttccagcacatccagaggtaaagaacctaaaatccattgagttagcattctttccatcatgtttatcttccaaatgtatagctatgaaacaaggtgttattaaaagccttaaaatcaatatcgacactgtcttatcaagaaattttaagctctgttgaaggtngcaaagaatttacnntttcactactagatgcngtnnatncattgctcttgctggagggctgtaaccccagagactattgttaaaagctatgaagaggcaggattcaaatctcaaaagggagaaagtgacataacaaatgcagagaaggatactggtctggatttggttgctgatgctctgggggcaggagtagaatttcctgaaggtttatctatagaagaatatgctgccctggatgatgatttggagacatgtgaagcagcaccaaatggtgattccgtatgcaccaaagaaagtaaatcggatgaaactggattttacacttctgatgaagaggatgatgatggatctccaggaactgaactccctttaccatcaaaatctgaggcaataactgctttagatactctgaaaaaatttctcagaagtcaagatatgaatgacggacttcaaaattctttagcagaccttgaaaattttattaactctttatcacctaagtaactatgtattgtacatctaaagagtaatagcttttcctgatacattttattatataaggtatgtaaaggagttgtaccacaccacttaaacataaaaaatggaaaactgct

SEQ ID NO: 518069 - DNA, 733 bp, Homo sapiens
  misc_feature (378)..(378): n is a, c, g, or t
  misc_feature (380)..(380): n is a, c, g, or t
  misc_feature (427)..(427): n is a, c, g, or t
  misc_feature (440)..(440): n is a, c, g, or t
  misc_feature (448)..(449): n is a, c, g, or t
  misc_feature (493)..(493): n is a, c, g, or t
  misc_feature (501)..(502): n is a, c, g, or t
  misc_feature (504)..(505): n is a, c, g, or t
  misc_feature (520)..(520): n is a, c, g, or t
  misc_feature (537)..(537): n is a, c, g, or t
  misc_feature (551)..(551): n is a, c, g, or t
  misc_feature (554)..(554): n is a, c, g, or t
  misc_feature (562)..(562): n is a, c, g, or t
  misc_feature (575)..(575): n is a, c, g, or t
  misc_feature (595)..(595): n is a, c, g, or t
  misc_feature (607)..(607): n is a, c, g, or t
  misc_feature (615)..(615): n is a, c, g, or t
  misc_feature (622)..(622): n is a, c, g, or t
  misc_feature (628)..(628): n is a, c, g, or t
  misc_feature (631)..(631): n is a, c, g, or t
  misc_feature (634)..(634): n is a, c, g, or t
  misc_feature (637)..(637): n is a, c, g, or t
  misc_feature (643)..(643): n is a, c, g, or t
  misc_feature (649)..(649): n is a, c, g, or t
  misc_feature (653)..(653): n is a, c, g, or t
gatcccagcatctcagagtgcagtcaagttccctcctgcagcctgccccctaggcagctcgagcatgccctgagctctctgaaagttgtcgccctggaatagggtcctgcagggtagaataaaaaggcccctgtggtcacttgtcctgacatccccattttcaagtgatacaactgagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgntnttggcaacaggagagacaggattgggccaacaaggactcagacgagntttattgactcanttctctgnntgatacggagccatgtcatgtgccacgacctggggtgggcacanggaggctnnannttcctgctgaacctngctgggcctatttgctnctagccacagaganagntgcccctnctgaacggccatncccagtgctccgtgcagganaggaacacccgnttgagagngtcccanccgacngcnttnttncatggntttatnaggnaaagacacccacccctcctggggtgtgaagacaaaacattgtccccctgaagggggaacccttggatattcccggggggg

SEQ ID NO: 518070 - DNA, 1173 bp, Homo sapiens
tggtttcagagggccagtagtgttgactatacattagtgggctgagatgaggagcctccaaggaagctttaggtctgggtgtttgctacacaaggaatgcatagctggacccaccttggtcatgctcttggtgcctatgaggccaagctctggccagcccagcctaggatctcacgtcaccctcctcttctaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggccgacaaaaacaaaaaacaaagaaataaaaagtatggaaaaaagtaataagacaaaaaccaagcaaagaaagttaaaaaagaaaaagaatcacaaatgcacaatagaaaacaaaaagggggggggcggggccctagataaaatattcccccggggggggccacaatgtatcggcccccgttattgttgaaagaggggcccaatagaagttgtataaaaaaaaaagcgcgcgggtgttaaacacaagtgcgtgggagaaaaccggtatttatgttattgtggaaggagaacccacactgtggggtgtggcatatgagcgcacaccctacagatgttatcgcgggggcacaaacacaagtggttggttggggcaaccccgttcattcgcggaaattgttcggttttttttattagccgtcgcttctactgacaacgacgacggagatgacaacgcgcggtacagcatgacgaccgattgaagacagacgtagactcaacaaacaaaagtaccaccgaaggcgagagagactacagtacatcaac

SEQ ID NO: 518071 - DNA, 711 bp, Homo sapiens
  misc_feature (324)..(324): n is a, c, g, or t
  misc_feature (326)..(326): n is a, c, g, or t
  misc_feature (373)..(373): n is a, c, g, or t
  misc_feature (386)..(386): n is a, c, g, or t
  misc_feature (394)..(395): n is a, c, g, or t
  misc_feature (439)..(439): n is a, c, g, or t
  misc_feature (447)..(448): n is a, c, g, or t
  misc_feature (450)..(451): n is a, c, g, or t
  misc_feature (466)..(466): n is a, c, g, or t
  misc_feature (483)..(483): n is a, c, g, or t
  misc_feature (497)..(497): n is a, c, g, or t
  misc_feature (500)..(500): n is a, c, g, or t
  misc_feature (508)..(508): n is a, c, g, or t
  misc_feature (521)..(521): n is a, c, g, or t
  misc_feature (541)..(541): n is a, c, g, or t
  misc_feature (553)..(553): n is a, c, g, or t
  misc_feature (561)..(561): n is a, c, g, or t
  misc_feature (568)..(568): n is a, c, g, or t
  misc_feature (574)..(574): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (589)..(589): n is a, c, g, or t
  misc_feature (595)..(595): n is a, c, g, or t
  misc_feature (599)..(599): n is a, c, g, or t
gatcccagcatctcagagtgcagtcaagttccctcctgcagcctgccccctaggcagctcgagcatgccctgagctctctgaaagttgtcgccctggaatagggtcctgcagggtagaatagagtctcgagggacgtgtgttccccagctgatcgtgtcagcctcatgccccaggcctcatctttcatggaccaggccttgttccaggagtgggcgttgggtcctctgcttcctgtgctgtcccctggggaaggtcccaaggatgctgtcaggagatggaagagtcatgtggggtgggaacctggggtgtggttccagaaatgntnttggcaacaggagagacaggattgggccaacaaggactcagacgagntttattgactcanttctctgnntgatacggagccatgtcatgtgccacgacctggggtgggcacanggaggctnnannttcctgctgaacctngctgggcctatttgctnctagccacagaganagntgcccctnctgaacggccatncccagtgctccgtgcagganaggaacacccgnttgagagngtcccanccgacngcnttnttncatggntttatnaggnaaagatcacagcaggcacctcctggtggttgttaagatcagagccttttgtccccttgaaggggaaatccttatgcatcattccacgtggtcagtaaaccagaacccctgcc

SEQ ID NO: 518072 - DNA, 897 bp, Homo sapiens
cgatgttacctcctcaggccggagagtggccaccactctatatgccaggctggaagccaggtcctggccatatggctcaagcttcctttggagaaccttctctggccactctaatagggggtgggcctctttcttcttagggccaaattagggcttaaactgagaaaaggaactgctctgggtcttcctgtaaggcctgatgtgacagaaaccaggttcatctgacccaaaagtccaggtgggggacaagtgtacaaggcccctcagtgcctgaggtcagggctgctgctgcctttggggtaggtagggaagtgcagcctgccactgttgcctcccaatatgggcttggtgggcattgatggtgggtgccctgtgcaggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagaggtgagcacctgaagctgttctcactggagcagggggagaagactgggcagggcctccacagaagtccttgtctggggccaagaggacagaatggattaacccatttgggattaagttccatttgttagaccaggattgggacccactgaaagacaggcaattaacaaaggcaaattagccctccttgcaggcacacaatgggcaactggggttagatagagattgagcacttctttctgattagataaatgacctcttatctttgaccccttatctgaccccgtcacagcaggaaaagggtttttaaataaacaactttcttccagggaggaggacctcacgactccccgacccct

SEQ ID NO: 518073 - DNA, 429 bp, Homo sapiens
gtccagcaagttgggcagacgcatctgtgtagccaatgtcgtggcatagggccatggcttggggaatgggcatgcacctcatgcagccccagggagcccctgaccctgctgtcatcccacagcatcaccagtgtcaccagcagccacagcccctgctccatcactgccttctgtgccttggccttaatgaactgaggttgagggttttatagggctgttcctgcacccagggagccaacagaggagatcctgcaggggtttgcacagctccgaggtgcccggacccacctggtgaggccccaacatgctgactgggctgtttgtttttgattagcacacagcaggggactgtagaggctggaggcacctccactgggcttgcagattactggcacctaataaactgaagaaacctggaaaaaagaacaa

SEQ ID NO: 518074 - DNA, 608 bp, Homo sapiens
  misc_feature (324)..(329): n is a, c, g, or t
  misc_feature (331)..(331): n is a, c, g, or t
  misc_feature (585)..(585): n is a, c, g, or t
catactgatgatatctttgtaaaagaacactgacatctcacgtaattctcattgtatcacacttccttcaatcccgcccatgtttaattggtcgggaccaaatattcctcgagccttccattagggcatatatacttattcatgatgctgttaccactcccagcctgctgttaccactcccagttacattattttaccgtacggtgattccttctgaaccccactcttatttgttggcctactacatgccactcaagagggattcaaagatgagtgcgtggtcccggaagatgcagatgtggggtaccacagagaaagtgattnnnnnncnctagcggggaacaatcacttagttcaagtgattgttcaagtgattgttcaagtgattgttcaagtgattgttcaagtgattgttcaagtgattgttcaagtgattgttcaagtgatggttcaagtgatggttcaagtgattgttcaagtgattgttcaagtgattgttcaagtgattgttcaagtgattgttcaagtgattgttcaagtgattgttcaagtgattgttcaagtgattgttcaagtgattgttcnggatcctcagagtcaccgcagca

SEQ ID NO: 518075 - DNA, 427 bp, Homo sapiens
aatgcagcggactcggcacgtctcctcttcctgctccaatctgtagttctcgagctcctgaagaaatctcatccattaattcctgggagttctgttatgtaagacacagcttatcaaattgcatcattgatgagcttcacaacattggtaccatcagcagccgagacgaattacaggggccgggagaacttcttggcacatttgaatctttttttgggtcacgtttatgtctgcatcaattttattggccaccacgtatgcatgggatctctggcctgaactccctaatctctgtctaccatgtgctcaggttcctataggtgactttcctctgtacatcaaacaccatgatgcatgcgtgggccttgtggtactaggaggcatgcttgctctggaaccgctcctggcctgccgattccgctgcatt

SEQ ID NO: 518076 - DNA, 2878 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 518077 - DNA, 168 bp, Homo sapiens
  misc_feature (145)..(145): n is a, c, g, or t
tacagaattgcgagcacaggtacccagcggggaacaatcacttagttcaagtgattgttcaagtgattgttcaagtgattgttcaagtgattgttcaagtgattgttcaagtgattgttcaagtgattgttcaagtgattgttcnggatcctcagagtcaccgcagca

SEQ ID NO: 518078 - DNA, 2148 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 518079 - DNA, 524 bp, Homo sapiens
  misc_feature (324)..(329): n is a, c, g, or t
  misc_feature (331)..(331): n is a, c, g, or t
  misc_feature (492)..(492): n is a, c, g, or t
  misc_feature (512)..(512): n is a, c, g, or t
catactgatgatatctttgtaaaagaacactgacatctcacgtaattctcattgtatcacacttccttcaatcccgcccatgtttaattggtcgggaccaaatattcctcgagccttccattagggcatatatacttattcatgatgctgttaccactcccagcctgctgttaccactcccagttacattattttaccgtacggtgattccttctgaaccccactcttatttgttggcctactacatgccactcaagagggattcaaagatgagtgcgtggtcccggaagatgcagatgtggggtaccacagagaaagtgattnnnnnncnctagcggggaacaatcacttagttcaagtgattgttcaagtgattgttcaagtgattgttcaagtgattgttcaagtgattgttcaagtgattgttcaagtgattgttcaagtgatggttcaagtgatggttcaagtgattgttcaagtgattgttccccnctgggatccttagatcaccncagcacagcatg

SEQ ID NO: 518080 - DNA, 2331 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 518081 - DNA, 204 bp, Homo sapiens
tgactcaagtcaggaggaagtaagtgcatagcaggggtgaacacctctcccccattcactcccagcttttcaagggtgggcagtggggaagtcgggaatgtggaccacatgccattatgcaactggtgttcagttttaatgcatatttaaacagaataaaatccccactcaatagcacttgaaaggaaagagtgacttgtaaac

SEQ ID NO: 518082 - DNA, 2191 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggcccgacaaactccgggtcggcgaaacagagaaaa

SEQ ID NO: 518083 - DNA, 153 bp, Homo sapiens
ccccttcgctgtggactcagagtacactgcttggagaagctgacaaaatccacacagtctgttctctgaactttcctcccctggggcagcctcactacccatgtgacccattgtcctacattacgcctgaggaacacctggtagtatggagaa

SEQ ID NO: 518084 - DNA, 3074 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccggcaagtatctcccaactgggggctgccttcaatcctcagaccaggaacacccatgacacaggcacagccctgcactgtgggcgtgccccttggcatggggccaggagatcactgggttatcccggttagtgatgccctcacctctccccacaagttgtttacccaatggctggaaaggggtggctactggtcatcgtgaccactggagtcaacacagactgatgtacccacagacaccaaaacttgccccctgagttctgaagcaaggggcaaggctgggcccctagcttgtcctgcccattcctccaggtgttgatcttgattccacttagagaagctgaagctgtgcctccctcccctgtcaagccagttctttcctcttcaggtggctgttctggcccagccccttcccatccccaaggagcccttcagcgcgccctgttgcttctgctagcctacctttccctgccaggcccttgctcagggccatggcatttaactaagtgcacctgtgatcttggccaaaaaaccattgcaactcacagtaagagactgggtttcggggaaggaggggctagggacattttggcactggcctgccctattgtctcccatcctagtctgtcctggtccctggcaacaggaacctgggcagcttatcctgcccacaggtaagcccctgggagcatccacaactggggacctgctcagtgccccccctgccttacagctacatgacagtgctgttttatttgaacaacgtcactggtgggggcgagactgttttccctgtagcagataacagaacctacgatgaaatggtaagggtcaactgggctattactcttgtgggctggcaggggcttagacaagtgaagtacacacctctccaggtctaaggatgtgggcccaaattattccttgggcatatctggttggtttccctttggtcacccttggctggcctggccatagagtggggacaggttgaacaccccaccaccctgctgcccacagagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcga

SEQ ID NO: 518085 - DNA, 132 bp, Homo sapiens
gatttgaaaagccttcgctttgaagcgaaaagtcctaatagtaaaagaaccctccataaacctggagtggctatatggatgcccccccccctaccccccatttgaagaacccgtatacataaaatttagaca

SEQ ID NO: 518086 - DNA, 2699 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgagccgccgggccgacaaaaacaaaaaacaaagaaataaaaagtatggaaaaaagtaataagacaaaaaccaagcaaagaaagttaaaaaagaaaaagaatcacaaatgcacaatagaaaacaaaaagggggggggcggggccctagataaaatattcccccggggggggccacaatgtatcggcccccgttattgttgaaagaggggcccaatagaagttgtataaaaaaaaaagcgcgcgggtgttaaacacaagtgcgtgggagaaaaccggtatttatgttattgtggaaggagaacccacactgtggggtgtggcatatgagcgcacaccctacagatgttatcgcgggggcacaaacacaagtggttggttggggcaaccccgttcattcgcggaaattgttcggttttttttattagccgtcgcttctactgacaacgacgacggagatgacaacgcgcggtacagcatgacgaccgattgaagacagacgtagactcaacaaacaaaagtaccaccgaaggcgagagagactacagtacatcaac

SEQ ID NO: 518087 - DNA, 2556 bp, Homo sapiens
  misc_feature (1)..(1): n is a, c, g, or t
nagcaggctggtaccggccccaagtcttatgatcacccccgctcctggagcacgaagatgcagacgatacttttcccggaggcaagagggcgtcttcacgcaggcaccgagaagctcccactagtgtatgccttaatggtgccgctcttgtccgcgtctacgcttgggaccttggcttctgacttggagagtgtacagctctgcccgacggcaacccagcttgggaagagaagccccagcgtgggctggggctcaaggcgcaggaaggccgagcccggcgcggacgcaggcggctccgggcgggctcagcacccccaggcaccgtctcctagtgaccgcggcgctcgcgggcctggcggccgttgtccgggcgactgcgcacgcgggcacccccgcggcccctcccctgggcgcgcgcgcgacctgggtgccatggcggcagcggcggtgacaggccagcggctgagaccgcggcggccgaggaggcctcgaggccgcagtgggcgccgccagaccactgccaggctcaggcggcggccgggctgggcgacggcgaggacgcaccggtgcgtccgctgtgcaagccccgcggcatctgctcgcgcgcctacttcctggtgctgatggtgttcgtgcacctgtacctgggtaacgtgctggcgctgctgctcttcgtgcactacagcaacggcgacgaaagcagcgatcccgggccccaacaccgtgcccagggccccgggcccgagcccaccttaggtcccctcacccggctggagggcatcaaggtggggcacgagcgtaaggtccagctggtcaccgacagggatcacttcatccgaaccctcagcctcaagccgctgctcttcgaaatccccggcttcctgactgatgaagagtgtcggctcatcatccatctggcgcagatgaaggggttacagcgcagccagatcctgcctactgaagagtatgaagaggcaatgagcactatgcaggtcagccagctggacctcttccggctgctggaccagaaccgtgatgggcaccttcagctccgtgaggttctggcccagactcgcctgggaaatggatggtggatgactccagagagcattcaggagatgtacgccgcgatcaaggctgaccctgatggtgacggagtgctgagtctgcaggagttctccaacatggaccttcgggacttccacaagtacatgaggagccacaaggcagagtccagtgagctggtgcggaacagccaccatacctggctctaccagggtgagggtgcccaccacatcatgcgtgccatccgccagagggtgctgcgcctcactcgcctgtcgcctgagatcgtggagctcagcgagccgctgcaggttgttcgatatggtgaggggggccactaccatgcccacgtggacagtgggcctgtgtacccagagaccatctgctcccataccaagctggtagccaacgagtctgtacccttcgagacctcctgccgctacatgacagtgctgttttatttgaacaacgtcactggtgggggcgagactgttttccctgtagcagataacagaacctacgatgaaatgagtctgattcaggatgacgtggacctccgtgacacacggaggcactgtgacaagggaaacctgcgtgtcaagccccaacagggcacagcagtcttctggtacaactacctgcctgatgggcaaggttgggtgggtgacgtagacgactactcgctgcacgggggctgcctggtcacgcgcggcaccaagtggattgccaacaactggattaatgtggaccccagccgagcgcggcaagcgctgttccaacaggagatggcccgccttgcccgagaagggggcaccgactcacagcccgagtgggctctggaccgggcctaccgcgatgcgcgcgtggaactctgagggaagagttagccccggttcccagccgcgggtcgccagttgcccaagatcaggggtccggctgtccttctgtcctgctgcagactaaaggtctggccaatgtcttgccccaccccgccagccgcgatacggcgcagttcctatattcatgttatttattgtgtactgactccatctgccccgtcaaataaaaaaccacaaggttcgaaaaaaaaaaaagaaagcaacaaaaaaaaaaaaaaaaaaaaagaagagggggggcggcgccggcgccaaacccccccggggggcggcgcctccccccccccccttaaaaggggggccgccccggggggtatccacactatatactagagcaagcagcacgccgcggcggttctaacacaacacgcggcggggcagaggaacaccaaacacttctagtcggggcgtgccatgcgagcagaaggcccccccccccccggggcgggagataaaacgacgcgaggcgccaacacccaacaagaattgcggccccggggggaaaaacaccctactccgcggggcggtgactgataacaacagcccactcactgtctcgaacaaaaactctccggcaacatagacacaaatattg

SEQ ID NO: 518088 - DNA, 103 bp, Homo sapiens
cataatgcccctcatccaggtgcccactctaggcactcactcaaacttgcacttcaactctgtatagaagcagaatgcaataaaccaatctgtcaatcataaa

SEQ ID NO: 518089 - DNA, 489 bp, Homo sapiens
  misc_feature (354)..(354): n is a, c, g, or t
tggcatcactgtcagtgtatgactggatgatggatagggatacataatcaggatgtcaatactgtgctcttacacatgaatcacatgaaactttttgtttctaaacatgaaaacacggctaagtcccctggcggggggaaaaaaacagccccacagaccagctgtgctaactttcgatagctgttgacttgtaattatccagactcacaaaattttcgtctttctcaaatttattttaacaatagtctcaccaccaaaatgttgcttttccatcatattcataacagagatactgtagaacgagaattttagcaggttaaggtgtaacatatatatcacgcacacatacaaccnctcacattttattaaaacgttttctcaaccattctgtcagtgtatgcccggaccgagggggcagagggaacacaaacacgggggtctcatacagtgcgcctcacacatgagtcacacgtgacccctttgtgtctc

SEQ ID NO: 518090 - DNA, 254 bp, Homo sapiens
tcgctcacttcgggaggctagaggtgtatggatcacttagtccaggagttcaagaccacgcctgggctacataggtgagacccccccatagtctactgagaaagtaacgaggactaaccattagccatggcatgcgtgagcatgcacctgatagtacccaggctactagtgggaggctagacggcaggcagtgatcgcttaaggcctggcgcagtacgaggactgcagtagaggttcgaccgctggctaagtag

SEQ ID NO: 518091 - DNA, 545 bp, Homo sapiens
  misc_feature (507)..(507): n is a, c, g, or t
  misc_feature (545)..(545): n is a, c, g, or t
ggacgcgtgggttaatttaaggacaaagatgaagtcactgtaaactaacctttgctcttgagagcagaagagggatagacaggtgaacatcatagcaatgatggtgaaacggatgcaccgaggagcaccgtcggtcttgtcccgtcgttcgtgatcttcaatgagtcaactggttgagcttgtaaaggcacaacacgtatgcacacgtcgacatgtagaagcataaatcctgttcagtatgctgctttacccgtatcacttatgtccttgtatgtacagtagcatgaaaaattatcaataagtcatacgtatactaaagagacagcgggtgaatatagagagaagtagtatgtgtgttagcggtagttgtcaagagaaatccaacctgggttaagaggtgttctcgggctggaatgaaacgaagttcactttacgcgcctatgcgagcgtatagtagaaggaagaggcgactctttgaagcggcgtgttaaaggaagaatataagcnctgtagaggacaacaggtacagtctaggaggattatan

SEQ ID NO: 518092 - DNA, 258 bp, Homo sapiens
cgtagagtatcacataggtggatagaagtaggtggtaggattaacaccttggtatcagagacataacgccagtaataattatataccatacatcatcctagtgacaagcactggcaagtctaggcagcggtgaaatgatgaaggcaatctggccacacatcttccttctggctcctgctcttcagggcatgcatctcccatgctgaaggctaacaatgggggtcattcgccaacaaattagagagtccgcttctccct

SEQ ID NO: 518093 - DNA, 418 bp, Homo sapiens
ttgagtcagcagtttttaggaactgaaactacatttaattagtagaagttggaatgataaaatatttacaggccgggcgggtggttcaagcccttatcccagcactggacaggccgaggggagcagattacttgaggtcaggagttggggaccagcgtggccaacacggagaaaccccctctctgctagaaatacaaaattagctgggtgggggtgcctgtagtcccagctactcgggaggctgaggcgggaaaatcaccctgaacgcagaaggcggaggttgcgatgagctgagaagcgccattcactccagcatgggtgacagagcgagactcctctcaaaaaaaaaatttccaacggggtgaatttcaggaaaaaaattaaaatctgtgtctgacattccacttgttaaacaatc

SEQ ID NO: 518094 - DNA, 1497 bp, Homo sapiens
  misc_feature (1)..(1): n is a, c, g, or t
  misc_feature (509)..(509): n is a, c, g, or t
  misc_feature (1210)..(1210): n is a, c, g, or t
  misc_feature (1443)..(1443): n is a, c, g, or t
ngcacccccctcccttctgctgtggttggcgtgtgcgtgctaataccaaagggacgttctttttttgttgagcgcccctctctcagagtttgctccctcctgctgtgcggagcccccgccactcgtctccccacgcccgctggtgtttggtgacgccgccccccctatttgagagtgaaccaccccccggtgggtcgctgtgtgtttcctacgcccttctcccggaggcttttttaagccccttattgggcccccccgctcggccgttcccgggtgatttataaccacaaggtggtggtcgccgcgccccccacccgcgggtaccacacgcggctgtgtgtggtgcgcccccactccttatggggccccccctcatattatttaatgggtgggggacaccccacctctttttgggggacccaccaagctggtgttgttgagcacaccacaacagtacgctcacgcgcgctcgggggtgagaccccgcgcttccccgcggcggaaatttntcccccgcggggaaggatttttctcgctccgatgaccccccacccgccccgcttctcctcgccgcttttgtgtggtcttctaataagctggatgattatagagagaagcctctctcttctccgcggcggagaggagagagatccccccacaggagtgcccctcacaaagagagtagaagaagagagagagatgatgagggtagtgcccgcgcggcgagatcttctctcgtatagtagaaaagaagagtaaagagacgtcattgccccccccgtggtctcctctccctccccagcgcggctctctagagagggacgcctctcatcgcgcggctcttcacggggagttctctcgagtgggagggtgatggaagcccccccgcgagaggagaagagtgtctctctcttttgcgcgcgcttcgcctttctctctcacacacacccccccgcgagctctctctccacacccacacaaatttgtgtgggagaccacacgtgttctctctctctcacactctgaaatctcccgctcccccctgtgaagttctctgtgcgccacactctctgtgaacacatgcgctcttccctgctgtgtgtggtgttgagaatgtgtcaccatatggcgcacacgggggagagacctctttaactttgtcgtgcgttctccacacaggagatgtgccgttttatataaatattgtggngagagaagaataaggggtgggagaggcacaggcgcacacatccacggagatcccacaatctcctcactatcttgaatactttctccgacgcctctaaaggagattaagctgctgctttgtgcctcgtgttcacacatttgctggagacacacaggggtgtcacagtgagggccacgcgcctcgttaagctctcctcaacctcggggcctcatttttatctctttcctttttgnattttttggtgtcttgtgtggaaaagattttataaaggggaccgacctttggga

SEQ ID NO: 518095 - DNA, 128 bp, Homo sapiens
gccctggcaggaggaggagagagaaaggagagacataattatatttccatgaggtgtcagccttggatcaggagattattgaagtagatcctgacactaaggaaatgctgaagcttttaaggacttgc

SEQ ID NO: 518096 - DNA, 1591 bp, Homo sapiens
  misc_feature (1551)..(1551): n is a, c, g, or t
  misc_feature (1554)..(1554): n is a, c, g, or t
  misc_feature (1573)..(1573): n is a, c, g, or t
cctgttcgtccgtggtggtgggtgttgttgttgtgttgttcttggtgtcctttgggcgattctctcattgctacctgtctgctttggggtggtgtggcggggtgtgggctggttggtgttgcctactgcgtctcgtggtggagtgtgctcctgtgcgggactttgcttgggacgctgtgtgtgagttgtctcgtcttggtgccaacgttggggtgttgtcggtaaacccgttggtttctggcgaccacgtgtggggtacgttgtgtttgtggcccctgtcgggtttgggccctggtgccttttcttttgtggtgccgtccctcgtggtgtgctggggcgcgcaccgcggttgctgggggcgagtgtcgtctgcgacgatcgtgtccttgtgtggggaggtgtccatcggtgccttgttgttcctccctgtggcggtgtttatgtttgcactggggccgggccgctgggggttggggggcgcgttcgttggtgcgccaccctctcttgtggtgatactgctctcccgtcgcgttctctgcggtccgtgcgcttgttgtggtttgctcggtggctgggtcgccggcgggggcccaacgcgcctcgctcgtttgtgggtgttgtccctttgtggtatcgtctgttggccctgctcattggcctcagtggaggtggcccttcttccctctggtgttggggtggtgcccccactctctcgctgggagggatccccccacaagaaaggcgggataaagttaatattttttggtccacccaaaaggcgccccttggggccccacgtttgtatgtggggcgttgggcgatcacacgccacgactgcgctaccgtggtgtgtgttgtttctgggtgtgtgtgtgaatagggtgggtacaagaatatagtgtgagcacccacatgggcaccacactctggtgtttgcgcgaccacctcaccggagggtcgcccagttgagaggggcacacacaggagagggtagatagagagggagaggggtcgtgggcgagcgccacttctgggatagtgacctttgtgcgcaaaaacacttgtcgtgtgcaacgacatgcggagcatgtgggcgtcgcgcacacttgtctgcgcatcgttgtgtgtgtgtctgtctcgttgtaagagagagccccacacgtccccacgaggtcacacgtctcacaacacacactgtgtcgcaccagaacacgtgggttgggcacaccctatctagaagagcgtagagggtctggcacacactgtgttctgtctcttgtctacatgtgtctagttttgtcactgtcgtggtgtagacccatgtggggtgtggtcaaatgtggtagaggtgggtgagagtaggtgagtttgaagggttctcccgtgtcttgttctccctgtccaccagatctgttgtgcggcagtgtgaaagagaggaatagaagaagtacgtagagttgaagaaatttttaaaaaatggtataaatataaaatattacgcttctcccagaaaacaagaagaattaaatattaaaaattcgttcggatggncangtcgtactcgtcaggggtncgtagatatgaggtagtg

SEQ ID NO: 518097 - DNA, 504 bp, Homo sapiens
tgttctagagatctcggattggcgacatttcaaaacaaacaaaacaaacaaagggactgcaggccccatgcaagtctaaaatccaatagggcagtcattaaacctcagagttcacgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctccacccctgcagcaaacttctgcctggacatccaggcgttttcatacatcctctaaaatccag

SEQ ID NO: 518098 - DNA, 94 bp, Homo sapiens
  misc_feature (40)..(40): n is a, c, g, or t
catggatttgctggtgcagtacaactaggcttaatagggnaaaaaaaaaaacgttagaagcttgaattcgagaaaccatttacccaaaaaaaaa

SEQ ID NO: 518099 - DNA, 108 bp, Homo sapiens
ccacagcagactacaaacctgagtcagtgttcatagttttcattggaatagaatagagacactcatatgttagcaaactttacctaaagtgtgagacgctagtaaaaa

SEQ ID NO: 518100 - DNA, 1008 bp, Homo sapiens
gggcttttttttttttaatagtattggtggtggaagtaatcgaaaagacaacatatttattggatccgggataccaaacatttgagcaagaattgaataaaatactggcgaagttgggaaccaagcatacttccagatggtaatgctattttcactaaaggtgtggctctcttgatataaggatggtcattttcacagagtatgttcggacacaatattataattaagtcacttaaattagataacattttctgaacacttactcgagctcatcggcctttcatctctggtggaattcagaacacaaatgtggcttcaataaactagtggtttatcgaacgacacttggtacacgcacaaggtacatctaactttctctgggagtacgagactgggattgtccatggtcttaaagccttccagtgggagcttctggattgtaaatttctcttaaaaccactggtttctcagctccggtggaaggaaacagtggtgctactgctactggtggcagctcactcaagttctttctcccaggcacattcacatttcctggaactttctaacttttcacacagcggcatttacacgggttgtctggaccacgtggttggctgtggtccctacgtgaaagaacaagaaagcaaaacattccagtccccttaattccatagataaagtcagttccataagtaagcctccgtgtattgggtcaaacgaagctgcaatagggaagtctctagaaattcatcctaaggttggactctacttagtggcaacagggcccgacatggggggacctaccgaatttgggtcccccttagacaattcaaccgtgggatccgtggtaacaagacgtggtctttaccctgcaacacccttgttgattcacgttcgaaaactgcctgttttacaccaagagaaggtcctttccctcatttagaggggctccccgtatctccttcgcagattgtgcagccaaaagccctactctcgggcgcgggctac

SEQ ID NO: 518101 - DNA, 662 bp, Homo sapiens
  misc_feature (662)..(662): n is a, c, g, or t
gtcttggccttactacggtttaaccattggatccggtgtttgcagaggaatcatcacactaggctgatattctccgtctgctgcctgaaatctactgtggcatttaaaggtctcaattctacggtgttttttgggagggcatctacgggtaggaaaccgtatagagaggagcgccccattgtaggagatttcaagagcatatgctgaacttgccactttaaccttcatgcatgccaagtcgtataggttcagaggcaatctacaccttgaacaagattgtgtgaaaaatacttcggatttctgatgtgaattggacagtttatatatgctaaaccggttatcgatccctaggatgccattaaaagcaaaaagggtttagtttagagcaagcgaatgatcgtaaaacatactaactgggcggacgcctgggactaaaaatgtgtagatttgagcagcttatgtatgcggccgaattttgggctaacttgggcatttcgcccttagtggagtcgtttaccacttcactggccgtactttgacaacgccgtgactgttccagttggcaacattaagaaggaggacggcactgtatgccttttccaacaattttgtccagcctgtagggctaaatggaacttgaacacgttataatgtgggtaaan

SEQ ID NO: 518102 - DNA, 771 bp, Homo sapiens
  misc_feature (47)..(47): n is a, c, g, or t
  misc_feature (80)..(81): n is a, c, g, or t
  misc_feature (163)..(163): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (289)..(290): n is a, c, g, or t
  misc_feature (324)..(324): n is a, c, g, or t
  misc_feature (328)..(328): n is a, c, g, or t
  misc_feature (505)..(505): n is a, c, g, or t
  misc_feature (520)..(520): n is a, c, g, or t
  misc_feature (535)..(535): n is a, c, g, or t
  misc_feature (543)..(543): n is a, c, g, or t
  misc_feature (553)..(554): n is a, c, g, or t
  misc_feature (601)..(601): n is a, c, g, or t
  misc_feature (632)..(632): n is a, c, g, or t
  misc_feature (651)..(651): n is a, c, g, or t
  misc_feature (683)..(683): n is a, c, g, or t
  misc_feature (746)..(746): n is a, c, g, or t
aaacaaaataaaaaaataataaaagtatgaaaataatgataaggtanaccccgccgcatgtaccctcctttttacagtannctccttctaatctaacaaataaccccctaaaaccctaattttactcaaacaccccttccttcttctccaccacatttcccancttctcttccagctgcagatcaggttctgctgggcagtgggctcagtgcggtgcatcaacantgtntgtnttggctggtccagggaggccatcagctcctcattaatcatcattttcctgatgatnnactgcacaatgggcagatccagctcaaacatgtntganagcgtctccatgctgatggagttatagacactgctgtaggtgaagacctacgtcctcacttactcttcctccatcttcctaaccagcatggtgcggactttgtcagcctcggggaaaaggtcccacactttcccattcatcttctcatttatgataaaacttttacaggtcttccantcacccatctttatngcctttgaggcagcnaccacatnttcccgcatnnactcagggggacccagcaggggctgtcgctcgcccacgcgcactggntggtggaactgcttgctgatcatgcgtcggngggcatcgctctcatgggnggccatgtaggggatctccaggagcatggcanacaccaggtagacacactccagcagctccaggttgatgtgcaggtggaaggggacctgacggngccgctccaccttctcctgctcctg

SEQ ID NO: 518103 - DNA, 1334 bp, Homo sapiens
gccagcggcacgagcctcctgttcctcacgacaatggtggtggtacgatgacggccaagaccgagaggtgccatgaagagaacaaacctccatccagacacgcgggcgtgaaaggctccagtgtgtccagtggccagatgtgcgccggctctgaccgactcagaaagatgagacacaagagccggagccagggagaggttggcgaagacggctggacagtgcccaggccttggagcgaggcgggtgatcttcctgtaagatccccagcaaacggttcccacgatatccgacaagtggttcaacagccaagcgtagtcccaagacgcttgtatagaggcgacgggaccctttgcggtgccacgcgtatcaccatgggtgcccattgcgttcgcatccgggagaccccaagagtcacagatggcttgttcgttggaggaccaggcaaagcaaaaccggggccttgtgtgctgcaggttgcgggtttggactgcgacgttgagcacacatgacgggccccaaacatgaggtctggcggaaatcctagagaacccgttgctgcaagagctggcacactcgcccagacggcctctggcgacgccgacgcaacgcatggtgaggcccgagatgcgacagcacgccacagcaaatggggaatctgacacgcgatgagaaaccaccaggccgagtgacgtaggagcgtctaagaagagcgcagtgaccagacttcctatgacggccatggcctcgtgaggacagcagagcaccaggagagggtcagacaaggggagacacgcctctgcgcagacttgagccacagacccaacggcggacctccgtctgtcgccatgagagcccaacggcattacgcgcgatccagcctattggtcactcgtaggcacatccccggtagggttaatgtggcacaagaggtcgcagcaggcccgaaggaccagcagaaccgacgtagcactgagccctgtagtagactagtcacgtgcgcggccacgaggtagcacgattaagccctgctggacgttggtaacaccaccggtgcccacgctcagttagtagagctcacaaaagcggtgtactcaacagcactcaatctacttggaaacacgattccaccgacgatacagccagaagtataaaacagcagaaagaaaccccaacgcgactcgacacaagggaccttggactagtgcgtcgcgaactgaaatgcacgatatccagcacgcattgcggcggattcgtcaacgacagctcagccatccacacaggtaaagagagtggaaacggacacagcgacacagtagtgtagaacgcgcctataa

SEQ ID NO: 518104 - DNA, 1207 bp, Homo sapiens
ctttcattgccaacgtccttctatgacctcagtgccatcagcctggcatggggcagaaggtagcatttcaatacgtcccggggcagggccgtgctgatcgagactgtggcttcgctctgaggcacaaccacccgggcacttcacccagtctcaaccagctgcaatgccgcctttcccaggcgccctggtgcgtccttgcgctctccccttgccttccaactttcggcacactcagcagccagtgccgcagaccccgaacgctagccaacacgcctcctcttcgacgcatgtccctcgcagctcccagcaggctacctccagtcgctcagcgcccgactcctccttcagcccttacgtctaagctctgcctgcgcaggcgacgctctcctccccgtacccacggcacgccaaccgcatgcccactctgtgtactcgaacgagagcctcgcaacgctcctcgccacgggcttatccgtctggtcctcatcgacttctactcgttttccctaacgtcgccttctcgcgcgcccgcgcgtacacggcccgacactctgctcacgcaccctgacgccgccgacttccctttgacctcccgggtccgtccacgcgcttcactggcttccccggtcccccatgcgcggccgctctgcggcactaagcgcaagtgccgcttagccttttcagtcccgttttggttccctgatgtacttgttggttgaggcgtgggaacgtgggggctccgaatactcgagcgtttcccttgctcgttcttcggcccctaacgcgcccgtgacgcgggcccaactggccttcgcctgccgtagacccccttctcattcgcagtctgcatgccccccacatctctctcccccctccggttggattcccggattcccccagatggtgctccctcccggttttggcgcaccgcccctccgtgtctgcccggccgcgcctccagtacgtgcttgcgccccctcggggccagccctctttcgacggacgtgctttcccctcagactagtggggggcccgcgtcaccgcgcggtatgctatgccgctcgtgtgtccgggtagcgggcactacagtagtgccgcggacgctccttcttttgtcgcgtgctcgtcacttctcacctccgcttctgctagcccaccgcgagctcctcttgagccgcggcggccctcccttctatagacaccttgg

SEQ ID NO: 518105 - DNA, 292 bp, Homo sapiens
acccgctggtgtaatggacgtacagagacatatgggattttgtgcgtaagctgtttgtcccatcctgtatcctgtatcacataggatatatatcactgggtagtccggagaataccgtgtgcattccggcccttaagtgcctgagctcaggaggacaccccacatcccgttcagcctattggtggagaacgaagaagacggagcggagtttcgcacatacctcccacctaggaggtagggaaggaccccgtcttagggtataacctggcaataccccgtgcctttctgtgtg

SEQ ID NO: 518106 - DNA, 1354 bp, Homo sapiens
ctccgtgagccgcacaaaccagtgcctcgccatgaagccaggattcagtccccgtgggggtggcttatggcagtgccgacggggtgctttgagtgacctgtggtgagtcagtgagagtgcctgacgggagtgattttggcagtggggcctgagggtcagacggctgtgagggcttttagaaaggctcggtggaccggaaggaaggacggatggacgtgcgcgacgcgcgagacacggttggcagagagggacgcgaccgacgcgtgggacggacattccacttacttggatggccaacccggcgggatcgatggatccggggacacggacacaaccagcgtgcaaacccagttcagaggagaagaagatgatgaatgggtgggaggcacgcaattcgtggaaattgaagggagttgtcttctcaattatatggtaggaaggagaaagggacagcatgccacattgggtccacccaaagcacaccccagtggggatccccccatggagcgcagaccacctccacggcaatgacctgggcaccgcagaacaggcagccacgatcaatcagaacttcatcatcgcgcaaccacgccggcagctggagcacaaaccgctccgaaagattacccggacacgcccgtgtgagacaacacccaccgcagattcttaccgcaggacggatactccaaaacggacattaagcaccagacgaccaagagcccaaacttaccaccctcgagtgagtatgagggaatgggactggggaaacgccaaaaggcaagttgtcccaaaacgacagttcatcacaccaccccatgacacgagacagacattaaaactgggcgctagtagtttcgttaaaccacaattcggaagggagaacacgtgttgcacccgttctaggcgcgggcgaactccgcaagcggacgatccaatctcacacccaactgtggaatcctctcctgtggacccacctatcgcggacatcactgcgctaaccccgggcgcaaaaggttgcgggtagcactacagacagtcactaaagttgttcaccacgacacacgagaatagcttatccggtccccacaaacgccggccacctccgtttgggccccccgttgagcaaccccacgtacgaattgctaccccgcctgtgtgcaccccatcagggaaaactgccacaggcggaagcacagaaaacacaagatcgcaaaattccacccaatggcagtggcaaacctccgcaacggggacactaggcacgcacgagacaccacagcccctacgccaccggataaacgattgacaccggacaaaagttgcccacaccaattagcggccgcacatgttgggt

SEQ ID NO: 518107 - DNA, 919 bp, Homo sapiens
  misc_feature (406)..(406): n is a, c, g, or t
agagcagcgccagtttccgggctcgggctgctctcggagccatgatctgcggacgccccctcccgacgtgcacggggtgatcaccctcacagggtggacgaacccgttgactctagcccgcagcctctccctgagaggcttgatggccgcgtgttcgaggacagtcgcggcgcgctgttgtggcgttcgtcgtccagtccccgcgcgggatggcccccataaccaattggcgtccccggggccttcgcgattctccgtcacggcattatccttccgacccccgggccgctgaggccacagttgaccggccgaatgtgcgctgtccattgggtccggggggcgggagcgtgttcatcggactgcgacgcctgccggtgttcgccgtgtgttcgcgctgtcgctgagngtggccctggccgggtgatctgcgacgccagtagtgttggccggggggagaagtccagcgccgtgattggtttccctagtacgcgccgtgctggttcacgcgaccgcgtggggttgccagccctggctcaacggttgcccggcggggccccccgccctgtccctaaagtgcggctcgcgcccacccgcctccgtaccttgaatccgcgtggacgccacccgatgggcgttggcccgcaggggtctccgcgctagggacgagaatcgttcgccatgttcgcgtggctcccctttcaggcctcactttatccaagggtccgcccccttgagtaaggccgcattgtgtcgtcttccctaggccccggttgcggacgcttagtatgggccggcttcctcccgcttagcagagcaaggattggtctgtggtaccacggtgacctcctccgctaaacggagaggggtctttccacttccccggttcctcccagggtcacaggctactttccgctaggca

SEQ ID NO: 518108 - DNA, 101 bp, Homo sapiens
cagaacggactggagactgaaaggagtctggggctaggcaaaccaagaagaggtggagggaatcctcctgctgggctgtggccttgtcactcccagagtca

SEQ ID NO: 518109 - DNA, 1212 bp, Homo sapiens
gggacaaatgccctgcagcagcagctgcggaagcgcgaggtcctgcttcgagctgagctgagcagtgccctgctgcctgtgttcatgccatgtggccccactaccctgcttgcctgcttgtcccctgatggtgcactggcatgcctgatgtggctgctcccatgtgcatgtgaaacacttgtgtgttgcccatgcatgtgtcccctgcatgtgtgcctgtgtgcacatatgcaccgcctcccatgcatgcccctgtgctgtgaccttgctgtgtgctccctgactgtgacttgatgtgactgtcgtgtcaatgtgcttgcgtgccctttgtgacgaacgaatgctgtgcttggaccattcctggtgtggcaaacttttagcctgtgcccacccatcgaccaccgtgtgtgtggaaccctgccctttcctgactgtgatcttgctaaggctgccttccggcggctggattgttgacattgtggacgatgatggcccgtcatgcgaccaaaccttggctgcaggggcccacgattgctccgcagtggtgcccatagctcaatactgccaaccagctgtgcaggacgatcttttgggcgtccagcctgtgagggcgctcttccaccgaccacacattgaccaacgttgtgcccgacgctgcttgaggcctgcaacctgttggagggtgggactcatgtgggacactcaagcgtcgtgctgcccccagtctgaccatcgtgtacaagcaagggtgtgggtgcttgtgccctcattgaattcgctccaccaaggttccagcagaatcgtccgtggcatgaaccagggtgctggattgttgccgttgactgtgaagatccgcacagggctgtccaggagctgtgtgaactttgggagcgactgctgccgagcatgcggacttggcgcgttgggactcggtcagcttcacggtcggctttgggaagcagggacaaaccaaagtcctagacttaactgtgcagcttcacttccgctgcagcttgcttgcacggccctgcctacccccaatgccccttgttcgggaaacgtggcgaacctctggcacctgaggagttcacagcgcgcacgtagaatgtatgcaacgggaacagacttcgccgtgtccagccaacaccatgaccttcggacacccgcccgtcgctggaccctccgcccgcctgcacgcggaccacaaggcgg

SEQ ID NO: 518110 - DNA, 840 bp, Homo sapiens
taggtcaaggccattggcaacctgtacggccccctgatggcgctgagccacatggtgcagtcaggactatttccccaaggtccttgcagcccgtgctgctggcgtcgtgaccaagtcccaagagtcgccctggaatcctgctccttcgaaccgccacagtctgttgcagacgctgtacaaggtctagactcaaagcctctacccaatcgccttggcttggacacagtgaagctggggagggactcggatgacacttgatggctgcagcctacgccattgcacttgagacagtgactctggccacaggtcagggcggtgtctgtgtcccatgtgtcctgtccagtcccctgagtatgtgtgtgggtgtggcgcatgtgcaaggatacatgctagcacctccctgtcgagatttaaagggttttgtaaaccgtcttacttgctggcccagcccctgctcttgtttgtcgtggccgtgaagttgagcccccaggggaaacgggctgtagatgctagcattccctccatttaatactccaaccttcacaccatgaagggcagctctgcttgatctacctggctgggaccctgataggtccagtacctccatacgcaacgtgacctttccggaccgtgactccccttgggcgggtatgccagtaacccagtggcagattgtcccggccgtagcttgtccctttctccctctctgtgttgtgatatggggatagtcacctgccccagcctgggtgttgcttccttcgtaacaaatacctgtgtcctgcgggggctgtcaaccccttacatcatagcactgtgctgccgtcatctgaaagcgagatc

SEQ ID NO: 518111 - DNA, 291 bp, Homo sapiens
tgtgatgggtcatcagccacgatgagatgtctcggacatctacaagatcggggagatcgcggcggggtggtgcctgggaggtggaggggaagagggtcagtaggacagagggtaacatggatgactcgctcatggggggaaatgcctccgttgaaggccccgagggcgagggtcccgaaagcacagtattcacgggggtcgatatggtcatgaaccattcaccggcgggaaacaggttttcacaaaagaagcctacaagaggtacttcatagattacatgaaaccaatcag

SEQ ID NO: 518112 - DNA, 1001 bp, Homo sapiens
ccaggctggtactggtccgggatgtatggcattgaaaagctcgtggtctgacgggtgctggtgaggagcaggacccacgtctggacttgccgaggtgctggtgctttgagagtggcgggaattgaggagccgcgctgtggtggcgacatgctggcggtggcgtgcgtgtggtcggccgaacccggttgccccccatgagccgcagggccctggcagggggctccctcgcctagcagctcggtggcctaagtcgcacagcttcttctcgctgctgaagaagaacgggcgctcggaaaacggcaagggagagcctgtggacgcgagcaaggccggcggcaaacaaaagctggtgggcttgcgtgtgtgctgttcagctggcatgctgctggcacagtgaaagacaatgctgttgccaattgcgtgagtgcctgtggattggggcgctgcgccctgtgggtgcggcttgaatcctacccctgtgctcgctcaacctgtcagccttgtgagtgcgtcaaggacggagacgcccagagccgcgcgcgtagccggaggagccacagtcaggacgcccccgggagacccaggcaggctgtgggagaatattattgcgagaccaaagaaggaaggaggcaggggtcccagactgttgacaaggcattgttccccgtggaccatgccaatgcctgggcgtctgttctaaagacaagtaaccccggaccgtggttggcctacccaagtgtagtgccggtgtcaagagatgtgaccaggtcccgtgaccggaagtgttgggaccggaccaagcatttattcttaacaagggaaggttccgtagggagaacaattgcattctttcccccaataaaccgggagggaagccagtgggaaccccagagtgaccccaaggtggaggtggcatcgggatataaaagggtttggacaagtcattggtatacccttgagaaagacccaatatggtttggtataccccgaagaaaccccta

SEQ ID NO: 518113 - DNA, 1224 bp, Homo sapiens
  misc_feature (341)..(341): n is a, c, g, or t
  misc_feature (1215)..(1215): n is a, c, g, or t
ggtcagcctgttgcacgcgccgtgggtccgggatctctccgtactttgcagcgtagtccgagtcggtcagtaccgcgaggatcatcaggcatgccattggtcgaagacccagtagtagaagtcagggacttgcctgttcagttcatgactccaatcatgttgactactgcaggactacgtggcatgacagcagtgtccgtgtgcatgcatcagtgtccgcgacgtgtgacatttgagttcatgctacgcgtcgatcacgtagctcgcgggtacgacgactgggcagattccattcgtgatagccgaattaggaaacgctacgtcgctgtcgcccggactcnagtggtgtgaacgacggccttgttaatggggagtcaatgagtgtgagcgttcctgggcagagtgccaacttggttagggcagtcctagttcgctccgagaagcaggtgccataacattcggacatggtgctagaagcctgcccattgggaatcgttaagcacgagattgggcgcggcggctagtggaaaccccgaagttgcctactacgacaaggaattttggctttgtctggaccgataccgtacggacgtcgtacgcaagggaaatagagacgcgccgtatgtagaggttcctctcgatcggaaatcgccagcgacttaggcttcctacgtttccaactgaagtacaagaagcgtgccccagttcgtcatgacacgtttggtttcgacggccatttcggtttaagagaatgcgagccttttaagagatagacgcaggcacccaccattgggagaagaaggttcggcagtgaaagaccaggtgggcgtgcactttccgagtttgcatagaagtgtggagagctagcggtagacagaggtcgcttagccgcgtaggcacaaaacggatacggaggatttgttggacacgccccttgggcactaagaccaaagaagggttcgcaagaatgggtcgcctaccaggtgcggattccgatgaagaggactttgctgtagtcatgaccttatggggtaaatttaggaggccctggcacaccggatatatgccccaatttggggagcacgagaatttcccaatgtgctacggcttcgtaagcccagggtaagggacaaaaagaccagcgggtatacaccggattagggatttagtcggtcgcgtttagcagcgcgagcctcttaattgctcacagagcgntatataccg

SEQ ID NO: 518114 - DNA, 189 bp, Homo sapiens
ggtatggcatctgcggaacacgagacaccttcaactccatcatgaagtgtgacgtggacatccgcaaagagctgtacgccaacacggtgctgtcgggcggcaccaccatgtatcgcagggcatagccgacaggatgcagaaggagatcaccggcctgagcgcccatgcaccatagaagatcaagatcat

SEQ ID NO: 518115 - DNA, 301 bp, Homo sapiens
cgagtgaaggtcagcttgatggcaattaacaatgattaaagatactagtataagagatcaggttcgtcctttagctgttgtgtatggttatcatttgttttgaggttagttggattagtcgttgtagtggtggtgattagtcagttgttgataagatattttgtgagctcaggtgatttatactcctgatgcgagtcatacggatgtgtttaggagtgggacttctaagccatttatgcggggtgatgcctgttgcgggccagtgccttcctaattaggggggtaggggctaggctggagt

SEQ ID NO: 518116 - DNA, 306 bp, Homo sapiens
gatcgtgtccggcccgcgagcacagagcctcgacctttggcccgatccgccgcccgtccacacgcgcgccggcagctcaccatggatgatgatatcgcgcgcgctcgtcgtctgacaagcggctccggcatgtgcaaggccgggcttcgctgggcagacgatgccccccggggacgtcttcccctccatcgtggggcgctccaggcaccaagtgctgtgatggttgcggcatgggtcagaaaggattcctatgtgggcgactgaggtccagagcaagagaggcatcctcagccgtgaaggtacccc

SEQ ID NO: 518117 - DNA, 740 bp, Homo sapiens
tggctcggtaattgagaggagcggccgctccagagcttcctcccggggcgcccccctcagtccgtccgcgcttctcagtcgccagtctcctgtgccgcgctagtccccgcggtacgtgccgggccgcggagaccctcgctagaatgaggcgctgccggtggtgaggactggccgtcggttttccagaggcgcgctgcccatagctcgaaacctctgctagccctccatgccagctcgtattcctgctggccgccgccattgtcctccttcctcttcctcccccagggagacgtacgaggaggaccgggagtacgagagccaggccaaggcgtctcaagaccgaggagggggagatcgactacttcggccgaggaaggcgagaaccggccgggaagcgacgccccggggcgggcgcggatgtgcggcggtaggcggccggagcttctctcagccggaggcaggtggaagtcatcataaagttttctgttcacccgtcgtccatgtcgaggactctgtgaatctggtggtggaagcagacctcgttggaagcgctggaaaaatttgggacaatatgctatgtgatgatgatgccatttaaacgacaggctctagtgcacttttgcaaccttgattgtgcccaagaatgtgtgacattgctgcaataaaccgcgtttacttgcgggtcacaggctttttaactttttataaggcaaaggatatctccgggcaggaaaatgtgt

SEQ ID NO: 518118 - DNA, 707 bp, Homo sapiens
aggagaatagcttgaacccgggaggcagaggttgcagtgagccgagatcacaccactgcactccagcctgggtgacagagcgaggctccgtctcaaaaaaaaaaaaaaaaaaaaatggttttagcgctgggtttcccaaggggggaaaaacagacccagccgttgagctggccccgtggcctgtgttgctgacttctgggggtcctcaaaccactggtattttttctgttgagcctgttactgtggggagagatcagtagcattttgaggaagtaagagaacagaaatcagggtacctcagggtttctttcccttttactcgctggcagccattggtctggtgggccacctcatgtttttccacactctactggggccgtggaggtaacgatcacccaggccagtctcctcctgccgggggatgcgccctctgagaggaggcctagcagggcaggctccctctggggcttcccgggatgcagcctctggacacatgcctcctttaacagtgtccgggttgcagctcacggttgacttggacgcgtagcaaggacgaacccgacttgtttaccacgcgtttccaaagctcctgatctttcccaagatggtcctgaaactgcggtctctggttggtcccgcccgggcgtggtggtgctgctggccatgcttgtgacgtgatgtgtgtctctgattacggattcctgtgc

SEQ ID NO: 518119 - DNA, 169 bp, Homo sapiens
  misc_feature (9)..(9): n is a, c, g, or t
  misc_feature (28)..(28): n is a, c, g, or t
ggttttacnaaattggtcaggctggttntgaactcctgacctcaggtgatccgcccacttcggcctcctaaagtactgggattacaagcatgagccaccatgcctggcctctacctgtgttttaacgtggactatgtttatgccttggattagaacactggagtagctg

SEQ ID NO: 518120 - DNA, 1011 bp, Homo sapiens
gtgtcgtcttaacagtgcgcggaagaagaacgggaatagccagtatgatggtatgaacaggatgtggtagcaccgactctttgtggattacgactgaaaggaggaagagcggccagggcatccgtcaagagtagctacaccagctccccctaaagaaagcacatcaagggatccatacgtgtccaatccactagcgtctggcttccgggactttctgctgaagaccggagctcctgctgggccatcgtggactgtggcttagagcatccttctgaggtccagcatgagtgcattccccaggccatcctgggcaattggacgtcctgtgaccaggccaagtccgggatgggcaagacagcggtcttcgtgctggcaccctacagcaagattgagcctgtcaacggacaggtgacggtcctggtcatgtgccacacgagggagctggccttccagatcagcacaggaatatgagcgcttttccaagtacatgcccagcgtcaaggtgtctgtgttctttccggatggtctctccatcaagacggatgacagaagtgttgaagactcaactgtccccatgtcgtggtgggggaccccgagcgcatcctggtgctcgtgccggaataggagcttcggctaaagaatgtgaagcactttgtgctgcacgagtgtgaacaagatgctgacgcagcttcgcacctgcgggcggatctgacggagatccctccgcctgacacaccaggaacggcaggcatgatgtccagcgcaccctgagcaggacatcgacctgttgacggacggtcctgcagaatcccacggcaggtgttggtggacggcgaaaccagatcaactgcggcatgaagagaatagtaaacaaaacggaacaaggaagcttaaccctgaaagaactacaaggaaacaacacaaaacacgggagcagcacccaagagaagagcgcaccacgggccccggagagacacatcacatatcatcaaggggacaaaaatcaaatca

SEQ ID NO: 518121 - DNA, 1082 bp, Homo sapiens
atgtttaggcaaaagtgagttatttaagaatttataggctgggcgcagtggctcacgcctgtaatcccagcactttgggaggccaaggctggcggatcatgaggtcaggagatcgagaccagcctggccaacatggtgaaaccccatctctactaaaaatccaagaaattggccgggtgtggtggcatgtgcctgtggtcccggctacttcggaggctgaggcaacagaattgcttgagcccgggaggcggaggttgcagtgggccgggatcgcgccactgcactctagcctgagcgacagagtgagactccatctccaaaaaaaaaaaaaaaaaaaggatttaccagattttcggggcaaaccgtttgtctctggagaaccatttacatactttttcattaccacctttgggccgttttggaagactctacacggtttaacaattcccgaagagtaaatggacaaattagggactggggcacgaaggaactcattcctttcctgggggtcaccgtgtaacccccacaggcttaattgcttgactcccgggggaggtgcttgtgttcttggccaaaaagggtcacacaggctgagataggagaatctgggacatttctgacttccaacggggtgttaaaagttaattaaaacacagggttaacgtccaggtgctaaagttttcccccccattttaatccaccttttccacaatatgttggtttttgggggggattacacggcatttttctaacctctaacacaacttggtggtgttgaagtgggctacaccattttgtggcaaaaacacatttttttttcgtgaaagaaagggggccccattcgggaaaatttgtacgtggtgggttaaaaagagggattgccgtggaaaccaagacataaagctgtggggggtcaaactgtaactctgaggcggttatgtagagcacccccggctataattctgtgatgactgtgtgctctatgaaaatgtgtgcctataacatacgggggggaacgattggtaaagataatgtcgggttggaacaaagggcccacgagaaggtagatgtatacatacatg

SEQ ID NO: 518122 - DNA, 300 bp, Homo sapiens
catttagtatacgccagcttgaggaggtccctggtctgcattcaatgactgagttgaggcttgctgtgcggactcagctaatgttagcgcaacattcgggcaagatttttcggaggcggtggtggtgggataagagagactgaactgacaggaagggaatcctgaggggggtcatgggtaagctgctcctaggtgggaaacttgggacgagacaatgacgacgtgaccaaggtacgcttacgtaatcctacaatggacagccagacatctccccatgtgatcagaccaggtaaagccgag

SEQ ID NO: 518123 - DNA, 106 bp, Homo sapiens
aattcaagcttctaacgatgtacggggacatgccctatcacaaatacctcttttatctgtccacccctcacagactaggaccctcaaataaagctgttttatatca

SEQ ID NO: 518124 - DNA, 261 bp, Homo sapiens
ataggcttgatgggaaattgaaggtaggctgagtattgggaatcccaattgaattttgattttccttggcagtgaactacttttaaaaagtggtcaatggggtgttgctgccatgagcatggacaacctttggaggtaaaagctcctcaggaaaaccagttttccaagtttttaacctgtggccctgaaaggaatgttgagttaccttttcatgttttagacagccaaccctatcccttaaaggacttgttagaaccctga

SEQ ID NO: 518125 - DNA, 848 bp, Homo sapiens
tgatgcttttggttgaaacatatacctttaattaaaaacatgaggttttttattttaaaaaaatctccattgggtctaaaacacatagtaaatctgtagcttgaattttattctaggcataaacatcatatgttatgtctctttaaaaccacatactttaattcctcgttcaaaccatctgggctttttttatggcagtagatattacatactactttcatttcttcctgaaatttgaagcaggcaagaatggtctagagtgataagtgtcaggaaggccagcattgatttttaaaaattgggttctgaattttacaacaatcgctgaataagatcctctgcatagtgtgtgtgtgtgtgtgtgtgtgtgtgtgtatcattactagagatgtacagtgaaggatgccctgacggacactatatatggctaatgggtacttacttcccgtgatatagactactgctctctccctaggaattttcagacgcaataagtgtcatgcacaatatatgtgagccacatcgtgtgcataggatccgtcctctagttatcatcttgagtggaataaactaagctgaaagtagtctgtccttcccatccgagctttaatatacttctagtgttcgggtcttcgccctgagaatcttttagaacagtcgtgggttcgtgtcccatctagtacgtcactttgtgttttgtgcgtatctagcgatctttgggtgttgctattctgcagggctccgcccgtacattatcgcccggctgtactcgctgtgtttgcacttccgtgtatttgggttcatcgtgttatccactagcgtcacggttcgttttttccctgcgcgga

SEQ ID NO: 518126 - DNA, 102 bp, Homo sapiens
gggggtctggctctgtccccggggtggggggcggggggccattttcccctcccgggaaccccggcctcccggggtcagggggctttccttcctcccccccca

SEQ ID NO: 518127 - DNA, 386 bp, Homo sapiens
ctaagtatgcgtagatatttgggaacaatcacagtgagtttagagaggtgacttgagttgatactgatctcagcgatcccctcattacccttaattcatctgctatctgcaatatgtcaaattcaccaactaatgcggcttgcactcagaacactatgaaaacactggagtcttttacaagttatggccgcgtttgccacttaaagtactataaactgcttgttccatgcaattacatcctatgtgcttgttcttgttagacttttcgacttatttcttgacttcctttttttcattccagttatcacctgactgatctgggctcttactgctctgtagtcaaatgtgacattgccgtaattcctgctgtgccctttctgttgtct

SEQ ID NO: 518128 - DNA, 434 bp, Homo sapiens
gacaaatgtactaggaatcacacagacacgacagacacacacagatgtgaggtgtagaggcgtgaggctgtatcccagctactatgggaggctgaggcgggaggatcacagcctcccgggaggtacccgtgagccaagatcataccactgcactccagcctggctactgtctcaaaaacaaaaacacacacaaacacaaaaaagcccatgcttaaaccaatccctggctatgcaggcatttccagcatttccttgaaacgtttgtgcaaatacagatttgaacataactgattacagttcctgtccccaaaacttttggttccttccttccttttgtacgtggcacaatggtgagagtaggtactctggagtcagaatctatcagggtatgaggactggttctgtcgtctatgagctgtatgacttcggccgag

SEQ ID NO: 518129 - DNA, 147 bp, Homo sapiens
gccatactgtgtctggtgcatctgtctcactgagagcattgtcagataatttccttcatccctcccaccagctgactgagacaccagcactcgcctggaacactgaactgatgtgtcagcagcgaactgtcatctatcaagggtcct

SEQ ID NO: 518130 - DNA, 379 bp, Homo sapiens
  misc_feature (68)..(68): n is a, c, g, or t
cgagacgcgccatgcacagcccgggcgacagtgagagatcgtcaccaaataaataaaaaaaataaaanatcctctagcccaatccctccaacacagaagcagtcggagagcttgaaaggttagatgataggccctgtagcttgtctgtggaagagctaggctgcaagacacctctgatccgttgagtgcctcttactctcctttcccgatttaagacattaaatcatttaagacattaaatcatttaagacagtgtcatttggtcgggcgcggtggtaacgcttgaaatcccagcaccttgggaggccgagatgggcggatcacctgaggtcaggaattcgagaccaacgtggccaacatggcaaaacctcgactccac

SEQ ID NO: 518131 - DNA, 213 bp, Homo sapiens
  misc_feature (125)..(125): n is a, c, g, or t
gagagagagaactaggagatggagtctcgctctcgctctgtggcccaggctggagtgcagtggcacgatctcagctcactgtgctccagtctgggtgacagagcgagacccagtctcaaaaaaanggaaaattacagtgctcagatgagagggaaggctataaattggcgcattatcggcacatattatttaagtccatcgagcatcacatga

SEQ ID NO: 518132 - DNA, 288 bp, Homo sapiens
ttctgaggtcgctctagaggtcccctgctgcttctctcctcgttcagtgacatgtgatgcaactgctattgacgagcagtaaacagtccgtcttacggctatagcagtttcaactccactctgtaggtgaagattccatttacattcgatcacttaagttctttcaacttttttcctattcaataagttcctgtagtccagttatttacagattttacaagtactagcgagatcaagtgtctacaactcatacttgtcttctgctgtatcctctttcaccagattggg

SEQ ID NO: 518133 - DNA, 180 bp, Homo sapiens
ccactgcttgtgggacacgacagttcttgagcagtaacagagttcattttcacgggcgagcggtgcgttctgacagtacttttttaccagagagtacgtcgttgcagcgacgtggggagtaccggcgtacgagcttggcgcctgatgcgagtactggacagccagaggactctggagaga

SEQ ID NO: 518134 - DNA, 366 bp, Homo sapiens
  misc_feature (78)..(78): n is a, c, g, or t
  misc_feature (207)..(207): n is a, c, g, or t
  misc_feature (316)..(316): n is a, c, g, or t
gcatttaggaactcgctcctcgggagaatgtgtgccgacgggatgcagaggaaaggcctgaagttcaatttcacctcnatcccgggggtcacacgggcctagcacaccacttctttccagcaggcggtacgcacgcaagacaggacgcatgcatggtacacacctcggcatagccatatgtcagcggggttcccagcggagtcaatncatccagatctctggcaacactccacagatggaaggtgacttgttctgctgcagtactctgagccctgggattcatctggctacgcaccgggggtagactgtgtggcanggggtgaggatcttcaccacttgctatcgggctacacagcacgtgctccg

SEQ ID NO: 518135 - DNA, 143 bp, Homo sapiens
tcgctctagaggatcttcttggacgagacgacctgttgaaatacaacgtttggtgatttggtgtggtccaaagtgtcgggttacccttggtgtgcttgcatggtttctagcagatcccactcctttcaacagctattaccaaa

SEQ ID NO: 518136 - DNA, 356 bp, Homo sapiens
  misc_feature (58)..(58): n is a, c, g, or t
aacttgctttctctgccatctgctccgcgggcgccgtcagcatgggtccctggacacntccttgcgcgccgtcctgctgctggtgcttttgggagtctgcaccgtgcgctccgacactcctgccaactgcacctaccctgatctgctgggcacctgggtgttccaggtgggccctagaagttcccgaagcgacattaactgctcgggtgatggaagcaacagaagaaaaggtagtggtacaccttaagaagttggatactgcctacgacgagctgggcaattccgggcattttaccctcattttacaaccaaggcttcgagattgtgttgaatgactacaaaatggtttggcgttt

SEQ ID NO: 518137 - DNA, 738 bp, Homo sapiens
  misc_feature (79)..(79): n is a, c, g, or t
  misc_feature (227)..(227): n is a, c, g, or t
  misc_feature (273)..(273): n is a, c, g, or t
  misc_feature (320)..(320): n is a, c, g, or t
  misc_feature (563)..(563): n is a, c, g, or t
  misc_feature (613)..(614): n is a, c, g, or t
tgctgagattacaggcgtgagccactgcacctgccagtaactcttctgtgtgattcactggcttgtactaaagatgaanttcagcatttatgcatatttatcttttgaggcttatttggtattggaggttttcctctctcactttttgctaatgaggaaaacaaatggataattgaaaagattaactcagagtaatgagtaaaattactggaattcaattgaatacnatagtcttcaacactgggctctaaaatgttcaggttaggtcacccnacgttccaacttatgggttttggaaaaagcagatggctttaacaggngaatatcattcactttaggtaggtattcttgtgtatctatttggcagacaagtagagaaacatttcaggcataaatacagttgttaacatttgggattatagtcttaacctttcctcactgattagaattccgtagtgacacatttgagattagctttttaacaaagtcacttcttgttagaagtgacttttttaaagaaaataagttagctttactcacttgtgtagtaattccacattaanataaagtttcagctatttttggggtgtaagaatagttggtgagtatgatnnagttatttttttctagatttagtcggtatatattgatcaatagggttctttgtatgtttgagatactataccagttgaaggtgtgggacttaaacaagtggaggaagggagtgccttgtatatc

SEQ ID NO: 518138 - DNA, 372 bp, Homo sapiens
acctagaggacccctgaatcgacggtttctccatgttgtcaggctgtctcaaactcccgactcaggtgatctgctgctcggctcccaagtgctggatacaggcgtagccacggctggcttccataagtttttgtggtaagcttgggtttccctttaattctaaaatgagagaattgaaattaaagtacagcagattgccatttttaaaaaacctatttacatttgtttgaaaattaaacctttagcaaatttgttagcctggaatgggggagattaggtactttgaaatttttgtcgtgggaattgtaaaatttagggacatcgtctttattggacggactaatttttataagaattccatcgaggatttat

SEQ ID NO: 518139 - DNA, 874 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
  misc_feature (733)..(733): n is a, c, g, or t
  misc_feature (737)..(738): n is a, c, g, or t
  misc_feature (747)..(747): n is a, c, g, or t
  misc_feature (769)..(769): n is a, c, g, or t
  misc_feature (771)..(771): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcaattgaanctcnncatcggaantgcctgtgccgaaggggtccangngccgcggaatggagcccgagaccacaactggggcaagaaacagcgcggccactggtggctccgagcacaaaaaaaaaatagcggcccgaaaaaacacaggcgc

SEQ ID NO: 518140 - DNA, 1212 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccttggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaaaataaaaaacaaaagaaaacaaaaaaaaaaaaaaaaaaaaaggcagaaaaaaaaaaagaaaaaccaaagcaaaaggaagaaaaaagaaaaaaagaaaaagaagaagaagaggcagagaggagaacaagagggcgcaccacacacagccagcggggccaaacaccaccccacggcgacaacaaccgacagagagagagaccaaccctcacccaggcggagagggaggggcgcgcggagaagaaaaaaccacaaaaaacagccgaacacgcgcaacgaagcgaccacacacaaagcagaagaaaacaccgaaaagcctaagaaggaagaggcacgccaccccgccaccgggggcgacaacggcgcaccgaccacgcacgacagagcatagcaccaagcagcagaaggcggagcaaccatagacagccatcagacccacagccgaggaacacgacagacgcaccacccccaggcgcgccgaagcatagacgaacacacgagataaacaccacagtgacggcggcgcagaggaagcacacgacacatccaacgaaggaaagaacgaaacacaaagcaaaacaggccaccgccagaaacaatcagtcacgccagccccacacaccagc

SEQ ID NO: 518141 - DNA, 769 bp, Homo sapiens
  misc_feature (24)..(24): n is a, c, g, or t
tagtgctgagggcctcaatactanttctctttccctgcacagtcttggttccccggagacgtccagtccggcgggcagcaagactgtgcaggaaaagagaactagtgctgagggcctcaataaagtttgtgtttatgccaaaaaaaaataaaaaacaaaagaaaacaaaaaaaaaaaaaaaaaaaaaggcagaaaaaaaaaaagaaaaaccaaagcaaaaggaagaaaaaagaaaaaaagaaaaagaagaagaagaggcagagaggagaacaagagggcgcaccacacacagccagcggggccaaacaccaccccacggcgacaacaaccgacagagagagagaccaaccctcacccaggcggagagggaggggcgcgcggagaagaaaaaaccacaaaaaacagccgaacacgcgcaacgaagcgaccacacacaaagcagaagaaaacaccgaaaagcctaagaaggaagaggcacgccaccccgccaccgggggcgacaacggcgcaccgaccacgcacgacagagcatagcaccaagcagcagaaggcggagcaaccatagacagccatcagacccacagccgaggaacacgacagacgcaccacccccaggcgcgccgaagcatagacgaacacacgagataaacaccacagtgacggcggcgcagaggaagcacacgacacatccaacgaaggaaagaacgaaacacaaagcaaaacaggccaccgccagaaacaatcagtcacgccagccccacacaccagc

SEQ ID NO: 518142 - DNA, 203 bp, Homo sapiens
agcgacgtatgtagaacgatcggtctctgggtcataaacaaggtaaagaaaaaggtgctgtgctattgatgtgcacatatgtaaacacctcaatgccttaaagagcagtattgccgccagcatgtctcacctccagccctaaggcggttttctcctatctcagtagatggaatatacaatcaggttttacactgagacattcc

SEQ ID NO: 518143 - DNA, 149 bp, Homo sapiens
agaatgttacttggtgagtattaagaggggccgcacattggaagccctcatgagtgcaggcccgcctacttagtcagaggggcacgacgtgggatgtacttgaccccgatcagtccatcgtgggatgagcgcgcttttctagccactca

SEQ ID NO: 518144 - DNA, 338 bp, Homo sapiens
tctgatatgctgtccttgtgtctttcatctgatgaccttaaggggtgggactgttttatcttaagttacaggtgttcaagtccagcccaaggacagcaactatgagggtcaagcttcataggttaattggatagatgttctctgatttgccacccagtggagcccgacgtgccccactaatttatatttcccctggtgtcattttgtactttttatttataattcacccgtaaagtgtatgtgtctatgataagctgccgcggatgtttcatggtatgaggtggtgacctaagtaaagaaggagatgtggcctttctttttttgttaaaaaaaaaaaa

SEQ ID NO: 518145 - DNA, 798 bp, Homo sapiens
  misc_feature (24)..(24): n is a, c, g, or t
  misc_feature (97)..(98): n is a, c, g, or t
  misc_feature (122)..(125): n is a, c, g, or t
  misc_feature (145)..(146): n is a, c, g, or t
  misc_feature (148)..(148): n is a, c, g, or t
  misc_feature (152)..(152): n is a, c, g, or t
  misc_feature (166)..(166): n is a, c, g, or t
  misc_feature (205)..(205): n is a, c, g, or t
  misc_feature (212)..(212): n is a, c, g, or t
  misc_feature (222)..(222): n is a, c, g, or t
  misc_feature (233)..(233): n is a, c, g, or t
  misc_feature (235)..(235): n is a, c, g, or t
  misc_feature (389)..(389): n is a, c, g, or t
  misc_feature (412)..(413): n is a, c, g, or t
  misc_feature (427)..(427): n is a, c, g, or t
  misc_feature (448)..(449): n is a, c, g, or t
  misc_feature (458)..(458): n is a, c, g, or t
  misc_feature (462)..(462): n is a, c, g, or t
  misc_feature (471)..(471): n is a, c, g, or t
  misc_feature (538)..(538): n is a, c, g, or t
  misc_feature (543)..(543): n is a, c, g, or t
  misc_feature (557)..(557): n is a, c, g, or t
  misc_feature (560)..(560): n is a, c, g, or t
  misc_feature (576)..(576): n is a, c, g, or t
  misc_feature (580)..(580): n is a, c, g, or t
  misc_feature (586)..(586): n is a, c, g, or t
  misc_feature (592)..(592): n is a, c, g, or t
  misc_feature (634)..(635): n is a, c, g, or t
  misc_feature (639)..(639): n is a, c, g, or t
  misc_feature (766)..(766): n is a, c, g, or t
tagtgctgagggcctcaatactanttctctttccctgcacagtcttggttccccggagacgtccagtccggcgggcagcaatgacacccactttgcnnccagcaggggcatctctgcggatnnnngagggcttgccgatgtgctnntngttnccacctccaaaacnatcctccacaggatttatggccacaccccgtactcgtgnccagcantccctctttnccttatatttntngtacgcccggccagccttcaagatgggtttgtcaattcggccacctccagccaccacaccaaccacagctctgttggctgaggagataaccttcttggagccggagggcagcttcacacgggtcttcttggtctcagggttgtgggaaaaaacngtggcatagttccctgatgcccnngccagcttgccacngtctccaggcttctcctccanncaccacacnattntcccctcangcatggtgcccacagggagcacattgccaatgttgagctgggccttcttgccgcaatacacaaactngcccntgtcaatcccctcngcngcaatcaacacctccntccncttctnaaaccnatacggatcccggaagaccaccttggcgaggggcgcgccgcnncccnggtcgtggatgaagttcttgacgatgcccttgatgtagccgtgccgctcagcgaaatccacggcgcgcaggccgcagctttttacgggtgcttcacgtgcgcgcggaacacagacccggcgcccttnctctgttcacggatcacacggcccatggcgac

SEQ ID NO: 518146 - DNA, 727 bp, Homo sapiens
cacgtttgacccagttcggttccccaacgctattcccttttagactggtttccctcgcctccgtatacctaacctccccgtttaacgtaactcgcaggatcattctccaaaaggcacgccatcaccctaatgggctctgaccgcttgtaagcacacaatttcaggttctatttcactcccctccaggggttctttgcacctttcccctcacggtactatgcgctatcggttagtaagagtatttagccttatgagatatggtcctcactgattcacacagaattcctcgtgttccatgttacttgggagcaaagttatatgtgtaaggatttacttatacaggactctcaccttctgcggtttatctttccatacaattctaattcatcaatacactatattgaatatcttacagttcttcactactttgtccctcaaccccttaaatacaacggctgtatccttgacatatttaaggtttaggcttgacccagttcgctcgccgctactttgggtatcgtttttactttcttttcctcacgttacttagatgtttcagttcacgtggttccctctttcgtattaagactccatcttaatagattgctccattcggaaatcctagactcttacgttcgattgcaacttatctaggcttatcgcagcttaccacgtccttcatcggctcttactacctagcgcctatagggatcctctagatcgctcg

SEQ ID NO: 518147 - DNA, 586 bp, Homo sapiens
  misc_feature (5)..(5): n is a, c, g, or t
  misc_feature (12)..(13): n is a, c, g, or t
  misc_feature (15)..(15): n is a, c, g, or t
  misc_feature (21)..(21): n is a, c, g, or t
  misc_feature (24)..(24): n is a, c, g, or t
  misc_feature (27)..(29): n is a, c, g, or t
  misc_feature (68)..(68): n is a, c, g, or t
  misc_feature (106)..(106): n is a, c, g, or t
  misc_feature (109)..(109): n is a, c, g, or t
  misc_feature (258)..(258): n is a, c, g, or t
  misc_feature (439)..(439): n is a, c, g, or t
  misc_feature (442)..(442): n is a, c, g, or t
  misc_feature (445)..(446): n is a, c, g, or t
  misc_feature (448)..(451): n is a, c, g, or t
  misc_feature (454)..(454): n is a, c, g, or t
gcggntgactcnnangacccnaanacnnnccaaacccccggttttgctggacggcgcaaaagttggcncgcaccctgctatatgcttagtacaaaaacaataacangcnttgtacaagacaataaaaataagacgaatcgactcacgcataacaaaaacaacacggcggaggcgcagctaactgattcttttggagaggcgttgcatttggggcttgccccgcaaccaggccgagaacaacaaaaactgccctaaggnagagcctgaactggttggatcgtagatcagcaacacagcgaccaaagcaatccgtttgctcttggctcccgattgggagtgtcatgaaggaagcttcgtggcgagggcgatcaacaaaaacaagaagcccgacatcaataataaaaatagagcacgcaactacttctgggggagcttcggntcnttnnannnnccngatttgaccttcaaacgcttatggcgcaatgcctttagctttgttcctacaaccatcccctgactaaatgctagaatccccggccatcatgcggtcattcttcggtatggccgaacatccttcaaacagtgc

SEQ ID NO: 518148 - DNA, 808 bp, Homo sapiens
  misc_feature (800)..(800): n is a, c, g, or t
cacgtttgacccagttcggttccccaacgctattcccttttagactggtttccctcgcctccgtatacctaacctccccgtttaacgtaactcgcaggatcattctccaaaaggcacgccatcaccctaatgggctctgaccgcttgtaagcacacaatttcaggttctatttcactcccctccaggggttctttgcacctttcccctcacggtactatgcgctatcggttagtaagagtatttagccttatgagatatggtcctcactgattcacacagaattcctcgtgttccatgttacttgggagcaaagttatatgtgtaaggatttacttatacaggactctcaccttctgcggtttatctttccatacaattctaattcatcaatacactatattgaatatcttacagttcttcactactttgtccctcaaccccttaaatacaacggctgtatccttgacatatttaaggtttaggcttgacccagttcgctcgccgctactttgggtatcgtttttactttcttttcctcacgttacttagatgtttcagttcacgtggttccctctttcgtattaagactccatcttaatagattgctccattcggaaatcctagactcttacgttcgattgcaacttatctaggcttatcgcagcttaccacgtccttcatcggctcttactacctaggcatcctttgtgtgcccttaattattttaatctattttttgacagctaactctaagaaattgttagagttaattcttttcttgtttgttctactatatagnagcaaaga

SEQ ID NO: 518149 - DNA, 887 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 518150 - DNA, 1510 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaaaataaaaaacaaaagaaaacaaaaaaaaaaaaaaaaaaaaaggcagaaaaaaaaaaagaaaaaccaaagcaaaaggaagaaaaaagaaaaaaagaaaaagaagaagaagaggcagagaggagaacaagagggcgcaccacacacagccagcggggccaaacaccaccccacggcgacaacaaccgacagagagagagaccaaccctcacccaggcggagagggaggggcgcgcggagaagaaaaaaccacaaaaaacagccgaacacgcgcaacgaagcgaccacacacaaagcagaagaaaacaccgaaaagcctaagaaggaagaggcacgccaccccgccaccgggggcgacaacggcgcaccgaccacgcacgacagagcatagcaccaagcagcagaaggcggagcaaccatagacagccatcagacccacagccgaggaacacgacagacgcaccacccccaggcgcgccgaagcatagacgaacacacgagataaacaccacagtgacggcggcgcagaggaagcacacgacacatccaacgaaggaaagaacgaaacacaaagcaaaacaggccaccgccagaaacaatcagtcacgccagccccacacaccagc

SEQ ID NO: 518151 - DNA, 460 bp, Homo sapiens
aaaaaaaaaaaaaaaaaaaaaaaaaaaaatttttggggccgcccggcccccaaaaatttttaaacccttctttgggggggggggcccctggagcaacttgggccccggttcccagaaaactcccggtgcactaggaacgcgctgggggctcttctccccaatatataaaaaacgcgcgcggggggaggggcaccgcgacggggtgtttgtgggaacaacaactcccaagagttgggtcgctacgggcgagcaactaaagcgtgggcccatatattaacaaaggtcaagcgctccaaaacgaggaagcgccgaaatactaaaaaatttaacgggcccgccacgggggggggactaataataatagcaccaacattgcagtagagaggaaagcatagcaacagcaaaaagagaaacatcgactcacacgacatgcagtatacttacataaatacacacaatg

SEQ ID NO: 518152 - DNA, 929 bp, Homo sapiens
ggcattggcagtatctgccgccatcctcttcctgtgaggcgctgctgagaccctggaccggccctcctgagagtgatgccggtgcgggctgcccgcggagagggaccctgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 518153 - DNA, 941 bp, Homo sapiens
  misc_feature (20)..(20): n is a, c, g, or t
gcgcccgcggagagggtatnggagtggtgggcgcggcggctcgggggcggggtcccggaaagccgggctggcgggggtaccgggccgcccgcgcgctaatcgtgagtcgcccccaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccgcggcgcgcccctcgccaaggtggtcttccgggatccgtatcggtttaagaagcggacggagctgttcattgccgccgagggcattcacacgggccagtttgtgtattgcggcaagaaggcccagctcaacattggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 518154 - DNA, 328 bp, Homo sapiens
tgccgtgggacattcacgtccattcaagggctcggattacatgtgtgacctaccttgcctggcctgtttgacttcttctttacacaaaaaacaacagtgtgcgttggtccatttttttttctgtgtgtatttgtgtgtgtgtatatttttcatgtattagtagtatgtaaaagagtaacacaaacaaaccccatacataataaagtagaatcacaacaaaatgaaacaagacaatattagtgggatgtaaaagaccctccctggtacaagaacacctttctcagcattataaaaaaggtgttcctacagcctttctttgacccccagt

SEQ ID NO: 518155 - DNA, 974 bp, Homo sapiens
  misc_feature (16)..(16): n is a, c, g, or t
  misc_feature (24)..(24): n is a, c, g, or t
  misc_feature (27)..(28): n is a, c, g, or t
  misc_feature (31)..(31): n is a, c, g, or t
  misc_feature (34)..(36): n is a, c, g, or t
  misc_feature (38)..(38): n is a, c, g, or t
  misc_feature (42)..(42): n is a, c, g, or t
  misc_feature (234)..(234): n is a, c, g, or t
cccccccgaagacggnaactttanttnngtngannnangccntcggccgcgctggtgaacaggacccgtcgccatgggccgtgtgatccgtggacagaggaagggcgccgggtctgtgttccgcgcgcacgtgaagcaccgtaaaggcgctgcgcgcctgcgcgccgtggatttcgctgagcggcacggctacatcaagggcatcgtcaaggacatcatccacgacccgggccngcgggcggcgccgccttcgggccaaaaggggtttggggtttcccttttccccgggggatttcacggtaattccgggtatctaaaggaaaaagacgggatacgggaggactgttttcactttggtccgccggaagggggcaaattttgcaacatcggggccaaagtcttagttgctaatgtgacagggccaaagaaaaggtctccaaggcgtcaactagttggcaatgtgctccctgtgggcaccatgcctgagggtacaatcgtgtgctgcctggaggagaagcctggagaccgtggcaagctggcccgggcatcagggaactatgccaccgttatctcccacaaccctgagaccaagaagacccgtgtgaagctgccctccggctccaagaaggttatctcctcagccaacagagctgtggttggtgtggtggctggaggtggccgaattgacaaacccatcttgaaggctggccgggcgtaccacaaatataaggcaaagaggaactgctggccacgagtacggggtgtggccatgaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggaaaagagaactagtgctgagggcctcaataaagtttgtgtttatgccaaaaaaa

SEQ ID NO: 518156 - DNA, 374 bp, Homo sapiens
  misc_feature (216)..(216): n is a, c, g, or t
  misc_feature (231)..(231): n is a, c, g, or t
agcgagcagcgagctggctggatcgccgagcggcgagtgagggagccgagccgcccgccgccgcagccctgtccctcgcgcttcgaggacgagagaggtagcgcgcgcagaccgaccgaccggggacgggaccagcgacgcgagcgctcggggcaggcaggacggtcagggaccgcgacgcgaggcagacccgaacgcgtggatggcagtagcagngagccgaagccggcngttgcacgcggaggcggcacggaaccagtatgcgggctgcctcgcgccgtgttggcagttgagggcggaagccggctttggcccctgagctatgttggacgaacgaaaagaacaaaagaatctaaagtttgagacacaagaaa

SEQ ID NO: 518157 - DNA, 1288 bp, Homo sapiens
catgcggagctagatagataaccgtgcatgagtatcatcctactattgataagaatagagatcaaatacaactattaataataatatatagctctattagagttaactaatattataagactatcagcgcttaagttttttaaggtatgaatatagattagtctttaagatttgaggacgaggaattatgaagcacgtaggaacgcagtaccgagtgaggcaagggagaagagatacatagggtttcctcacagaacgactgtagcgggcaccgctcagaggaatgcaaaggccttccttcagtggcagataaccaccctggtagtagttaatagaggaaataagtcgaggcaggtagacagccgaactaccagcacggcgcgccgtaaatttagagtaactcaatcagaaacgggtcaaatgacttgtgaagtactctaacacgttgattagggtagagcgtgtaagagctacgtcggttgaaaatgctcttgaagtcatagcgaatggttagctaaggctgagtttatacagatcaatcccgaaaggggccgagtctatttaacagaagaggggtagttgacaaaccgagagggctcgagtgtataaaagatccttagagggagttccaatagatcgcagggacagaaaataaggggggtcaattccaaaaggcactttacgttaacagctggttataactttaaaaacggctaggtactgaaaaacctgggatagagtagtgtacaccttggtgagaagttgggtcagaggaattgaaaaacgaaattaggcgagttaaatgagtaggcaacgatggacgaaaggtggggagaaaaacgagggtaattgagctaggaacacgtcaccagtgaggaaaacgaggcggaaaagcaacaagacgcaccatacggaaggaagaagaagtagcgcgcaaaaaaaatccatggcaccgtggatttcaattggaatacccaaataaacgtgggtaacagggaaaagcgatatcgtaggagatggggaacttcaacagaagtgtgtgacccaacacatggagaactaagggcctcccggaagaaggctcagcaaatgtcaacaccagggaacgaaagagagcggggataagagaaaaacacggaacaacacagctcgtaaaaaggcgcgcccaagagaaaaaacccaatgaggacccacacagagaacacacaaaaggaaccgtaccaaactccatgtggcagggcggacgtgcggcccccgcacgcccacacggcagtgtgcagaacaccag

SEQ ID NO: 518158 - DNA, 901 bp, Homo sapiens
ccaccctcggactttaccccagtgtgcaccacagagctggagagctgcaagggtggcaccagaattggcaagaggaatgtacgtgatggccctttcaatagacagtgtgtgaggaccatctttgccttggagcaaggcatcatcaatgcttacaattgtgaagagcccacagaaaagttaccttttcccatcatcgcaggattaggaatcgggagctgtgccaatccctggtgtgggccatgcctggtattcccagccagagcaaggctgacaaaggggcatgccttgtcgcacaggctccgcgtgggtggtacgtctctcgggtccctgaattacacgcaaggcttggaagctggttcttatcccttcttacccagtttacccatcttgcaaggggaaacctctggactggcaggactcccctcaaggggggctacgctcaatcattcttccttccacaaggcgttgtaccacagccaggcacaaaacacaaggggtttctgccaacacccccaggtgtggactgtggaccgcggactgggggcatacggtggctggatagggctcccctttccaataccaattccccctggacatccaaacgaaacggcccacataaaaaaccttttttcccccggaaacgacggacgctcttcaacccaacaaggaggcctcaccaattctgttgcgcaacggacatactaccttccggctaacacgaccgccagaggcctataagtctctgttgggcgacaccctgggtcgcttcgtcgaagcccaagcacgcgattggtcacgctgccacaattgtcgtccctccatcgcacgccattttccattataccaccattccttgggtggtcatccacagccaagcggcttcatcaagggttggtcatac

SEQ ID NO: 518159 - DNA, 789 bp, Homo sapiens
taaattcccatatgggctaaaaaatccaaattttttaaaaatctgtctctctttcttctctcataaagtgaattatccctttttttggttttatgtaagtgtatatattcttagtttttcttggaaatcattgtaatgttacactttgttgttctcaaatatctggcgtgatggctctcattatctcttcaacaaaaaaacacctttaatttgtcgccatgtgaacactgtaaacacttatgccagagtgcttttatatttgagaaaacccgcagtgtgctcttcgttggtgtgcttttaccaacacaacacaaaaggaaaaacaagtgggggtggtttaaccattttgaagaacaaccaaatttgtgggggcgacaaaggtttggttggtgggggccaactttaaaattttttacatccaccccctcgtgggtgttactttctgttggtgtatcacgccaacaaagccaccaagtaattttttttcttttctctaacaacccagagggcttcactcctcgttggggcaagcttaacaactctgtggcccacacgacagggggggacaacaaatgttttggctcccccaaaggttcgtttttttatttacacaacaaaaccaaaaccatttcttttgttttttttgctcaaccacgctctcttaacaaggttggtttttgagaaaacacttgggagggacatattaatcgttggcgcggggggaacacaacacaattcttttataagaaacggcgctctttttttttttaaaaaagaccaaacaatgtg

SEQ ID NO: 518160 - DNA, 148 bp, Homo sapiens
ggacgcccctacgtgatcatcagtgccgccaagggttgcgcctacataagtcggaggaccgctgttcgtgctggacgaaagcttgccattgacacgcagaattacctggagcagcagttggccaagcccctcctgcgcatcttcgagc

SEQ ID NO: 518161 - DNA, 299 bp, Homo sapiens
  misc_feature (266)..(266): n is a, c, g, or t
ccccctgaatcccagcactttgggaggtttctaggtgggtggatcacaaggtcagggggagcgagagcatcctggctaacacggggaaaccctgtctctactaaaaatacaaaaaattaaccgggcgtggtggcgggcgtccgtaatcccagctactcgggaggctgaggcaggagaatggcgtgaaccccggaggtggaggttgcagtgagccgagattgcgccactgcactccagcctgggcgacagagcgagacctgtccccnctcaaaaactaaatcaaactacaaaagcttgtt

SEQ ID NO: 518162 - DNA, 243 bp, Homo sapiens
tacacagtgaggtctcatgcccaaacatgaggcacatgtgtcagaggcatttgaaccagagtcactccatcttgaatgggggctgggtaaaataaggttgagacctactgggctgcattcctgagagattaggcattcttactcacaggatgagacaggaagtcggcactaagtacaggtcacaaagaccttgctgataaaaagaagtggtaaagaagccggccaaaaccagccaaaacccac

SEQ ID NO: 518163 - DNA, 1253 bp, Homo sapiens
agtgcccacctgtctgctgcatgctgcatagtgaacattggaatatatgaggatggaagagatgagaagaattacctcgtcactatagcataacatgagtacacgaagattatttactcgtcatgagagatagcgatgggaacagcttagtatagtatataacaaataagcagatgggatgcagttagcagacaaaaggatcagaattattacacatcagctcagtcatcggaagtatttaggatgctaagttgagcagatttgacatcaagttctagccatatgctatagacacagaggacatggaagagggaatagagatataggagatgaatatacagtagaagatacatcaatgtagataagataagcatcaagacgacgacatagagatatgacgtagataactgcagaagaaagcagtcgttactaaggctaggatattttagtagatgagagagtatagaggaaagtagaaggaaggcagaatcggtatgcaatgagaagggagagagcagaggattgaggtagatacaagacgatacagtcagaaatacgagatactgatctagtagctgcaagaacaggcgccgcagacggagagaagagaatactcgtaccaataagtataagcaacttatagtacagagatggtaaggaacgatagcacagtctgcacagctatggatacggatgtcgagtagaacttactggatgtgagatcagcagagacagcttagtgatagattacgctagatacggtctgccgtccagtgtgtatgtgtatgatagactaaatgagagtctagggtatagagaactgatagattatctcaacagtgatctactctgcacgttcagagaactagcgagatagacgagaggatgatgtacaacatgtataactgtcatgtattgctatcatagccgtgtatgaagcaggatacgtctcctcaacaaataacggaatgcgaaatcagagatagaataataagcgacagacacaagattactctaaagtataacgaaacgacaactacaagaagtaaaagacataagagaaaaaatataagaaaagtacatgaatgaaaagcaaaagaggaaaaggaaaagagatagcaaagaaggagatctaatacatcaatagaacagcaaagatagaagtaatgaatacaaacatagaaggaataagagtctaggactaacgtgaacgatcgacactgacagaaaaaataaaacaacagtataattca

SEQ ID NO: 518164 - DNA, 424 bp, Homo sapiens
tccttcgagaaatgtctcactgtgttgcctaggccgaagtgcagatggcacaatcacggctcactgcagcctcaatctcctaggctccagaaatcctcccatctcagcctcccaagtagctgggactacaggcaaacaccatcgtgcctggcttttttttttttttttttgggaaaattgaggtctcattttgttgcccaggctagtctcgaactccgggattcaagcactcctgcctcaacctcccaaagtgatgggtttaccctgtactcactttatacctcactttctatagactccagaatagctatccactatttcagcgatcccagatctaaatctctaattactcagctacctcctgagctctataccatttattacaaactacacatctgcaccttcccaatccttccaaccagaa

SEQ ID NO: 518165 - DNA, 981 bp, Homo sapiens
atggcacatgcgcgcgcaagtaggtctacaagtacgctacttcgcccgtagtcatagaacgagaccttatcagcctttcatgatcacgccctcataatcattttcctttagtctgctttccgtagctctcctgtagtgcctcttttcgctaacgaactcagcaaggaataaactaatcgtaagtactaataattctcagacgcgtcgaggaaactggaaaatcggtctgtaacgtatgcgcgtggcccggccgatgcaatcctagttccctcaatcaatccatcccagtcccgtaacggcatccctttagcataaaacagcatcgcaggatcatacgaatccctcgcctataccactcaaagtcaatttgggctgccaatggatagctgaaacctagcgagtacggccgagctaacggacgggactaaatcctttcgaaactgcgctatcgataacttacacgcaccattgattgcctagatatccgaggacgaacctgacgatcttccgttggacggtatgaacaatgcggagtagtaagcatcaccgattggaatgctcaccacaatatcggtgaatactgtaacttaacatcaacaaggagtgtactttggcacgtcaatgagcctgtccccataatttaggcctatgagcatacaggattcgccattccgctggacggtctaaaaccaaactctacaatttcaactcgtttacaacgaagcgggagggtaatatgtactgcgtgcaattggctactgcatagatccgtattggagtagcgatagccaacgagtttacatggcgccaatcggtcctagaagttaatttccccctatacaagtctttgggacataatggccacgtatttgacccatattagcacctccttcataccacgtcttagaaagacataaaaaagaacaattcacatgtaaacacacttttgttcggatccactgaccctgaaacatttattga

SEQ ID NO: 518166 - DNA, 501 bp, Homo sapiens
  misc_feature (207)..(207): n is a, c, g, or t
ggcaacaacaaagggccccccaggccggcaagacaggttaggggcgacccggcaagatcacagttagagggagaaggggaagccctgagccgggccctcccccaggtcctggggtacagccatcccgttaagccggcctcacccaaacccgggtgggaccttaagccctggccaagttttaaggttttgtcattaagcaaagggaantgcaccgggggaggtcctccctgggcccccagcctaagcccaattttttacccgaaagaatcattgccttggcccctccctccggggggcccccatcacctttaatgtttccccccctgggttaaacaggggaaaaacgggctgggggaaacctggatgggggccaagtcccctgtcccccttgggggcaaaagcccattgaaaaaaaaccagcccagccggccccctattttgtccgggaaaatttttgggggggggacccaaaaaaaaaaaaaaaaaaacccattttttcca

SEQ ID NO: 518167 - DNA, 206 bp, Homo sapiens
gatgcagcatatccccagtaagtaaagacaggcagccccccacgaaatcggagaagcctcttcaccaggtcagccccttcctcactccccttgttccctggcgacactgtgcagagggacactttccagtctttccccgccatcgctggacctttggacataccggccagattttcacctcttaaataaaaatgcagtgggtgtca

SEQ ID NO: 518168 - DNA, 611 bp, Homo sapiens
gatctctgcagggctgaggacgaggaggagaccacgttcagaatggagtccaacctataccaggaccagagtgaagacaagagagagaagaaagaggccaaggagaaagaagagaagaggacgaaggacgaaacagacagcaaaggaaggagagagcaacttgtggacctggcatctggaggacaaaagagcccggagaccatgagagagcaaagagcacagtcatgtggacagattccgtgtgtgcctcttccaggcagtcccccagaagatgcctcttctgccccctaaaagcagttgccttggactttgaagcccgtgcaaaatgactccatctggggattcagaatacagtgtatctcaagtgaagaacggcttgggaacccagcccacctccctcactggggggctctctgggcaaaactatggttttacatgcacccctcttcctgagcttggtcccttgcctggtgattcttcttaatactcggagagccatcccttggtttgaggaagacacccgcaatcctcccatgatctcatggcatccaccctggcttctccccaatggcctgaattttcattatttacacttctggcctgaatggtct

SEQ ID NO: 518169 - DNA, 222 bp, Homo sapiens
cttgcgtacctcataacactgggaaagaagtaacagttgagtgcaggattgatggatcagccaacctaaaaagtcagtgatgatcgtgacaagttatatgggacgagttatgtacaaaatcacagcacgtgcaatagtactgagtaggatatctccgacagagtcaaatggtagtgttgtctagtcgttcatttgtgtaaccagcctgaccattcacattcg

SEQ ID NO: 518170 - DNA, 796 bp, Homo sapiens
gcctgaggtacagcggcggtttctgaggttcttcactcgacgactgacggagctgcgcgcggcgtctccacacgcaaccatgcaacgtcgcacaggacacaaaactcaaggccaaagcagctcaagcatgctgcgcaaatttcagacaaagggaatcaaacgttgctgggacaaatgcgacggaccctgaacgattgacccacatatgctatatgcacgcatggacacgactggactgaactatgagtgtgcctctccgacggacaattgaccacgacttacccagattgcgctctcaccctgacccaaggaactccccctccaggctcctctttcctcacacacggacagccacccaaacagagcacaagggcccacacagcctggctcccacgacagaacacgacggcagcgcacgcgacgcgcacggcgccccgcccctcagacctcaacccaaacaccccacccaaagcactcaaacgcactcgcacaccccaaaacaaggtcaccaccacactggctacaacaacccaccggaaccgcgacaaccccaccaccccccccaagcaccccgccaacctcagcgaaaccgcgcgcaacccaagcacctaccatgcaaccccccgcgaaaggcacaccacagaccgcacaagcaccaggaaccaatggcgccaacaccgaaccgacatcgaacacaccgacccaacgagacctgccacgccgcaagccctcgaacaccaacatcaaaagcaaacaaacacccacgacgacacaccacacaacacgcccccaccca

SEQ ID NO: 518171 - DNA, 514 bp, Homo sapiens
agaagagatgaagaggaataatcttccagaaacagcagttattggatctatctgtggacattataatgagcgctgttgagtagaacaatgaaggaagaacttgttgcatgagcaggctctgacagcacctgaagcaatatgctcccctgcatggccgtgtacagctcccaaggccagtcatagctgatcctcctccagaaggttcaggaatactgctacgactacatccatttcatgaaagcctttcagaagattcgtggttctcttttataaagctgatgttctgagccactaagcactactgaaatggtataaggaagcacatgttgctaaaggcaaaagtgtttttcttgaccagataaagaaattagttgagtggttacaaaatgcataagaagaatccgaatcgtaaaggtgaggaaaatcaaatagctcaaccatagcactatagctaggttaccacacaccactttttgattgggaatgctgaaccatttgagaagagcaacttggc

SEQ ID NO: 518172 - DNA, 165 bp, Homo sapiens
tggccaaaaaaaatttgggtcccggaaaagcttgcaaaatgattcctggcactggggggggattgtttgaaaaaaggagaagaaaaattttacccctttttacataaaggaaaaagggtgaaaaaaagggaattgcccaaaaaaaataaagaacttaaacctccc

SEQ ID NO: 518173 - DNA, 846 bp, Homo sapiens
ctggagataatgtgttcatcctttctcggttacagctgtgctaattaaagcacccagcacattagcagggctcatcactggtagatgtaatgatgggtctctatgccccaggtactgggagaaacctacagtacgttttaccaactcattaaggagattttttttggcgaacagattgtttggacgattcggtaaagaatgacaaagaatgattacagcatcataatcgaagtgattaatatgctgtcgtcgtttgctcccgtgcgctgactgttccacattgcagcgattcagtacaggagggattcaacgtgtgcatacttgaaacaattcagccacctctgatgttcaccattctgcatgagtaaactggtgtgagtgagcggatgaacttgcaaagaagcatgacctgggccccgcgactgagccctgacccagtgtacagaatgacctgagttatctggtacactgaggctctgggctcagacttccatttgaggtgtagagctggatgggggtgtgctcgagctccctggagagaggaagatagacatgcccttcctgtgggcatgccccagggtctaggggatccaacacttgaatggtgatagagagcataggcctcccgatagtaatgttctcctcaatgtctagcggcaatggtccaggtcaaagcccgaatcctggtctggatcattacaatgtcttcgaagttgctgtgcttgctgctcaggcgccaagcctccaaggcatctgtaattctgaattcactttggtcattcttcccagctaggcttgatgcatgctcccatgtcctatggggaagtcccattctttaggggcacg

SEQ ID NO: 518174 - DNA, 396 bp, Homo sapiens
cctatacacacacgacggcctctagccggaaggcacacacccgagacaagcgaaggaacagaattcccacgggaacacacgcccaacaatgcctgggctccagacagccattctgattccacaagacagggtaggactcatgaagtgctgggtggcggtctttttaagagatttagaaccagagatccaccccatcccagtctactcaacacaaaaactcacaaatctctcctttcccaccaaaccccagccagaatggggctcctttccctctgagttcctgtagtgttagatttatggtttctttcggctctctagtcaagaatcagactctgttcccagagttcccacctcctcctgcaggccatgcacctagtactaagtgagcagtcagta

SEQ ID NO: 518175 - DNA, 933 bp, Homo sapiens
ctacggtcccgacccgcgggcgatggcggggtacctgggctgggatccgtgagcaagcgggcgagggcagcgccctaatcaggcccggagcgatggcagccttgatgaccccgggaaccggggccccacccgcgcctggtgacttctccggggaagggagccaggacttcccgacccttcgctcagagcccatagcagctcccggtagctgatcctgcatgaagcgagacggaggccgccttgagcgaagcggacatcaggggcttcgtggccgctgtggtgaatgggatgctgcgctagggcgctaccgtatcggggccttgctgtatggtcatccgacttcggggtcagtggcactctggagtgagacctcgtgtgctgacccatggtccctgggctcacgtcgggcacagtcgcgctggccgtggtccagtaggcctggctgctcgagcgacgcgttgtgtgacacagcattccgacagggtgggtgtgtggtagacgacaggtctacggctgggtgcctcgcgaccctgcccttgggcgtgcattgtggcctgcagaggtgccgaatgatcacgcggacgtggtctgggagcacacaagtgaggcacccttggagtaagctgggagtcatattccgtggattcaactgtcgagtccagagcccagagcagtatgcagagtgctgctggacctatgcgggctgctgtatcgtgggtcggagtgagcagctggttcctgcggacggaatcctatatgctggccagagatgtgacagccatccgtggcacggcctgccacgtctgtcacagactccattctcagtacagaaacgtcggtggaggggcctgtccggtctggtggtggacgttaagttcggagggggccgccggattccccaacgaggagctggcccgggagctgggaaagacg

SEQ ID NO: 518176 - DNA, 104 bp, Homo sapiens
taccacttaaagaggaccagagcttctgccctactgtcaaccttcacaaattgtggactttgctccaagaaacagacatgggtgaatgcgtccgtcgaacttgc

SEQ ID NO: 518177 - DNA, 152 bp, Homo sapiens
tgtttacatggctgaatagtacacctattgtgttacaagaccatattttctccacccactcatccgctgacagacgacaggggttagttgacctatcttggttatatgtgtgactcatggctgcacgtgaaccattaaaggtgcagggtatc

SEQ ID NO: 518178 - DNA, 783 bp, Homo sapiens
gtctgggcaccttcctgggctggcaagctggctgcctcctgcatcagccactgcccttcctgtgttcccgagccaccagacacagctctgagaagctcctggcatgcttctgtgtgccactggctcgaatctgggcaggaaggcaaggccgcagaagtatctggtgacaagaaggaaaccccagagcctcagagaccatcttctcagtggacaaaattaagggccgaggaggggaggggcgtgctggaagtctatgggactgcatctttctgaggcccaggagcagccattccccacacctgtaagcccgaaaatgagccacagtaggcatagctgtaccccagcgaacactagtgcccccagccctactgtatttccgttcctatcaataacaatgggatgactcggagacaggtttcaatctgaaagtcgtcctggtcagtttcaagcgagtgtctcgatgagaaggaagaggtcttgctggatcgccctactttgccagctgggaagggcctggtcaggtttctggtaacagctctggggcaccgatcttctcattcatctccgaaggacgtggtctccaagctgcaggagtcatggagcgcctctaggggctggccccgcatgagcgagcgactaccgcagtcctgcaatgccagtggtggcccgacgagctgagcaaccggcgtggtggacctggagcgccgttccaccacccggagtctggctgccggaggtgctgcgccctgaccggcctgcactggctgagctgttcctggaggg

SEQ ID NO: 518179 - DNA, 89 bp, Homo sapiens
cgcgccacaacagcacaggtattttgaaagcgaaaataaggttttcttgttttccccgtttctggtacataaatggataagaattccgc

SEQ ID NO: 518180 - DNA, 120 bp, Homo sapiens
gagccaggagtagatgctgcagtgagcatcgtaccactgcactccggcctggacaacagagtgagaccctgtcccccaaccccacaagagatgggatcctactctagggactattctgta

SEQ ID NO: 518181 - DNA, 715 bp, Homo sapiens
  misc_feature (9)..(9): n is a, c, g, or t
  misc_feature (125)..(125): n is a, c, g, or t
  misc_feature (211)..(211): n is a, c, g, or t
  misc_feature (218)..(218): n is a, c, g, or t
  misc_feature (287)..(287): n is a, c, g, or t
attggactngggaggcgcggtgaggagtcaggcttaaaacttgttggaggggagtaaccagcctgctcctctcgctctcctcctcgtctgcgccgcgttcagaggtgcccatcagcctgtgattnattttatatctgctttttataaagagagaaatatatatatatatatatttttttttttttcttcttaagagaaaattcctgtccangagaaantaaggcaacatcaatgagggagagaagagccagccagaaattatccagcaaatctatcagggatcctantcagaacgtgaaatgcaagatagtggtggggggaagacaggccgggggggaaaactcgggcgcgtgccccgtgtctgcgccagggagtgctccccgagaatacgttcctacagggtggagaatacacggcagtttggaaatcgacacacaaagaatagagtggagcctgtgggacactccgggttctccttactatgacaatgtccgccccctcttttaccctgattcggatgctggctgatgggctgtgacatcagttagaccagagaccctggacggggtcctccaaaagtggacaggggaaatccgggaattgggcccaaataccaaaaggctctgggcggctgcaagtctgatcgggggacagatggttacgtacatagtagagtcctacaaatcacaggaagaacccagggtcctaggaccgg

SEQ ID NO: 518182 - DNA, 767 bp, Homo sapiens
  misc_feature (521)..(521): n is a, c, g, or t
  misc_feature (683)..(683): n is a, c, g, or t
gaatagtatccgtagtccttgcagttgcgagcttcgtcacgggggtgtgccttcaaaaagcggcgaaccgaaacactcgcggcgtcccatcggcgcctctctccggtggatctgggtaaggggacggttccctctgggacgccaagagtattgtagtgttccttgctatgtattgatcctagggagggcccatcacaggtcatgcattgcctcatatgtgccactctggctgcgcttcgttgtacgtagggctgggcccttggcgtagcctcacacagccaggcggtgacgccgtagccgataggattgcaagccatctacacacgcgtggaactaatataatagtggagcgtcgctcgtgtactgtcagctttcacctcccaattcgcttggcagatcctgggacacccgtcgtggtcctctgccaatgcagagcagtgcaatccagagctcgttgagcagacttcgactgagaccggagtagaccagttgcaatatgcgtactgacgacaagacacagnctgaagtgacatagcacggcgcacatatcgtgacctgtacacagggatgtctatgtactgtagctatgttccccctaggagcacagaaagaaccctggcgggcattttatacaccctggggcatgtctacatatgcgttgtgaggtggattgcaaattcccntcctatttcatatgtaccaaatatcttctggaccatacagtgccggattgatccgcgcagggtggctcatggctgcaaagctaa

SEQ ID NO: 518183 - DNA, 1027 bp, Homo sapiens
gcaagatgtcgaagcgaggacgtggtgggtcctctggtgcgaagatcccggatttccattgggtcttccggtaggagctgtaagatcaatgtgtagctgacaagcacagggagccaaaagaacctgtatatcatctccgtgaaggggatcagagggactggctgacatcagacttcccgctgtctggtgtgcagtgaccatggtgagtggcccacagtcagagaaagggcaacaatcaggaggctcaggaaaaaaacagggtacatccatgcagctgggtcatttcgacaaccgacagggtcatactcggtggacaaatcactggccgctgtgtctttgacttcttgacacgagtaactgcagcgagtcaatagtggaagcagatagaagggagactgacgagggttgctggacattagcgggaccagtagtcaaaaggagtgtgcatgacctttgtcgtgcgctgcggacttgcactccaaatagctaggcaaggcagtcttgcaatcggacgttctcctaggtactatgttgtaagcacacatagaagaataaaacataaaagtgcagtgagcgaatggaaaacatcgacaaacctctcagggagtgcctgtggaggggttgggggagcaacacagggggcaagtggaagcgggagcaagggcgaagaaggggggccaccggtggcgcgacatggtgaggcaaaagcagctgggaaacactgcgccagagggcgcttaataagcgaccgggtattaaaccgtgcaataggaggcggggtactcctgcttggatgacttcggagacaccgccatgcgggaagacccaccgcaaaggagtcccggtcattgggttccatggaggacacgggtgtagccgtgggttcttggggacccggggacaagtggctcgtacttcgcaagcacactgacacgtgatcaagggagcgcgcgtggctgcggcgagccttggttaatcagggaaacgataggcacactgacacaagcaaaagaacacaggagaccaa

SEQ ID NO: 518184 - DNA, 845 bp, Homo sapiens
cgaaggacggaggcaccgaaggacggacgcccccggcacacgcagacgcacagagctcggcgcggcccccgtcgcatacacactggcacagacacaagcagggacacacgcagacacacgcacactcgcgcgcgcatcctcccgccagcctgcccgcctgctcgccggcgcccggagcccgctctggccgcgtggatgatctgaagctgccctctcgtccttcatttatatcaccagcttgctttattgctgagaaagcttcctgccctggaagatggcacccttccccatccagacaccgttggggaatgaattatgagggagccaggatgtgagagagagaaccacgctgctgatgactccgagggaggggccctggacatgtgctgcagtgagaggctaccgggtctcccccagccgatagtgatggaggcactggacgaggctgaagggctccaggactcacagagagagattgccgcacaccctcctccctacgccgagcctcagatccagctcagaagccaccaactcgaggcgcttgggagccactcgctcactgtcaaggagcaagcctgtgcctgttcgctgcctcacagtgtcctgcgttgcctgtggggtgctctggttcaggcggatatggccacatctgggtcgacagaactgccaactaactcgatctccatcttttgcctgacgctcctgaaacagctggaaaccccaaagcactggcttgaactctggagacgtggatatgtacccaggtactgatgctggctcttatcttgtaccttgtgccctggtcctcggtaccaccctggtgttgacccttcttgtgggacacc

SEQ ID NO: 518185 - DNA, 324 bp, Homo sapiens
cgccagcatgaatatgcatacagcagtctaacatacaggatcaaaaaggtaaggacagggtgacttggagtcagttggagtcagccccagtttattcatctataaaacaagattaaaagtaaggctgggccaagagcgactacaggccggtcagtcgctctgggctatatggtattttcccctttccaggacgggaatgattggtctaatgatctcgggtgtctggatgggacaggggtgtatagaagctcagtcgtggtgccagaatggctcattgtggccagggttccattgcttctaggccctccaagagcgacggacagg

SEQ ID NO: 518186 - DNA, 101 bp, Homo sapiens
agcccattgatagtactgtgtccaacagctgaaggaatttgaggggaaaactttagttgtcagtcaccaaagaaggcctggactttccgtatggatgcaaa

SEQ ID NO: 518187 - DNA, 262 bp, Homo sapiens
gaaccccgtgaaagcacaccccattgctcacggtcaccttctatcatcgtctctccagtcatttgggttgtgtggggaccattctctattagattcttcacaaagtgctcatataatcagtagcgcttgagttgtgtttataacagttgtttcgccacttgtatactttaaatttagtggttctgactggatataaagtccttgactcacattttcaatattgtttgcctaaaggccagatgcaattgtctcttcttttctt

SEQ ID NO: 518188 - DNA, 450 bp, Homo sapiens
gattaagtgactttttagatgttcttgtagttctttgtatagacctctctcaaaactgtcatatgacattaaattgtctattttatttgtgtgtttgcccctttacactgtgaacttcttaatggcagggaccattttttatttatttttgtgtcttcaaaacctggcacacactagatgctctataaagatttgttaaattatttctatagttatttattttaatcctacacagaatgtataaaaataatttactatattgttagtgaagaagattgtatcaaaatgcagtatacaatccttaaggtatgtgggatgcttgatagtaatacaaatgtatgaataattgttccagtcttctccaaacctgtaagagggaaataggaaaataaaaatgttttgttttattgttttgaactcttgaaaataaacttaacctcaaaaatatca

SEQ ID NO: 518189 - DNA, 821 bp, Homo sapiens
  misc_feature (430)..(430): n is a, c, g, or t
  misc_feature (476)..(476): n is a, c, g, or t
  misc_feature (485)..(485): n is a, c, g, or t
  misc_feature (622)..(622): n is a, c, g, or t
  misc_feature (683)..(683): n is a, c, g, or t
  misc_feature (690)..(690): n is a, c, g, or t
  misc_feature (703)..(703): n is a, c, g, or t
  misc_feature (757)..(757): n is a, c, g, or t
  misc_feature (795)..(795): n is a, c, g, or t
ggcggaactctgaggtggtccattatggttgacatgcacaatctggtaaaaagattggagagggcagtgtggccggcttggaggcagtatctcatactctctgacatgcaccgtgaggtatgcagacagtccttcaaaagcaggatgcagtctccaatatgtgtgaggcactttgagcgtcgcgtagacgttgtctggtccgtgatggcagagttacttgtaatgatcatgatatagtagattgggtggagcacgtgtcacgaccatcatgcggtatgatgtgtccaacactaggttttgacactttcggaggctgatgctcattttatgggttacagtccttcctcgaatgctcaaacgaggcgcagtgcagacatagagtaagtctatatatccagactatgtggattgagacactcactaatcatcncagtaagggccatcagtccatacaaggaaaaggtgtgaataacacntgtgttcgngtgcacgtaaggaaaacccaggaagactaagctgaatggttgtgcagtggagatcacctctgtcggagacgtgtccagtcgaacatagttatcactagtgtcgccttgtgtgccctggggattgggctaatagtgcnttcgccgcaaggctcgtcgagcctcgttcatcggatgaaaggcaaggagtgtatactaganttgccgngggcccattgctnttttactaacaaaagagcggctgacgtatctcctccgataggaggttaccaaanggaagtagtagtgactcaaagaaccggccactagtatngccatggggggtccaatatgcttata

SEQ ID NO: 518190 - DNA, 180 bp, Homo sapiens
atcgtcgggcacgtcgacgtcgtatccggcctttgcgagcgccccgagggtgcgatggagcgaggcaaagacggaaaggaacgcggcggtcccgacatttcccgagttcggcggaaaattgaacagcacgatggccaacttgcggttcttgcgctcgctccttcgtagctgaaccggctt

SEQ ID NO: 518191 - DNA, 315 bp, Homo sapiens
gctgcttgaggatccaacacatagcacatgcagtgagagaagagtagaatgttagtgagccggtgttgtgagtgtaattagtgcatagtaggggaagggagcactaggttgataggagatttgctggtcagggcgtctgctgttgctcatcgggtgatatagcaggtgggataagtgtgtttcgaagaagatataaaatatgattagttctgtggctgtgaattgttataattaaggagatttgtagggagattagtatagagaggtagagtttttttcgtgatagtggttcactggataagtggcgttggcttg

SEQ ID NO: 518192 - DNA, 493 bp, Homo sapiens
aggtgcaataataaaagcaataatgataatgtgggtagctattccttctcatatattcgccctttgccaggcctggttctaagtgacagtaaaaggccaggccagaattccagctcagatcttattccttactttttatcacctcacctgtaaggttttaacaggtgtaggatttcagcaataagaataatttgatgttaaacaaagaattcatgacatagaaggacaaaaaaaaaatcctatccttttcccctaggactaaggtgaccgccatgatgaaagaccagattctcatgaagaaaccgtttgtgaaggattttgatcaggcaacatgggcatgcaggtttaaacacagcccccagccttccatgcctggcaagccactttctcctatgttcatgcatgtctagatttctcaatgaaaaacgtagttgaactcatgaaagcctatctttaaaaaatattaaatagctaatcttataaacccctaaaa

SEQ ID NO: 518193 - DNA, 324 bp, Homo sapiens
atactgagtgtttttggaagagtccttgttcctgatgctgggcatttctggaagaggcctttttcactggggcctccctaagcatgggactaaggtgaccgccatgatgaaagaccagattctcatgaagaaaccgtttgtgaaggattttgatcaggcaacatgggcatgcaggtttaaacacagcccccagccttccatgcctggcaagccactttctcctatgttcatgcatgtctagatttctcaatgaaaaacgtagttgaactcatgaaagcctatctttaaaaaatattaaatagctaatcttataaacccctaaaa

SEQ ID NO: 518194 - DNA, 175 bp, Homo sapiens
gcacgagtagaaatggaaaggtgatctgcactgtatcttgggtcttgcggctatgcttcctttgatgacatatattatacagtatatatatacatatattccttttgctagagttctagccattttatttctccgcagggctcctttctcaaacattactgcatgctgtatatgg

SEQ ID NO: 518195 - DNA, 413 bp, Homo sapiens
agtacaggagtatgtgtctcccctgcatgcatcatgcttccagtaagaaatggagatcatctagtgctcttactttcatatcctttcactcatactcagttgggtatgggaggctaagaagagaagtagaaaggggaagtgatcatacttacaggggttcagtttcataatgggtagaagtccctatttttcctccatttctacaataacaaaatactatacatttcaacatctcacattgttgttctttgcccagcatgcaaaaaagctaaaaactcaatttgcaaggttaccatacttttaaaacccaggagggttctccccaaaattttgctgattaccatgtccccccacagtaagaaattgtgtcctcactccagaacaggctttccttacttatttgtttacatatt

SEQ ID NO: 518196 - DNA, 718 bp, Homo sapiens
agcggagtcttgacccatgaaccaaggatggccgccatcactcacagtctatgctgttatctggtgctgaaaaagctactggagaaaatgaagaggaatcagaaacagcaacaataattagatggaagtaagcagggaagattttctaagtgaagttgcaaatcgtaaatggattgcagaagtctcctagaatagtatttgtggggaggaaatctgaggatataaccacgtgtcattaccagaaatagcacctgataacgcaaatataatggactgcatggacgaactcaggcagttgtatacaaatgagtatggtggccagagataatgcgaagatctgggaggaggagagagaatgacaggattggaactaagagagggagttagaaagttcaggacatgcctgagatatgtcgaagaatcactctggaactattaagaagaaattctatgagggaatgtcagagaaggcaggtctgaatatgcaatttcatggaaagcgtacgttctgtcagaaagcatatgcttacgcagatgcacgatgccggacgcccatctaatgactgtgtgctcatactatgacatcgaaggtgtacggttcccctgctgactctgtgggtagttagtaacttcattgggagaagacctggatgaccgtcctaggataccctgggacctaaactctaagacgttggcagacatcagcctaggacaagac

SEQ ID NO: 518197 - DNA, 242 bp, Homo sapiens
  misc_feature (214)..(214): n is a, c, g, or t
ggaacagctattgccagaaatttccatttaagtgccaaatacattcaaatttcatggccttaaatatctggttctcatctgtaatcccaacactttgggaggctaaggcgggtggatcacctgaggtcaggagttcaagaccagccgaccaacgtaatgaaacccttcatctttctttataaaaaaatgtcaggccgggcacagtggctcacgnctgtaatcccagcactttgggaggccga

SEQ ID NO: 518198 - DNA, 327 bp, Homo sapiens
tttgtttttttagacgtacggacaatgtgtcaaccagtcaggagtgtagtggcataatcttggctcactgcaacttccgcctcccgggttcaagcaattctctgcctcagcctcccgagtagctgggaccacaggcacccgccaccagagctggccaatttttttgtttttcgtatttttattagaggcagggtatcaccatcttggccaggctagtcttgaactctggacctcctgatccacccgcctcagcctcccaaagtgctgggattacaggcgtgacgaccaattacctggcctgaaaagtttttaaccaaaacgtcgacg

SEQ ID NO: 518199 - DNA, 124 bp, Homo sapiens
taagggaataccgtgctaggtgctctcctggtatgtcacagcggttcagcaaagaccactggtcacttgtatcaactgccccgtgtttgagggtaggtgcaccctgacctgcgcttctacagca

SEQ ID NO: 518200 - DNA, 100 bp, Homo sapiens
aaattccttataatggctgcatccctcccttggttcaaagaggcttccacccccagcctttttttcttcttggaagatggtggcatttgaaggagtttgc

SEQ ID NO: 518201 - DNA, 1947 bp, Homo sapiens
  misc_feature (620)..(620): n is a, c, g, or t
  misc_feature (1160)..(1160): n is a, c, g, or t
actagttctagatcgcgagcggccgccctatttttttatgtgtttattttttattttttttccccaggagacattttaatacaatgggaaacacagaggtggggcgaatccgacatcaagtccgacaagaatgtgtggtacacaaatatccaagaggcgccgcggtggagagaggacctctggtgggaggagaaagcgggaggaaccacgcggtgggcccctgtcgggaacagagaggaagaggaaagacccccaccaccgcgcgtcattacaacagaagagacagagcgagacgctcgggtggcgacggggatatacaccgcgtgtgtgcacgcgcgtgggcacccacacaacctcccacactcaggtggggcgagacaaagaaagaggtctcttctaagagagacaactatgacacaaagacgtgagcaacacacagcggggagacgacaccacatcaagcgccccacccacaagagagacgcgagggtgtagcgccctagtcgcgacgagtgtgctatataagagggacgagcagcccacttgttgtgtagtgggacgccacaccgtgagatgatcagcacgcactacacacaggccactcactctctcgcacgaangctctcccatagcgccccaataaggggaggtggagggggagagaagagcgacaccagaagagggggcacacataaaaacaaccaacaagaaaacatcatacacacctctacaataaaaacaacaccccctataacacaacacaaccaccacaactcataacaaataaacaacgaagagagttgacaaaataaaaaaaacttcgcacaacaaaaaacaggagggaaaaatcaagtgtggagaacaaaacagatgtgtactcacagtgggggagaatgggcggacgacgcataggaacacacaccaactaaagatgttgaagaacaggggggcggaaaaaaaagaagggcggacgctctaccatcaaccacaccactagtacaggagggaggaatcaaacacacaaaaatatacacacaatcgttacagaggggaaacaacaaaaacaagaataaaagaacaaacaaaaacaacaaccacggtgttgcagcaccaattaaaacacaaaacatctactaatagcacatcgatcgggtgagcancataactctaccccagacaaagggtcgtcatcaacacacgacgcgatgaagacagcggaaaaaaaatcaatcaatatgcagcgcagaacaatgcatcagatgggtgggagacgccaactacaaccaaatatcaagaacacaaaacagatgcgtgaggacagccatcatatatcactcaagcatcctagtaaaaacaaaacgcagtaatcaataatagacagcacaacaagatacaaccacggcggtgacaaaaacaaagcagcgacgtgagcaactacagcaggaacacctaacacggagatacgacacacacgccccctctattagtggggcgcaccaaagcagagcgacgtatcaaacacaagacagacgaagcacatatcacaacacgaaagaaacaccatctcgcaacaagcagagagataaggaggacaacgaatcatatatgagaggaaaaaacactggctccctcagcggaacgaaccaggcgcacagtagaggatagtgtgcacgcaggaggcacaccacctaggagtgggagggaccagcgacctactaagaagaagacgagtagatgagagagaacccacctcaaaactagttagacacatgaggaagacaaagggcaaaccaaaatgatgaccacaaatagtagaagaagacacacccaataagtaagagagagaaagaagcaccgacggaggtaagatgaagcaaactcacaaactaagcaacagcataagagtaacagagaacgtagagcaaaaaaggacaatcaatacgcacg

SEQ ID NO: 518202 - DNA, 595 bp, Homo sapiens
  misc_feature (516)..(516): n is a, c, g, or t
ggacagtttcgactgttctagaaacctatggggtactggcacactggtgagctgctctagagcctgcgagccatgtaggcgatgtgcgatggattgatgtcgacgggaacctacccactttggtgaaaccaaaagtgactgccatgggcactccttgtcatgacagggattggacattattgagtacttatactcaatggcctgacaacatacgcacttttatgcccacggacttcttgtatgtgctgcaaagtgtcaagcagcgtttacaggatgcacccatgttggtgatactacttgcagtctgtcgctaacgatctgtgaacacacggacccaggtatttggttgcatgagctactgagacgcaagtgtgtcctgctgcagaaacttggggagagagattctgcactaagatgtgaatgcagtctgaacccaagattcctcccactagagttagcacatgcttgcaagttagcgacctagcttaccatagaccacaccagtatgctcacgtngtagagcagatcttatacgttgtggcacgagcaggcctttccttagactacactgtgggtaactgatggtgggaactcg

SEQ ID NO: 518203 - DNA, 384 bp, Homo sapiens
gcccaggtttgcagaacaatacggcggtctcagctcactgcaaactccacctcctaggttcaaccgattctccttcctcagcctctcaagtagccggattacaggcacccaccaccatgcccagctaattttggtattattagtagagacagggtttggccatgtgggccaggcgggtctcgaactcctgacgcccacctccacctccctgagatagctgggattacgggcacacgccaccatgcccggctaatttggtattttaagtagagatgcggtttctccatgtgggccaggctagtcttgaactactgacctcaagtgatctgcccgctcagcctcccaaagcgctgggataacaggcatgagccaccgaacccgatc

SEQ ID NO: 518204 - DNA, 136 bp, Homo sapiens
  misc_feature (72)..(72): n is a, c, g, or t
  misc_feature (74)..(74): n is a, c, g, or t
  misc_feature (92)..(92): n is a, c, g, or t
ggcgtaaagccgctttccctcaagagtaacttacaatctttccatgcacaagatgattaatacagatctttngnaggatcttgaaaagcccngagatctcaaagaggcccttcgagcaccacgcaaggagattcat

SEQ ID NO: 518205 - DNA, 126 bp, Homo sapiens
aacgtatctgtgtcgctgcaggtctgtcgccggcttgtgtgtgtgtgtgtgtgtgctgtgtgtgtgtgtgtgtgtcccagcgcgctccctcatgtgtctgtactctcttgtgtctttcgttgctct

SEQ ID NO: 518206 - DNA, 116 bp, Homo sapiens
gagcagattcctcatggtcatggggggccaccgttgttatgtacctgcatcacgttgggtggtttccatttagaccgaggccggttcagaacttcccaaatgatggtcctcctccc

SEQ ID NO: 518207 - DNA, 931 bp, Homo sapiens
  misc_feature (142)..(142): n is a, c, g, or t
ccagcctcggttcctcccccccgagttattccccaaggggtcgcatcttacagtggaccgaaaaccccgggtccgtcaaaatagggcccttcttcataatactacagccctcctttacaggctccttggtcccccccattanggagccccttctcccaaaacgctccaacccccgaggttttaaagaccgacgtccgctcaccttttaccaaatcaaaagcgccaggttgtggaaccaaaccctggacataatttttctagggggcaacagcggcctcgatagctccacacacagcacacaatggcgccccagagacttcaaagagcgatctccatctggctctttccaagattaatcgaaagtccaattcccctccatcatgaatcgcccctgtctcgctcattcaaatacgacgaattcccgccccctttctaaagattgatcagcaaattgtgggaccgttattgatcctccacatcgtacgaaccacgaacatctcgagtgaactcaccttctatccgcgccccgtgccttctaaatacttcgtcccaaccaaactccactcccacgaacttgggtatatacaccacgaaagacacaccgtcctcgcttttaccccaccacagcccaaattatcacgttcgtcacgaacgctcgttgtgccacgcaaaggtaagagccactaaatatccctagcaccagccacacgtacgggagaaccactgaccacgtatatccctatgccagttctaggaaaccacaccacgatttttgggggagaaataaaatatttacggatatcttgcgataaaggtcatcatatatgttttgtacagtatgctgcaattccctcttttcaagccccccatttttttttttgaacccacggctaacaaaaattacaaaaaaaaacccccttgttaatgtcgg

SEQ ID NO: 518208 - DNA, 979 bp, Homo sapiens
tgctgagcagtgtgtctctcctgtacacatatctgaagagcatgggatgcacgaatgcttggataaaggatgtgtgagcacatgtcaatcatgtgtcaggatagtcaaaaggaggattgagccaggatcacatcacgaatggaggcaagggtatgacctccaatgggctcataagtctaccagagtgaatacttggcagccgatagaacctgtgatcactgacacagtgcagtggggtctaaacaactagatctgatcatacaattattccttgaacaatcacttggcaagacgattggttattcatgttgtgcttttaatctacagatatgctttgcatttacatacctggggcaacatgtggcactaatgtatatcgcccattatgtgtgagcagaacttagttcttgctcccttccccccatcttgttgcaactaggggactaatgtggtggaagcaacttggcttattttgtcccagtgcttagtgtctcctgtcctaatgtgtggtcctgcctgtccgtgttgttcatgtcggcgtaccggcggtttccgattccgactggctggcgtattatatcgttgactgctaaccttctgcatgtcctctgtgtggactgtgggagcgtgcttatgtccctgtttttagagacaaatgattgctccattttcgagttcccggtgtttcggtgtaccctctctagctgggagtactcttaggttcgccttgcacttttatcactttctgggtcggtcctctgttacccgacgttatgccatttacttgcccatggaccgtgatttgtttacacctggggccggcctagtctaaacggcatttggccccgacgtgtggccgtcgcacaggggcgcccagcacgggcacaagttcccttctcgaagttactctacccactgtgggggagggcggaggacaccccccataggtcttggaagtggcgcgcacgtctcacagccc

SEQ ID NO: 518209 - DNA, 286 bp, Homo sapiens
ttcttggccagtctgttgtacacgggctctagctgcttgcagagcccgcaccatggcgcgcagaactcgatgaggacgcccttattggggggcatcacaatggagtcaaagcaatttcccaccacgaccttgacgcgacccttgttgatcttgggcactggctgagattagatgactgacttcagttgtcctgttttgaaagcagtgacaaactcgcggagggcgacagagacaaactactctggctccatggcgaacttcttaccactcccgtaccaagggtacc

SEQ ID NO: 518210 - DNA, 339 bp, Homo sapiens
acagaagggagggggcttacctaaaacaaaccctcagttacacaaacaaaaataagcggcgcttggtgctgcctagagacatacccacagcggcgtaagataaggggagatgtacagacagtcttggctggataagagacagttactcaagagtgctacagcagatgagaggagtttcttaaaaacagctttggaatgcactgtaaaaacgggcaatccactgtggactcccactctcgtgctgcagaagagctttcttctttcgcgttactaacactttggctccaagccaacctcacccgtgtgtccactacgtccttaacttttctggggttgtga

SEQ ID NO: 518211 - DNA, 250 bp, Homo sapiens
gggggtcccttttaaacccccccctccccccccccacccttttttttagaaacccctatagggtccccccccccaatggtctgtcttgggtcctgggacccccccgtttttttttttgtttagcccggcccccaagggcccgggggaaaatttttttgggccgggggttgatttttgggggaactttgttttaaggggacctccccccccccctgcccggttttgttttttttaaacctttgttttttta

SEQ ID NO: 518212 - DNA, 207 bp, Homo sapiens
tagaacctaccaggctagagccagaatttggacccctgtctgtttcaaaacctttgtcccagaacaccagtgttcttcaattccagataaaattgcttgcagagaccacacctatggaatcaggatctccaggaatcaggggtttttgtttgttttgtggttgttgttgttgttgttgttgttgttgttgttgttaggtctacctgg

SEQ ID NO: 518213 - DNA, 359 bp, Homo sapiens
  misc_feature (52)..(52): n is a, c, g, or t
ccagttcttcatcatgaagtcaagaagctggtagatggaagcatgtggtgtntggaagtctagagggcatggaggtggtgcggaaggtggagagcacaagaaagacagccgggataaaccccttgaaggatgtgatcatcggagactggggcaagatcgaggtggagaagccctttggcatctgcaaggagtagggcacagggacatctttctttgagtgaccgtctgtgcaggccctgtagtccggcacagggctctgagctgcactggccccggtgcttggcatcttggtggagcggacccactcccctcacattccacaggtccatgggactcacgttctgtaacaaactcctagc

SEQ ID NO: 518214 - DNA, 561 bp, Homo sapiens
  misc_feature (168)..(168): n is a, c, g, or t
  misc_feature (274)..(274): n is a, c, g, or t
  misc_feature (276)..(276): n is a, c, g, or t
  misc_feature (343)..(343): n is a, c, g, or t
  misc_feature (348)..(348): n is a, c, g, or t
  misc_feature (364)..(364): n is a, c, g, or t
  misc_feature (367)..(367): n is a, c, g, or t
  misc_feature (371)..(371): n is a, c, g, or t
  misc_feature (376)..(376): n is a, c, g, or t
  misc_feature (379)..(379): n is a, c, g, or t
  misc_feature (384)..(384): n is a, c, g, or t
  misc_feature (427)..(427): n is a, c, g, or t
  misc_feature (451)..(451): n is a, c, g, or t
  misc_feature (458)..(458): n is a, c, g, or t
  misc_feature (507)..(507): n is a, c, g, or t
  misc_feature (516)..(516): n is a, c, g, or t
  misc_feature (536)..(536): n is a, c, g, or t
attgcgatccgtgttgcctcacccaaactggttatggaagaggctcctgagtcctataagaatgtgacagatgtggtaaatacctgccatgatgctggaatcagcaagaaagccattaaactgagcccaattgctgtgatcaaaggatagacccttggacagcagggntgcctgaccccaccaaccctttttgaagtggaagtggactgacatgctcttttgacgtcagactcaaggcgggacaagttgcaaagtgtgcagctgtaactgctcncnccaaaatggctgatggggaggctgctgctttcaggggcccgggcttgtaaaatacccttccaggaanaggcncattgcccccctttgnaangggnggaanatnccttncccttggttgttccccagagttttaggaaaatctgttagggangggtagatgtcaaactcccttacncagtcanactgatctttagccatcagattgatttttttccccccaagctctgtttncattccganaggggtcatgaaaaaagttntgttcaataaggttttggaatgtta

SEQ ID NO: 518215 - DNA, 183 bp, Homo sapiens
  misc_feature (100)..(100): n is a, c, g, or t
  misc_feature (103)..(103): n is a, c, g, or t
  misc_feature (175)..(175): n is a, c, g, or t
  misc_feature (177)..(177): n is a, c, g, or t
atccgcctgcctcagcctcccaaagcgctgggattacagatgtgagccaccgtgcccggccacaagtgttatatcttaacgagtgatctttcttgtgatnatntagtaagtagctcaggcgacatttatgcatttaatgttctttaaaatctttgttaataatgtaggttgttgngnttttcc

SEQ ID NO: 518216 - DNA, 176 bp, Homo sapiens
cagccaacaggattgtcgcccgccatcaggattggctgctgttggtcaagagtctatggggttgtggttgtggtaaactttaatagttaggaagctgaataatttatgaaggagaggggtcaggattgattcgggaggatcctgttggctggcgacaatccttttggctggcgaca

SEQ ID NO: 518217 - DNA, 128 bp, Homo sapiens
gacccgatctctatggtcgtcttatgtgtgtatggttatcattgtttgaggttagttgattagtcatagtggggtggtgattagtcggttgctgatgagatatatggaggtggggatcaatagagggg

SEQ ID NO: 518218 - DNA, 991 bp, Homo sapiens
  misc_feature (453)..(453): n is a, c, g, or t
  misc_feature (516)..(516): n is a, c, g, or t
  misc_feature (529)..(529): n is a, c, g, or t
  misc_feature (567)..(567): n is a, c, g, or t
  misc_feature (611)..(611): n is a, c, g, or t
  misc_feature (621)..(621): n is a, c, g, or t
  misc_feature (655)..(655): n is a, c, g, or t
  misc_feature (683)..(683): n is a, c, g, or t
  misc_feature (697)..(697): n is a, c, g, or t
  misc_feature (701)..(701): n is a, c, g, or t
  misc_feature (738)..(738): n is a, c, g, or t
  misc_feature (764)..(764): n is a, c, g, or t
  misc_feature (770)..(770): n is a, c, g, or t
  misc_feature (774)..(774): n is a, c, g, or t
  misc_feature (777)..(777): n is a, c, g, or t
  misc_feature (798)..(798): n is a, c, g, or t
  misc_feature (815)..(815): n is a, c, g, or t
  misc_feature (823)..(823): n is a, c, g, or t
  misc_feature (873)..(873): n is a, c, g, or t
  misc_feature (885)..(885): n is a, c, g, or t
  misc_feature (888)..(888): n is a, c, g, or t
  misc_feature (890)..(890): n is a, c, g, or t
  misc_feature (892)..(892): n is a, c, g, or t
  misc_feature (903)..(903): n is a, c, g, or t
  misc_feature (936)..(936): n is a, c, g, or t
gttgggctggggaatgccagtgactggaggtgtcctggcctgtcacccctagatggagggctgtgctggggtgtctgtttttgcattgcgatgccaccctctctgtgcttgcatcctgcgtgtgttcccctgatccatgtgaatgaatgctggattggatgtattgtgattgacgaagcttatgatttacctgatgctgttcctctgtccatgtaaactgatgctctgacagttgggcgcccatgacccatgaacttgcgccccactgcgcttgtatgcacccatgtatgccacacgctaacttgcgtcacatgaatcctgatgcgaagcttgcattgttgtgacacacttgtccttcgcctgatactatgtgatgtccctcattgtacacttcccttgtggatgtcctcctgatggtatgtggtgtcttgtggtgtctgtgtgtccattacnctatcgtgactctcatgtcaatctttggcccacattactatcgtgtccacattgatggtattnacacatatgacanatgtggttgattacacacacctgatacaccattgtggnatatcgctcacattggtgtcacttgtttgacatatgtcgcatgnctcacattanctagacatgcctagtgactttgcacactctctgnctaactatatgaccatttgtttgtgacntcctggtgcccacnagcnttggatgtgatacacatagtgacattgtgttaacacncaatgacatacacatacctaatcagncacatntatnttncaaacataccatgtgcacacncgaatagtgtgtgcacnagttagcnaacaatgacccttgtgattgctatgaataagagcacatgcaccgaaaccnagataagtacanacntngnaatgactcttnggaatgtggacatattgacatgatggatctccntatacactaggcctatgcaatagagaccaacactgaacacatgtgcacggacaaa

SEQ ID NO: 518219 - DNA, 140 bp, Homo sapiens
agtatctgcaatttgctgaatattggagtcgaatagattattgtgtggaattttaggattttctacatacaaaatcatgtatcatctatgaacagagataataataactatcttatctttcgaatcttgggaggcagacg

SEQ ID NO: 518220 - DNA, 219 bp, Homo sapiens
gtctcagggggcccaggagggcgtcgttccctgctaagggcgggtagacggttcaacctgtacctgctccggactccactatagcagatgcgagcaggagtaggcgagcgggaggtacgacgtcgacacgctactgtcgtcactgcggggaaaccgccatatcgggggcaccgacttacttacggggaccctacgtccgttgaccacagcctccgactt

SEQ ID NO: 518221 - DNA, 441 bp, Homo sapiens
tattcttatgggtaggcttatatggggtgagtactaattctttatatgttatatatgtagcaaatatctctcccaatattagtttatttgaaccgtgtttatgtcttttagttaatcagaaactttaaatttggatatagtcaaattggtctatctttctataatatcatatagaagaaatcctctttcctactctaagacaaaaagatcaagccaagatcccctaatatttgagtctgattttgatactgtttctctgatcttattaactacccctgagccattatcacattaccttaattactaaaaattatatatgcatttatgtgtgcatataagcttatttctgtttggttttggtacgctcccttgtataatgaagcttcctgagaaagggtcatagggagtaaaatttgttatggtaaatatatttttattatt

SEQ ID NO: 518222 - DNA, 994 bp, Homo sapiens
cgcaggcggggagggcggggctgcgaagcctggggtgcgggggccacgcgtgggtgcagtgcggtgctcggctcgtgctgacgtcggcccgccggcgccccaccatgctccgcgcggtgcccgggttggccaccgcgcgggcccccggcccatccccctggcctgtgtccctggcctggaaccgatcgtggcatggtttgagctggtgcgtctccatggctgaccctgcgcggtgctataagtagggaagcggcagtgcctgtggggctttgtcagtccctcctgtagccgccgccgcgcggccagcgcacctctgccagcagatcccggcagccacctcgggcctggcgtctccgtgctgggcgtggagccagggtcggcttgacgggcggcggcggggggccgtgcctgagcgctccttgcgggcttgcgacctcatgtgctcctggcgtcttgcgctttccccactggggcttggccttgcaggcagcctgggacgcactgagataggtcagctgctagttcccaagggcaacacgcaggaagggactatgggaattcctttggagagtaagcctttggtgaggaacgctggaaatagttcattttcaaattccatcctcataagaatatacccagtagggaaccaatcagagaaaattcattgaaccaacctatgggtaaattgaacgaaggtaatgaagctggacactacctcagaatgagacggttagaccatgccaaagggacatttctgggcacccaggaaaagagtaacagtggaaaggtttacaacacgttctggaatggaataaggggcatgcactttactattggttgcgacaggaacctgggggaacaaaccatttctacaagaacaacacatctgaagggtggggtaagaagacgttctccccacgatgaatcacccgcctctatattgccagaacaaaaatgtaatgtgatatgaaaagtcaatcgggcaaagaagcag

SEQ ID NO: 518223 - DNA, 964 bp, Homo sapiens
atgagacgtgcctttcatcttccaccatgattgtgaggcctccccagccatgtggaactgtcttgctctgtggcccaggctggagagcagtggtgcaatcatagctcactgcagcttcaacctccaggtacaagtgatcctcctgcctcagcctcccaagtggctaagactacaggcctgcaccatcacacctggctatttcaaaaattttttgtagagatggggtattgttatgttgcccaggctggtttcaaactcctagactcaagcaatcctctcgccttggcctcccaaattgctgggattacaggcgtgagccactgtgcccgatcctacttctctttctttctatcatatagtcaggtagcaatgagggcactggaagccttggtaacaatgccctgggccagggccagccctacagctaaaatgtctagcctaagattgcatcgactgtcatcatcacgtgctcacaagaagaatacacttcctttagctaatagagggactcgtgcaacatgactatattgaactccatgacgagaagtcacgacatagtggttattctgcagggaacggaattactctgggaagggcttgcgggcactgagggggtggtgaggcgtagagtaaggttccctctctttccttttcttcagtcaatactgacacattccatagacgctagcgaggcaagttcctgaacccatcggctggaataaccgcgggcaattcccacaagacggtaccctgggagaatatcctggcacttagcagggcagtatatgtctacacttaccaaccaccatctagtgattccctccacttggcaggcctaggcgtggcaccggtactcggaaaaaaacgccgggacggcacacctgacacaaaccttggaggcagcggaggttatgcccgagacgacagcgtgatataacacgctgaaacaacatgagggccccta

SEQ ID NO: 518224 - DNA, 300 bp, Homo sapiens
tcacaatattttattagccactttcgtatcaattttgtgtctacactggagttttcaatcaactcaggtgacttctaacttgattggggacggggtgatctaaaacactctatacgccggcttctattgtcttgggttactcgtgtgaccgcagtggctggcacgaaattgaccaaccctggggttcgtataccttatttcaactttcgtttattgctcatggttattcacttgctgtttccctgtgtgggtgtggctaggctaagcgttttgagctgcctacaccgtgcttatctcaat

SEQ ID NO: 518225 - DNA, 435 bp, Homo sapiens
tacttttccacaggttaatgggaggaagggttctgaaaggacaacaaatgcatccagacagaatccatattctttcaagcactagtatagcatctagcataaacatacaaagtaagccaaaagcagcaggccaagtactgttaatcacattgctttaaagcccttggaagtatgctacaggcccaatatttacaatcttccacacaggtacaagcaccacaaagaaacgttgtgggctacactatatcgcttaataatatgttaatagctgtacatccagcagagttcttgtgaaataatgtgactcattagtactaattttaaggtggattatatttctgatctatacctgcattcccccccatcagcagggaaatgagtctagtattttagtagcagaacagggtgtactccttataggctgttggagggtgg

SEQ ID NO: 518226 - DNA, 452 bp, Homo sapiens
accggtagaagactctgacagctgaaaataccgtcgccacaccggccaaaaagttgccttcggaaattcaatccagccctgtgccggcgcctttagcaccggcacagccatcaccgttcgaactacctcagcattcctcgagcagtacagatgaatttgacgagctactggcgctccttggtaacatcaatgagccatcagaagacaccaaaaacaaagcggtctcagcggcacataccgcgcctccgaaactggatgaaatccagccttcccaaacctccaatcaaggaggtgcgcctttagcaataatcgaagaagtcactccgatgcctagcaataacaccgagatcggtcagggatttgttgaatggcttaagaaaggcatcgcatcccggaccatcattatcaacgataccaaagcgctggttcataccgtagcagggacccactcg

SEQ ID NO: 518227 - DNA, 169 bp, Homo sapiens
acttacaatcacttaacaatcatggttcagaagtgattgttgcccgctagtcggggaacaatcacttagtagatggttccgttggctgtacgataaggctttttcacttcatgtaatcgtattggttcactttggctaggtagcttagcaaaagtgattgtgccccgct

SEQ ID NO: 518228 - DNA, 111 bp, Homo sapiens
catcatgctattccgtttccatagagccttccagcagattcaatgctcaaacccagatttcctatagtctggccatcgaggccactgatccactttagcaggcttcttaag

SEQ ID NO: 518229 - DNA, 165 bp, Homo sapiens
gccgggttaggaaattatttattaatttccaagccaggttttaactcacccggggtgggaaatggggtccctgtcccccccaaagcccagggcccagaaatggggccgtttacatggggggtttccgggggggggtttaagtctttaaaaaaaaactcaaagaga

SEQ ID NO: 518230 - DNA, 467 bp, Homo sapiens
  misc_feature (46)..(46): n is a, c, g, or t
  misc_feature (79)..(79): n is a, c, g, or t
  misc_feature (186)..(186): n is a, c, g, or t
  misc_feature (189)..(189): n is a, c, g, or t
  misc_feature (191)..(191): n is a, c, g, or t
ggagcctggaaggtaagcccctcctggggtggatgccccagcaatntagtactttctgccagttcctgtgcacagcccntaagtcaacttagcattttctgcatctccacttggcatagttaaacctccgtgtcagattcagctagtggccagagatgtcgtgtccggatccttaaacgttgcgcngcntntcagctcatcttcatgcacctggatttgcatacttcttcaagatcccctttgaatttttagtgactaaaccttgtgcattctagagtgcatatatttatattttgcctgttaaaaagaaagtgagcagtgttagcttagttctcttttgatgtgggttattatgattagctttgtcactgtttcactactcagcatggaaacaagatgaaattccatttgtaggtagtgagacaaaattgatgatccattaagtaaacaataaaagtgtccattgc

SEQ ID NO: 518231 - DNA, 943 bp, Homo sapiens
gatctggatactgtgtgccggagcagccaacagaatcctgtgtcacaatgcgatgcagaacgaataacgccttcatcaccatggcaccatttatataaaaagatagagggagagatgtggctgggaagtcagggaccccgaatggagggactgactggaggaccgcggcagaggaacataaattgcgaatattgcattttaatatggacatttatcagttcccaaattattacttgttacagtttcttacgcctgtcttactttaatctcttaatcctgttatcttcataagctgaggatatatgtcacctcaaggaccactgtgataattgtgttaactgtacaaattgattgtaaagacgatgtgtgttgtgcacaagtatgaaatcagtgcaccttgaagaagaacagaatatcagtgatttttaggcaacaagaggcgacaaccagtaaggtctgactgcgtgcagggtgcaggcaataatagagccatatttttcttcttgccagggagcctataaatggacatggaagtagggaaggatattgctaaattcttttcctagcaaggaatattactattaatactctgggaaaggaatgcattcctggggggaggtctataaacggcactctgggaatgtctgtcctatgcagttgagacaaggactgaaagtacaccctggtctcctgcagtacccctcaggcttactagggtgggggaaaacctggccctgggcactctgtggtcagactgcttctctggtctgaacctgtgtccggtgtgtaagatgtttatccgaccactcgtgcctgtggtcttaacctgttaggagttcattgcctgtgcgttctcaaacagggttccgttcgctgttggccctaagttgtgtttccccggtaaccccctttgattaaaatggtggacgcggccgcttatttc

SEQ ID NO: 518232 - DNA, 503 bp, Homo sapiens
  misc_feature (55)..(55): n is a, c, g, or t
  misc_feature (57)..(58): n is a, c, g, or t
  misc_feature (61)..(61): n is a, c, g, or t
  misc_feature (65)..(65): n is a, c, g, or t
  misc_feature (67)..(68): n is a, c, g, or t
  misc_feature (70)..(70): n is a, c, g, or t
  misc_feature (81)..(81): n is a, c, g, or t
aatattgagtagttgggtggtggtggtctcccatcaaaacgcacgtacttacaangnnccngtgncnncnacctacccctnttagctccagtgcttataagaagaccaagtgctttcccttggcctgggttgctcaggtctccagtggaaagatattctttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaa

SEQ ID NO: 518233 - DNA, 275 bp, Homo sapiens
ggacgcgtgggtcaagcccactgcccaccctatcaaatgatcccttcctcgggcactttttaattcaccaaagtatttttttatcttgcgactggattggaccctagctgggaggcgagaggggcagagactgcttcttaccccacccttgggcctacctgttgcctgaggtggggtcccaggagcctcacccctaccacccctccatgtggaggaaagaggaaatctttagggcagcttccgtggcccagctggacttcccgcagagtgaagag

SEQ ID NO: 518234 - DNA, 520 bp, Homo sapiens
  misc_feature (35)..(35): n is a, c, g, or t
  misc_feature (40)..(40): n is a, c, g, or t
  misc_feature (54)..(54): n is a, c, g, or t
aaaatgtatactacaccgggcctcgaataagagtnataanaccttgtgccacanaaaaggccatgtgatgacctggtgagaaggtggcaatctgcaagccaagaagagggctttcaccggaaacaaactcttccagatcttaattgtggatttctagcctccagaatgatattactttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaa

SEQ ID NO: 518235 - DNA, 417 bp, Homo sapiens
cggatgatctacaggatcttcaaacaccgcaatctggcttctttcaagtgatatgcataagctccccaaggacaggtgccctgtttacttcactccagcagatacttcctggggtccagctgcgtgccagtggtgctctggaattttggctagtgggaagcggctataaggaagctgtcttggtcagacagcaggagcgaagaggcctgggtagagtgtgcaccctgtgaagtattggtgtgcagacatttactaagacttgtgcgtccaccttggatgcactgggagtagggtaggggtgggggagcccaagagcacctccaagtttctcccctggtctctgcctcctgacacagtctaggccagcactattcaacagaaatttctgtgacaatgggaatatcctagatctgtata

SEQ ID NO: 518236 - DNA, 402 bp, Homo sapiens
  misc_feature (50)..(50): n is a, c, g, or t
  misc_feature (53)..(53): n is a, c, g, or t
cttatattctcctcttcaactccatacgcccaccgaaatcctactattanctnacactttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaa

SEQ ID NO: 518237 - DNA, 925 bp, Homo sapiens
gcaacctctgacttattctgcagatgctctgtgtgtgtgtgtgtgtgtgtgtgtgtgtgtgtgtgtgtgtgtcggagagagggtggtagcacagggcttgggatatcggcagtgtgggaaatgcgaagcatctctcatcatcatcatctctgctacagtcatgtctctgcatgtcgagcgagcgacacgtgtccctgcctcagggttggagggttttatcacgacaagagtgtttttcacagtagtatcgtgcgtctccatatcatccactctgtgccttgtcagccttatgaaaggcttggtctgctcccaggctggtgcttctcagggaccttaaaagggacctggttacgtcttgggagcagagagtatctacttgggcactctctctccaagaaagaccttgtctccattcttcaattaagacaagtgcttcttgtgtgtgcttcgtgggaagatcttctaataggtggaagtgcttgtcgcatcctgcttccccagggcgatgtggcgtcgccaatgagacctgagggaccacatctttgggggcccaacatcagtgtccttcaccaagtgtgccattagaatccgcccctggacagagttcctgggcagaggggaaagcagcccccaggtcttactcaggctcatgtccatgggttgggcagccagtgtgggcccttctcaggatcctacatctccaatcactcatccttctttccttcacagtatatacgttggagctctgttgtgacacaccgtgtcagtcatgatgaatcggccaacagccagcccttgccagtgacgtcacagtctaaagatgggaaagtgtggtacagatagacatgaagagacctaacagagatgggggtgggacaaaatataccggctggaaaaacccctggcgtgtgttaaaaaaaaaaaa

SEQ ID NO: 518238 - DNA, 560 bp, Homo sapiens
  misc_feature (35)..(35): n is a, c, g, or t
  misc_feature (40)..(40): n is a, c, g, or t
  misc_feature (54)..(54): n is a, c, g, or t
aaaatgtatactacaccgggcctcgaataagagtnataanaccttgtgccacanaaaaggccatgtgatgacctggtgagaaggtggcaatctgcaagccaagaagagggctttcaccggaaacaaactcttccagatcttaattgtggatttctagcctccagaatgatattactttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaaaaaacaaaaaaaaaatggtctccccggtctcacccgtgca

SEQ ID NO: 518239 - DNA, 191 bp, Homo sapiens
gtcttaccgtgggcgtatgtgattcatgtggtcacaagatgagagaaattcttgttttaaggctgaagtagctatccattgcatatgtttactacattttctttatccattcagtcgcatcgatggacacaggattgattccatgtatctcagtcgattgtgcataatgctgaagatgaacatggcaagtg

SEQ ID NO: 518240 - DNA, 680 bp, Homo sapiens
cagcccacttgcacccaagtgaattaacagccttgtcgctcacacaaagcctgtctaggtggtcttctatacgcgacctgccttgacactcggctgcccaacaatctgggccagggcggactccttcgctgagaccggccccctgtcctggccctcattccgctgaagcagatccacctgcgacctcgggctcctcagaccacgcccaaggcaacatctcaccaactttcaaactcggcatctccctcggcccttagccgcgcctgacagactgactgcatgccccgactcgccctcagcaagccccctgcgaccactcacacgactgccgacgccttcgcggctacactcatctacgcgcgcgcacggactctcccacgccactactgacagcaccacccctagccctggcaccgactcacgctaccttgctcacacacacgctctcgaccaccctcacaacctcctacacgccctccaactggacccagaccccctaaccacggctcacccaactacgcacaaccaacctgaccgacccaatcctggcccggaccccatctcccactcggcgctcacccactccccacgaactcaccgccacggcccactccagaccagaccaagcccggattctcctcctccttcctccctcggacaccccaccaagaaccaccgcc

SEQ ID NO: 518241 - DNA, 307 bp, Homo sapiens
ttttttcctttttggtgggggggcctttttaattggggggggtgggcccccctttttttttcgggtttttgtttttcccaggccttttttttgtccctttgggaaaatttccctttcttggggtttttccctttccccctccctttaaccggggtggggatttttttttttgtttttgggtttttgaacccctttttccccccttttttgccatttggggggtttttttggggttaaaagtgggggcttttaatttttttgggaattcccctttttttttaaggagtaaaaggccctttttttttta

SEQ ID NO: 518242 - DNA, 543 bp, Homo sapiens
  misc_feature (55)..(55): n is a, c, g, or t
  misc_feature (57)..(58): n is a, c, g, or t
  misc_feature (61)..(61): n is a, c, g, or t
  misc_feature (65)..(65): n is a, c, g, or t
  misc_feature (67)..(68): n is a, c, g, or t
  misc_feature (70)..(70): n is a, c, g, or t
  misc_feature (81)..(81): n is a, c, g, or t
aatattgagtagttgggtggtggtggtctcccatcaaaacgcacgtacttacaangnnccngtgncnncnacctacccctnttagctccagtgcttataagaagaccaagtgctttcccttggcctgggttgctcaggtctccagtggaaagatattctttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccagaactcctcagggagatggatttgaaggtctcctcccttctacttgcttgatgccctattattattaaactctttgctacaaaaaaacaaaaaaaaaatggtctccccggtctcacccgtgca

SEQ ID NO: 518243 - DNA, 306 bp, Homo sapiens
cagattgggactcagtctcaaacaaaaataaataaataaataaataagttatctgttcatattgtgcctacttttatcagagcttacagttttatatctgtatgaagtgttcttatatttgggacaatgattttgctagcttatttacatttaaattttctttgtacttttactttacattcaagtatttgatgtttatattgagtcaaatctgtccatcctttcctttgtgatttttttcccattgctgtaatgcttagggtatatttttatagagcaataataaatattttagtgttaattata

SEQ ID NO: 518244 - DNA, 246 bp, Homo sapiens
  misc_feature (232)..(232): n is a, c, g, or t
gctcgacgatgacttttttgatggaatcctgcattggatagctggtgggacccccccctcagaattggggaactgaggagactccagggagggtgtccttccagggagagcagctatgaggggccccctagcttcctggggcgggggggtggggggggggagtaaagggccatacacacctgtacccaggggcgggggggggcgggggctttctttttttactaaataattntaaaatattattat

SEQ ID NO: 518245 - DNA, 693 bp, Homo sapiens
taaatttaaatttacatttttttccattttttggaaaggtttttttggtttggtttggtggtggtggtggtggttgttttggaaacagtctgttgctctggtcacccagggctgggtgatgtcgcaggtgggcatagattctctggcaaccttctacctccccagggttcaagcaatttctaggtggcctgcagccatcccaatgtaatctggggactacagtggggcacgctaccacacctgggctgatatttttatttggtggttatgtagagaagacagggtgtttcaaccatgtgttgccccagggtgtggctcctcaaactctcctgtgagcttcaggcaaatccaccccgcctatgtggcctccccaaaggtgctaggatttacggcgttgttgacgccacgcaaccacccagcttattttatctcatatctcgctttatataaagtttataaaggtgtggggggggtccctcaatttgtgttacccgtggccgtggttctcgaaactctccgcggactttaagacgactcctctgtggctctccaagcccaattaccgagctcctcgagggttctctttatacataaagagactcacttaccttttttttcctcttatatcgtgctgtgccatgtgttgtagagtggtggcttttcacctttccgccagtgatttggtgaggccct

SEQ ID NO: 518246 - DNA, 333 bp, Homo sapiens
tacaagatcaggttagggaggcggggcagtggtcatgctataatcccagcactttgggaggcgagggagtggatttcctaaggtcaggagtttgagaccagcctgagcaatgtggtgaacacccatctctactaaaaatacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaacaaaaacggaaaaaatatatggggaaaata

SEQ ID NO: 518247 - DNA, 104 bp, Homo sapiens
gtttcttcttcagagagtccttgaacagcacaaactcaacaatgaccatttggaggagcggattccaggtttgcataggacaacctggcatgttgaaggatgga

SEQ ID NO: 518248 - DNA, 124 bp, Homo sapiens
gcggtccactagacgcagatgatgacattaccccaacagcggaaagggagaggttgatcttggtagctatcttttaagtctctccccgttgtgcgccgggtctatggattgcggtccgctgcca

SEQ ID NO: 518249 - DNA, 1163 bp, Homo sapiens
  misc_feature (33)..(33): n is a, c, g, or t
  misc_feature (145)..(145): n is a, c, g, or t
  misc_feature (148)..(148): n is a, c, g, or t
  misc_feature (150)..(150): n is a, c, g, or t
  misc_feature (167)..(167): n is a, c, g, or t
  misc_feature (171)..(171): n is a, c, g, or t
  misc_feature (178)..(178): n is a, c, g, or t
  misc_feature (247)..(247): n is a, c, g, or t
  misc_feature (304)..(304): n is a, c, g, or t
  misc_feature (316)..(316): n is a, c, g, or t
  misc_feature (357)..(357): n is a, c, g, or t
  misc_feature (427)..(427): n is a, c, g, or t
  misc_feature (469)..(469): n is a, c, g, or t
  misc_feature (1047)..(1047): n is a, c, g, or t
  misc_feature (1067)..(1067): n is a, c, g, or t
  misc_feature (1085)..(1085): n is a, c, g, or t
  misc_feature (1087)..(1087): n is a, c, g, or t
  misc_feature (1091)..(1091): n is a, c, g, or t
  misc_feature (1102)..(1102): n is a, c, g, or t
  misc_feature (1120)..(1120): n is a, c, g, or t
ggtccggtccggccttcccgggctgtgcccggncggtgctcgcttgtccccgccgcgcgccccccgccccttgctgcccgtctgtcctctccggccgttcgtcccgccctccccccctgccccgggctcgccgccccgccccgtnccncngctccccggctggggtntgtnggccccntctgggcgggcctccctcttcccctttccccccggtgcccctcgccgcgcccggctggggccgcctctncgcgccccgcgcggggccctggctgctgcccccgccgcggcgccggggggccctgtncccccgcccgtngcccccggcggccccggcttgggcggtgctccgggggggcngcgggcgcccccgccgtccgccgtgcccgccgcctccccgttgtccccgccggtgctgggcctgggtgtncccggccccgtgctggcgtccttccctcggcgccctggcccnccgtgtgccctgccgctcctgtctgcccgccccccggcccggccagcggtcgccccatccctggccggcttctggcggcccccctcttgtctgcctcctggctgtgtctgcgcccctgccccctggcccgcgctgtctcctcctcctcctggcctgcctggccggtggtgcgttgttccgccggcttccggcgcgtggcgccccggctttccctgcgcgcgccgctgccgcgctcctgcgggctcttggccctgccctcccgtttctgccccgccctccccttgccccccgcgctgtcccgcctgcccccctcctctccccctctccggcgcccgccgcctgcttccgctccccgcttttggctttgctccggcgccccccccccctgccctgccgccccctgctctcctccctcttctgtggcccctgcggtcctgggtcccgcgcccgtctgccccgtcctgtgccctgtggtccctgggtgtcctcctgtccctcctcctttgtggcttcccccccttctcctcccccccgggcccggccctctccccggggctgccgcggcggcttcgcctggnccgtccggcttcccccctcntgcgtggtccgcgttttncngctncccgcgctgcnccgctcctgttgccgccnccccccgcgcggtgccctcctccgttctgccccccctggctcc

SEQ ID NO: 518250 - DNA, 326 bp, Homo sapiens
gctcggtacccgggcgaacgtgtatccctgcaggtgtacctgccaagggcgggcgaggttctccagaccagtttaagcgcgccaaggcttcttccaagaacttcttctgagccggaggtggtaacacgctgagccccgttccagttccacctgcagagttcggtctctctcagagctctctgaatgggcatggaacttcaccagactgctatagagctgtctctctgcttgtaaggcctcattgagccgactccgttcatctactagtccttctagcatcagcagcaactgtggtcttcggtttcctgaaatttcttgaccctggg

SEQ ID NO: 518251 - DNA, 232 bp, Homo sapiens
cagctttttgacagtgggttttagcatgctgtttgtaatcatacagacatgatttccatgaggatgtatctttctctgaaatcaatagaagtccagactttttttcttttttttggaggcagagtctcactctgtggcccaggctgaagtgcagtggtgtgatctcggctcaccgcaacctcggcctcccaagttcaagcgattctccgtgcctcagcctcccaagtagcta

SEQ ID NO: 518252 - DNA, 889 bp, Homo sapiens
  misc_feature (104)..(104): n is a, c, g, or t
ggcggggctccgctcagtccgggagcgcagtgggccggggctcgacctcggtttcccaccgcccgagtgaagcacatcccgagcccgggcggatccgatcgccngagtgtgccctctggcgccatgtcgcagaaacggagcgcccgggatgcaggaggagagcctgcagggctcctgggtagaactgacttcagcaataatggaacggggcagcgttccagcctcggttttctatttataatggagacatggaaaaaatactgtggacgcacagcatgagttctggacggagtagtccaagagctctcatgtgacagccactcgtgcgagaaaccagaagatacccaaagagtgtctgaaaaagatacccatagcatgggagagaaaaaacagtcacagttctggggacagatgatctggaacggaaggaaggaagtgtgaaagcatttttgaagaaaaatcagatgtggatatgggatgtggtcaagtgcggcggaaaatatgcccccccaggaagttctttctttaaaacacccgaagggcaaggcacctcagctgaggaacccgagcgtcatgagaagggcggcattttctctgcagactctgagaggtttccttccatcctggggtccccattggggccacgatggggccaattcggaagggttgagacctcccacgcgctttggtgagactgggctgccgggccgacggtatctggctggacatgcccgaacaggagctgggggccggcccggtatttgcggaagcgcgccatataaaaaaaaaccacgcggtggtccacgacacacccgccgaccggcggagcctgcaccacacacaccgcggcgcggcagcctagatcgccgaaagattggcttatttggga

SEQ ID NO: 518253 - DNA, 163 bp, Homo sapiens
ggacgcgtgggctactccggaaaaaaagaaccatttggatacataggtatggtctgagctgtgatctaattggttcctaggttatgtgtgaccccattttcgtaggtgactaccactttcctccgccttctgttcccggtaattactgtcgactagagcttgt

SEQ ID NO: 518254 - DNA, 388 bp, Homo sapiens
cccttcctgcttccccttcaggtcttggtttgttttgaagggacgttttatagtccctatccccatgccagtgtgaaatgggcatttataacgtggtcagggtgtcccttcctaatcatggggcagatgccccaagccttcaaaaggagttttgaaagggtggccccagccccccgtggtgtgccctggaggcttaggttggtttgaggttggccccccaatttaccccagagcccagggggtcccaaaggcaagtttcccagaattgtcaaatggtcccctttccctgagtctggtttttttttgtttttttttgtttttttttggcagagataatcgggtcttaaaagttgtttttaaatggcaataaaacaagccagaatgtcca

SEQ ID NO: 518255 - DNA, 279 bp, Homo sapiens
  misc_feature (5)..(5): n is a, c, g, or t
  misc_feature (28)..(28): n is a, c, g, or t
  misc_feature (47)..(47): n is a, c, g, or t
  misc_feature (52)..(52): n is a, c, g, or t
  misc_feature (91)..(93): n is a, c, g, or t
  misc_feature (95)..(95): n is a, c, g, or t
  misc_feature (100)..(101): n is a, c, g, or t
  misc_feature (109)..(109): n is a, c, g, or t
  misc_feature (117)..(117): n is a, c, g, or t
  misc_feature (169)..(170): n is a, c, g, or t
  misc_feature (172)..(173): n is a, c, g, or t
  misc_feature (180)..(180): n is a, c, g, or t
aaganacagataagtacactgctgcttntgttgcaactgttgcctcnaattnaggtgaatcttgaggtgtccaagttgcaacagaagcgannngnatacnnaccagttnccaaaganacagataagtacattaaagagtttggatctcgcccaccacccccagtgaacnncnncaaaggnaaatacagaaggatcgcttagtggcagagttcacaacatcactgacaaacttccagaaggtccagaggcaggctgctgagcgagagaaagagtttgttg

SEQ ID NO: 518256 - DNA, 124 bp, Homo sapiens
  misc_feature (59)..(59): n is a, c, g, or t
  misc_feature (65)..(65): n is a, c, g, or t
ccaggcgtcggtactcagcggtgttggaacttcgttgcttgcttgcctgtgcgcgcgtngatcantcggcctcaaacgattatacccaacaagcaacccaaagctatggggcctaccccaccca

SEQ ID NO: 518257 - DNA, 624 bp, Homo sapiens
agcggacgggcgctgcgtggcaggcccggcggccgggcgtgctgcctgccacgatgtcctgtgcgccgcggccggcgcgccggcgcgcgcggggacccggactctcctggctgctgtgctgcagcagcgctggtgtcccgcggaccgcagggctacgtgatcgttgagctccgtagtcttgggccgacaaccaagaggtggaccgaggagctggaagcagcctccacattgagagacggtaatagcccagaggctgctagaaggaatccgagggaaagccaactccgtggaccacgcgaaacaagagtataccccaggaacataccttgcacaccgaacacaaaagggggaagagaaaagacaggccaaaacaaattgacagaggaacacaccgggagggaaggagaaacaaaaccaagagcacacgggggagacccaaggggacccggaagcgacccccccaagacaacacaaagacaacgaggaaaaaagtgaataacgacaacaataacacacgaggacgagccaaaagaggggcaagaaaccacgaaaacaacaggagacaacaaacaacggaaaaacccaacgcaaggagagacaccaataaacaacaaatgaaacacg

SEQ ID NO: 518258 - DNA, 546 bp, Homo sapiens
agttacaggcctctctaggaacagctgggctgatggggacagccgatcacttgacaggcaatggagtgtgggaaggtgttgatggacatcagcgcagacgctatagaatacggaatacctaaactcagagggtgtatggatccatgatagggtttctataggcaagagtagctaagtcaggaggggtatctagatctagtgagggggtagctgagtccaaggaaggagaagctgagtgaggaagtagctgggtgggccatcagcaggtctttggttggaggagaagagcagctggaggcaggaatatttagatccaggaagggagcaattgatgggatctgagaagcaatctgatccaggggaagagtagctgggagagaagctagtgaagggggttaactgggcttaaaatagaagtaggtgggtagagatagagactggggtggccatcagtgggccctggcagaagcagctagattcagaggagtaattgagagtgtttgagaggagaagcaattgaacccagaatctaagggaatgaataga

SEQ ID NO: 518259 - DNA, 837 bp, Homo sapiens
ggaggcatggaggcagtcagcgcacgggactactgctgagggggcagagcggcgcttgagagaaaccgcggataagtaatgactctttgaaagatagacgattaatgaacaactactgtaaccaggagtatagtcaataggtatacgaagatatggccttagcgttgagttggaacgtaatttgaactcagcttaagattttgaagagagaaagtatgaagaacattgaggaagagtagcctgaggaatggaaccagatatacaaggtttctaaagacatgacggaggtgtgaggatgaagcttcttcagtggatctaacaatagatgtatttaagagaacattgagagaaaggactatagtagtcccgtaattaatacacaatagaagggcaattgcttttcagcattaacacatgaaggtgaacttagaatcggagctttagaaggttcaggtttagaagttgtaggtgatgagaagataatgagaaggcgatcttttaaaaaatgagattaacaccgaaaggtgattaaaatagagcgtgtgaaatcccatggactgcaggggagaactgtgtcactgttagtagccctagatatagggtcatttaacttaaaagcgcagtaacgaaccatggaccagatttatgggggagtttgggtagggatagaaaacaatttgtgacgtaaaatagaagttgtcgaaagctgggaccaacttggaagaaagaaggtcgcgcgaaagggcgaggaaggaacattcgcgacgcattgggtgattcacaaagataacaaacttcgctgtgtacacaagcacagaataagtttcacgcctggaa

SEQ ID NO: 518260 - DNA, 102 bp, Homo sapiens
tcagatcagtttctgcaggaagctagctccaagcacgcagtctggtagacatttttgcctctgcgcttgaaatgcttgcaaaatactttgttaacaaaagct

SEQ ID NO: 518261 - DNA, 100 bp, Homo sapiens
accccgtcctagccttacattgcccagcgcaaccctacctgctgcctctggctgccactcctccctcatcttcttaatgtcactcttgcatttctcaatc

SEQ ID NO: 518262 - DNA, 118 bp, Homo sapiens
ctttgctccagttcccagtaagttcctcatttccatcacctcctcagactagcccctaccccccaattaggagggcactggcccccaacaggcatcaccccgctaaatcccctagaag

SEQ ID NO: 518263 - DNA, 1007 bp, Homo sapiens
gatggtgccatggagcagagggacccacaagtgcctcccgagcctagatccttggctcggaccactgcaagggccgaggcaagggacagaccagagcatcctgggtacagtgcctgtgacatctaccatgagaacctgaggccatgattcaggtgcagactgaggacacatcctgaagggtcagagacgagcatctagccaaagacagaccccatctgagacttaccagcatgcagagatatcttagacagagccatagaagagagcaacaagacacaaggagtaggtacacgaaggccgagcggactaagaagagacagactaggaagcggagagcattatagcatagaacagagagacgaggtgcacaccagggcataccacacctagacagcttacgggcccttgcacctcctccctcgctacctactacctacacatgtcaccacgcccgcgcaccgggcaacagcgctaagcacatatagcatgagcttagaaccaggaggggttacaacgaaactaaacgtcgtaggcacaccagagagcgacatccctgagacaaactgcaacagacaaaagactaaccctgctgcgagccagttaacccacttagatacaggacaggaaacatagcagattgagcaggatgcagaaccatcataccgaaccgagcaccaagaatacccactatgaacacaaaatatcagcaaaccaccacatcagacccctcacacaaccacaagaacaaattgaaaacagacaaaacctctgaaagctagaaatcaaaaaacgcacacaaccagaggcgcaaaccaaaagagaaacaaagagagaacggaatgaacagcccataacaagacgcaatgccaccaatcacatcgagccatgcgaacaaggaaaaaacaagtaaagcagaaagctaccataattggtaaatacaaaaaataacacacaatgagccaaaagagacaaaagtagatgagagcgaagacagataaaaaaagcag

SEQ ID NO: 518264 - DNA, 360 bp, Homo sapiens
  misc_feature (34)..(34): n is a, c, g, or t
atcttgtctggagggcactagatatgagcctgtntctccattagtctaacgctcctagggccagacagtgtcacaatgactcaatcagccatttataatgagcacctactatgtaccccatgctgctcagaacacagcagttaacagggagacaaggagaggaccactgtataacaaagctgcgtctatattaaattcaaaataatgatgtcaccagcagggtgatgagacagatcagtgatcagcaaaatttctttttgttgagatagagtctcactctgttgcccaggcaagagtgcagtggcaatcatggctcatgcagcctaaacctcctgggctcaggcaactcctgactgggca

SEQ ID NO: 518265 - DNA, 796 bp, Homo sapiens
  misc_feature (98)..(98): n is a, c, g, or t
  misc_feature (109)..(109): n is a, c, g, or t
  misc_feature (141)..(141): n is a, c, g, or t
  misc_feature (148)..(148): n is a, c, g, or t
  misc_feature (216)..(216): n is a, c, g, or t
ccggggcctggcttcgcgtgggtcctggctcctctgaagtggagtggctggtgccgcctgtggccgcttggcctcgtggaggatgctggctgccctgncgcgtctccgncagggtttgcctgtcgcacctgaggtgcttcnagctcanacagggactcagcctcctgaggccctccgagtgccctcgcgatgccaggctctgctggcttctgctgngcactttgcccaaggtcgtctccctgtgcggggacgtgggtgagggggccccgtgactgtttctggagtctggcgaagtggtcctgctgcatgctgtgtggctgtgctggctgctggggcccgcggagatgcctcccccgagcgggacctctgggcggctgtcttcctgcatctccgccttctggcttcgcgcctggcgctctgttggtgaaattcttccccctcctactcctctaccccgctcaactacctggctccaagagtatccacctcttggatcaccttgcttctgaaagacaccgaggacctcagggcaccaaactacatcaaatctgtgccagtgggccagcacccggagaagatcctgtaacacggaaggctttcatgtgacccaattataccaagctgcatagtccgagtgacgcccaacccgttgacctcacactgagacggctcttaggaaaggatttggggattaatggggcagcatcatctctttgagaccggacctgtgagccaagatgatgccaagttacaagaatagccaactgctctggactcaagtcaaaatgtagccaaa

SEQ ID NO: 518266 - DNA, 933 bp, Homo sapiens
atgacaactaagtgaaatgtggaatctaggattagaacctgggacacaaaaggggatattacttggataatcggcttaatttcaagaaggtccatggcaattattgcaatagtattgattgttaatgtttctggtttatgatgattatgttaatgatttatacgatgactgtgaacatttggcggaaaactgcagtgaagcacacaactaggactctactattcttgtttgaaatgttttgacattgtaggcctggagcgcggtggctctacgccttgtaatcccaagcgacttctgggaggccagaggcgggctagagcacaaggtctaggagtttgagaccagcctggccaacatggtgaagccctgtctctactaaaaatactattaaattagccaggcatggtggcaggtgcctgtaatcccatctacatccgtgagcgcgtagaggcgaggagaatcgcttgaaacccgaggaggtggaagttgacagtgagccgaggatcacgccactgtcactccagcctgggtgacagagtcaagactccatctcagagaagataaatcaaaccatcggggtgcaagaagtatttttcctctaatctggagtaccccagtaaatgagtctgaaatgtgctggcactcccacagtgctgaatagcataggaatttgtattacaaagtgtaccattgcctcgtattgcggtagaggccactttgtttggtaaatttccaggaaagattataggggggtaaatgtccagaatgcacgaaaacgcctatttgagaagggataagaatgagttttctggggaagcaaaggggtttttgggaataatcattctggagtaacaagcaataaattgtattagctgagagcggcattgaatggagagttggaagggaatgaaccgttttggtattcagaatggt

SEQ ID NO: 518267 - DNA, 374 bp, Homo sapiens
tcgatctagaggatcccgagctctctcggtgagggggactatgactgattcttggggcatctgaaggggggaacaggggcgctccacacaccggggttcgggcccatcccacgggcggtttccttgacaagtaagcttatcacggccttctagtctggtacccttcatcacaggcaaccaaacatgtggtcttatataacatttccctggtagaacagctgatgtggccaggtttcggcgggcggagatgaggacatgttcttactcggcagtagctctcggaaccggaccacaaaccatggggtagacataagaggatgcggcttcccacaagatcaaatccaggtggacatcggaccccacagagagagcgt

SEQ ID NO: 518268 - DNA, 832 bp, Homo sapiens
  misc_feature (134)..(134): n is a, c, g, or t
  misc_feature (145)..(145): n is a, c, g, or t
  misc_feature (177)..(177): n is a, c, g, or t
  misc_feature (184)..(184): n is a, c, g, or t
  misc_feature (252)..(252): n is a, c, g, or t
ccagaagtacaaataatctccgcggcgtcagggccgggcttcggctacaccgcagcctcaccatgagcgacgcctctgaagcggagggcggaccgcctgagccgagggcctcattatgtatggaggcgccctgncgcgtctccgncagggtttgcctgtcgcacctgaggtgcttcnagctcanacagggactcagcctcctgaggccctccgagtgccctcgcgatgccaggctctgctggcttctgctgngcactttgcccaaggtcgtctccctgtgcggggacgtgggtgagggggccccgtgactgtttctggagtctggcgaagtggtcctgctgcatgctgtgtggctgtgctggctgctggggcccgcggagatgcctcccccgagcgggacctctgggcggctgtcttcctgcatctccgccttctggcttcgcgcctggcgctctgttggtgaaattcttccccctcctactcctctaccccgctcaactacctggctccaagagtatccacctcttggatcaccttgcttctgaaagacaccgaggacctcagggcaccaaactacatcaaatctgtgccagtgggccagcacccggagaagatcctgtaacacggaaggctttcatgtgacccaattataccaagctgcatagtccgagtgacgcccaacccgttgacctcacactgagacggctcttaggaaaggatttggggattaatggggcagcatcatctctttgagaccggacctgtgagccaagatgatgccaagttacaagaatagccaactgctctggactcaagtcaaaatgtagccaaa

SEQ ID NO: 518269 - DNA, 313 bp, Homo sapiens
ggcttctgttcctgctttgtgtagcgaagatcagggcttcaagtgccatccatgtccctgcaagggacatgatctcattcgttattatggctgcatgatattccatggtgtacgtgtaccacaatttgtttatccagcctgtcaaaagacatgggcttttcagttgattccatgtctttgctgttgtgagtagtgctgcaatgaacacatacatgcatgtatctttgtgatagaatgatttatattcctttggtgtatgcccagtaatggaactgctgggtcaaatggtatttctggttctaggtctttgagg

SEQ ID NO: 518270 - DNA, 393 bp, Homo sapiens
tgtaaacctgtgtatttgtaatatcccgtttctgcgatagataaaacaaatgcagcaagtgaacaggttttgtagatgacaatgcctttggttactttgggcgaaaccaaagtaactcgaaccgaaggttattcctaatattggattacactaagcaagacaccgcctcgccaataactgagttacggttcaactcataaaatatgcggattcatatctgttaacgtagcttattccacaaagcacatgaaaatcgagtattaacaatacagattatggaatttgactttgctctaaactgagtaaaatctgcttcttatccaatccaccagcgaaaccaactaatgccccagctgatccaatcactcgatgacacggcgcaataatcgaaat

SEQ ID NO: 518271 - DNA, 1349 bp, Homo sapiens
ggacgcgtgggtcgaaccacgcgttcgggggaccgcagaggaagaattctggctttgggcgtggacaacctgaacaaagatcagagcccaggggccagtatcggagctccgggctggtatgctgctggtgaccaatgggtgagacagtcctttgcttgctctatgacaagtttcagcgttgggatgatgccaaggtactcgtctacaagctgaatggtggaggggtactagctgggactaggccatggtcgacttcctattggccttacgcaacaagtggcgcaagaatctctttcgtccaccatttagacagaggcgacacgagattcaagccgagtcgactcaaacttggtgctcgtggtccttgacaaacatgggggctttctttggtaggaggggaaattatgttcgaccagttgtcaaaccatagatcggggacgaatatggtggactaaataaattcgacaagttgcgatggggcggttaaactttggttccaacttggtgaaggggcactagagagactagatcaaaattccgaagttgtgctgaagatgataggctgagggaagcaaaggcaacgtgtcagataaatctttgaaggggcacggcgcgaaattcgggggcgatttgaaattccgaggggaacgcaccgtgagggtgacgacgatgtgaactaaaggggcacagaagcagcaggcacaagggactattttcaccacagaatgccatcaacattagcaaaccaagtcgcaagacaatctgggtccgattagacttgggggcatcctgggtgcggacgttcaagagcttgagcatgggatcccctggggcccatgtgtgataaccaggtattggggggccttcaccattccatctggatgaactttctaatcttgtggacatcaaaaggaccattcagggattccaaagcaatggttacctggccatgggaggaagcggactgccaggcaaaaaatttacccaaggtggacaagcgattaggcacaataggaaagggaagaacctcctaagagagggagcccgggcggaaaagggaggacaaggggcaaacgacggtcaccaggggacaacatgggattatgaaaaaccgccggggatattaaacagtaagaccaggataacacatccaggcgcaacaatactgggccagcccacaacaacagggcgtacctgggaaaacaacacacatatgaacaacagataaacagagaacccgccacagacacatggtgatcccaaaaacagcagtcgacaaacacaacaaacaagacgagagacatacccaacacaatgtagaaacggagagccacaagacgcgacagcaa

SEQ ID NO: 518272 - DNA, 319 bp, Homo sapiens
gggtatcgttccgactggaacctgggggcttgatcaggaaacacactcagcgtatcgggcgtggagagtcgacgagctgagtgtagttgactacggtcttgcctcactgggaggccacgtatggtgacgatgcacacgaagccccggctacttgtccagtgttaaccaatgtgcccagtcgaatgtccttgtgcggaaaactcagtgcatatgagcgcgcacagcgaccagtcgtcccggtgacgcggcacattgtcccgtgccagtgccagtgcgcatgccgtagccacatctgctctagacacctatgggaaaaggg

SEQ ID NO: 518273 - DNA, 371 bp, Homo sapiens
gtcgacccaggctccacattgggcgctaaattttgggggctggccagaggctctcatgtccaggtttgagcttgggaggcatcttggagctgaaagaaaaggaaactaggcagaagagagtgttcagtggcacgggtgatagatgggagggggagccctgagacttagggcttctgtcaatcacactgaagtaattatgataccacatggaaacatgcaactctgcaagctaactaaaaagaaagaactgattttcccgaagagacagaagtcccctttgcaccatgtgagtcagcttctcttcttggctcctggggagtcacatgacttcagcccacactgcttgttgccttccttttcagtcgacgcgg

SEQ ID NO: 518274 - DNA, 229 bp, Homo sapiens
  misc_feature (183)..(183): n is a, c, g, or t
cctgctccgtcgcgcctacgagccacgcagtgagtttgatccgataccatcctgtatacatctggaactcgggcctggactcgtgaggacatgagcttacctgcgtgcttacgtacgagtcagctgctgctagcctactagcggggtcttgtactggtctcaatcgtacatctcacatgtggntctctatcactatctaattcacgcaatccattacctatccccatat

SEQ ID NO: 518275 - DNA, 509 bp, Homo sapiens
cttatactgaccccacttctttaacgatgctgtaacccagccagtgacgctaatcctacaagtgcaaagggagttttgcatctcatgtccaagtcagaattagggccatttactagacttcaaattggtgtttgctaatatttttgtggccaagtatgtaaacttgtagtgggtaaattcaatacttttgtcatattaatttactgtatctgtcttatcttttgcatgcttcaacctggctaatatatttaaatccaccgcatctctcctccctccccccattattacttttctctctctccaaagactctgttcatagttttataacaatattgtaaagttcaattgtatcaataaaaaaaaaaaacaagtttggacagtatttaaatattgcaaatatatttaattatataaattaaaatataagccataatgtctttctttggcccacttagaattgctcttgacttgctgtaaaccaaccttcagaataaaggacttttgttaag

SEQ ID NO: 518276 - DNA, 234 bp, Homo sapiens
tagaattagagagctggagtcattgtagggagagaagataaaacggtcgatccagatttggctgctgcagaagctgaaaaaccggcgtggtggaacgcttcactctgcgccggctcattggcatttattggggtctgtacggtagtccgtcgtttccactcagcaaagctctttaggtcacatcatctcctattgctcccccacatactgtccccccgttttttaaacagagaa

SEQ ID NO: 518277 - DNA, 274 bp, Homo sapiens
gctaccacaacctctctctactacaaatacaaaatttagtcaggtcatggtgttgacacaccgtaatctcagcctacttgtggaagccgaggcataaggataccttaagcccgggaggctggaggctgcaggtgggaggatcgcttgagctcaggagttctgggctgtagtgcgctatgccgatcgggtgtgcgcactaagttcggcatcaatattgtgacctcccgggatcgggggaccaccaggttgcctaaggagggggttttgtgggtga

SEQ ID NO: 518278 - DNA, 524 bp, Homo sapiens
ccatgcccctcaaaggacatatgtccacaattcctatgtcctgtgatcgtgccacgtactgatattgtcactctacgcaagctttcctgaacaaaatctcgctgaaagagctatatcgcggactccatcatctccttgttactgcatagtgcatagcttcccactgtttgaccggtgagtaatggacacacccactttctctctgacaagcctataaagtgactctttgtctttgagacagagtcttgctctgtcaaccaggctggagtgcagaggctggatctcgggtcactgcaatctctgcctcccgggttcacggccattctcctgcctcaggctcccgaatagctgggactaccggcccccgccatccacgtcccgctatgttcatgtatttggagtagagatggggttacaccatgatatccagagatggtctcaatctctctgacctcatgatctgccctcctcggcctccccaaagtgctgggattacaggcgtgaaccacggcgcccgggcgtgc

SEQ ID NO: 518279 - DNA, 240 bp, Homo sapiens
cgctacccaggtccggcctgctactattcacccatagatgtggcacccgcttactaactccacctgttagacgctctgtgtttgccggaatgactccgtgcagtctccactccccttctttagtcaaggcagcaagcattcaatcctaggttagcatgcattatttttcaaacacacacactactacaaccattgcatcacgcaaaacagtggcatgaacagcaaatgttcccagcattg

SEQ ID NO: 518280 - DNA, 166 bp, Homo sapiens
agccgttggccactgtcccttagcctgactcagccctagcacaggcggctgcggacgcctgcacagtaccaggtggtgctgtccgagagctgcaggccctggtgaacagtctgtgtgcggggcagtccccctagagactcggagcggggctgactggaaaacaaca

SEQ ID NO: 518281 - DNA, 141 bp, Homo sapiens
gggcccaccacttatcacacaggtacggcttctctccagtgtgaatgatgatgtgcttggacaggtcccccacgtacacgcaaggcttgctgcacacgcttgcacttgtgtgggcggctgtcgtcgtgctggcgcaatatg

SEQ ID NO: 518282 - DNA, 114 bp, Homo sapiens
tggttcatccacgttcttctgggaggggggatgtcagtaatagtctaaaaccttcagggcttacaggagtcccttctccagatgtcatgagtgcggggttgaattcttgatgta

SEQ ID NO: 518283 - DNA, 657 bp, Homo sapiens
  misc_feature (555)..(555): n is a, c, g, or t
  misc_feature (657)..(657): n is a, c, g, or t
cagaaagtgaggaaatttggaaggctcatgagactcaatgataaatgcataaaattactttgtaaattgtaaattattattgccatattaaattttccattttcttattgctattgctattactactatcacggctactacagttaatattgaggttccatagaccgtgaatctgaaaagtcctatttgttcatgagggtgtagtactgtgtccggaattggtgggttcttggtatcactgagttaaagaaggaagccgcagaccctccaggagagtgttaacagttcttaaaggcggcacgtcccgagtttgttccttctgatgttcggatgtgttcgaagtttcttccttctgatgggttcttggtctggctagctcaggagtgaagctgcagaccttcgtggtgagtgttacagctcataaaggcagtgcggacccaaagagtgagcagcagcaagatttattacaaacagcgaaagaacaaagcttccacactgcggggcgatcccagtgagttgccactgctggctcctgcagcctgcttttattccttnatctgtccccacccacacccttctgatcggcccattttacagagagctgattggtctgttttacgagctgattgttccattttgacagggtgctgttggtgn

SEQ ID NO: 518284 - DNA, 159 bp, Homo sapiens
gctcaaataactttactcactgttgcttcttatgattaaactagctctgaatgttgttggttgggcctcttgtctttcctggttaactattagccttttattattacattttcaacctttccctgtaatggggtttgtgtaccaagggtctctaagaga

SEQ ID NO: 518285 - DNA, 1249 bp, Homo sapiens
gtcggagccgagccggactggtcaggatgatcacggacgtgcagctcgccatcttcgccaacatgctggcgcgtgtcgctcttcttgcttgctcgttctccctccctccttgcccccccccacctcccccccaccgcacggacactgcacgctgcgctgcttctctcctgccccagcggttccacggccacataagctcctgcagcgcaagactgcgcacgcggctatgcacgcgcgcgcgccttccacacatctccacctatcccactacccctctcctactccgatccaaccacaccataccaacagccaaacctaaccacccccttgggactcatactatctcaaaaaccaaacccttcttcacctatataccttccacccacgctcttcccccctctaacactccctactcgcgacaccaaccaggaaacgccttgcccacccttgacactaaggagagccccatcctaacttaatcgagtagcgccttcttgtcctactatcacacattaaccttccaccacttctcctcactcgcaacaattacttaaacacaccacacttactaaacgaaacccatctagctaggaaccatcccaccaccaccacaccaccacatcaccaaacaacaccgcatcactacctacacacacacagcacgaccgccgtgtcgcagctcacgacaccaacccgaaacaacaaacgaccgcccgcacctcacgagaggaccaagacgacgcgcagcagcagatggagaataggacgacgcaacgtgatgaaacaaaaagaaggagcacagacgagcagtgaggtagtatcacaggaagagagaacgaaccaaaagagaggcgtcagactaagactacgggagcaacacagatggggaggaggcgaatcagcctcacccaacagcggcagacacacaaacacagtaggagcccaatatcacacaacaatgaccaggcagacgaggaggaaaccctccagcaacacacacactaaacataaacacataagtcgctcctcatctcttttacaaccttctaccccgcttcgcccctctctaatgcaccacaacacatcacctcttctcccgccttacgtacatatctacctctctcacacgcgtctacacatactcctattaactgttctcatcataaataccacaaccctaatcaccctctcccacacaacctcactactctcttctatcacctcctacctcacacattctaccttcacc

SEQ ID NO: 518286 - DNA, 373 bp, Homo sapiens
  misc_feature (67)..(67): n is a, c, g, or t
  misc_feature (90)..(90): n is a, c, g, or t
  misc_feature (251)..(251): n is a, c, g, or t
  misc_feature (290)..(290): n is a, c, g, or t
  misc_feature (339)..(339): n is a, c, g, or t
ggtaaataaattgaaagtaagggctgagaaatttttgtagcaatttgacattgctataatgtccaanatttctaatattttatttttatngtatctgacgaaatatccatatgcaatggattcgaaataaagaaaaatctggtccttcatcagaactaggaatgcactgatttaaacatttggtcagacattctacattgagttagtatgctgtgtgggctggtctactgctgaagagctgtatccatgtngtgatggtcaccagttagtgaagtggtccttgttaaccngtgaacaaactcaagtagtaacgcttcctgctggtaatttaccctattnggtttttcctggttcccaaaaagttttgggtgta

SEQ ID NO: 518287 - DNA, 129 bp, Homo sapiens
gtcctcctcctgctgctgccctcatccctccatccctatgccatgttcccaccttggtatgctatgcttgggcgcctggctcacgaggttggctggaagtaccaggcagtgacagcagcaggaggagga

SEQ ID NO: 518288 - DNA, 175 bp, Homo sapiens
gaattcactagtaattagcatgcttcctaggtagtggatctgaggctacctatagaacttcctttgcagtcataattcgctcagaaactacaaaagtgcttgctcttgaaaatggagtctgtctttgtccatttcatgcttctataaaagaataccacagactgcataatttatg

SEQ ID NO: 518289 - DNA, 340 bp, Homo sapiens
gtgaaccctggaccaccagcctctctgagtgggttcacaggataccataaaacatttcggaagcagatagaatgaatcttggtttctttgtgaccagcacatactatagtcactgtaacttgcttagagggaaatacacatttaaaaacaaggggctggcgagatggctcagtgggtaagagcacccgactgctcttccgaaggtccagagttcaaatcccagcaaccacatggtggctcacaaccatccgtaatgagatctgactccctcttctggagtgtctgaagacagctacagtgtacttacaataatcaataaataaatctttaaaaaaaaaaa

SEQ ID NO: 518290 - DNA, 175 bp, Homo sapiens
  misc_feature (138)..(138): n is a, c, g, or t
gagcaagactctgtctcagggggaaaaaaaagaaaaggttaaaatttaggccgggagcgtgtggctcatgtctgtaatcccagcatttggggaggctgaggcaggtggatcacttgaagtcaggagttcaagaccagnctgaccaacatggcgaaaacccatctctactacaaat

SEQ ID NO: 518291 - DNA, 273 bp, Homo sapiens
gtcctatagtcctagctacttgggaggctgaggcaagaggatctcttgagcccaagagttcaagcctgcagtgagctataatcacgccactgcacttcagtctggtcacaaagcaagaccctatctctagaagagaaaaaaaagacatatacttcagttcatctaaaatataggtagagtaaaatcagaagcacctagtctagatgttctagattcagtagagacctcctctctttgtctctacactttctcagatctagcagtattagggct

SEQ ID NO: 518292 - DNA, 242 bp, Homo sapiens
  misc_feature (17)..(17): n is a, c, g, or t
  misc_feature (37)..(37): n is a, c, g, or t
  misc_feature (118)..(119): n is a, c, g, or t
  misc_feature (121)..(122): n is a, c, g, or t
tatgcatagataatctnctccattcccgtgaacgttnttcctgttcttaagacgtgattttgctgtagaagatggcatttctataccactttgggctttggttataagtgccatcttnntnncacaaaaatccaagtggtatagaaatgctggtttttcagttttcaggagtgggttgatttcagcacctacagtgtacagtcttgtattaagttgttaataaaagtacatgttaaacttaa

SEQ ID NO: 518293 - DNA, 227 bp, Homo sapiens
cggcacgaggctgaaattcaaatttcagtcatgtgatttgaaagggggtcatgtttctgtttgtcatgtgtaacagtggccaaatatcctatgagttcctaggggctctgggttccaaagttactgtgttacatttaccttcaaacctctatcattttatctgtcattctgaaagaatcgctttattttgatcttcttgattaagaacatgaaacatgaccattgca

SEQ ID NO: 518294 - DNA, 145 bp, Homo sapiens
ctgtctagaggatccggctagttgtgctcagtgagatagtcagctcgagtggctccgtgtcgtaacagcaggagcatggcgcaacttcccaggccgaggaagggccccggctcggcctcttgagagccccacccctgacaacggc

SEQ ID NO: 518295 - DNA, 436 bp, Homo sapiens
  misc_feature (42)..(42): n is a, c, g, or t
cagagttgccttccttcctaaggtcccacttgcacgcacaanaatagttcctaccatcaaggcagagtggctgctctcagagcactggtctgtgagctgctgtgagcctctacgttggcagtgtctgtccttacaacaaagcacaaggcaggcattttccttcttgctaccttctcttcacagatgagtaaactgaggctcagacacagcaagcagaactggctggtattagaatccaagtctgcctgagcccaaaggcttattctatcttccacatcaaggatactcttgggcagaccgttcatcagtctcaaggtcattgctatcatcaacagccaatatctattaagtacctagtgatggtgagagagatcagaccaggtactcaatgcagattggcggcccagggctgcgctaagggcaggcacagagtggc

SEQ ID NO: 518296 - DNA, 175 bp, Homo sapiens
  misc_feature (141)..(141): n is a, c, g, or t
tcagcagcacatttccaggccacgggagcccatcccggccccagagcccagaaaaacgcatcgtctgccggccaaaagttgtcgtcatcgagaggccagaatgctgtcggcgcttcgcggatagtactcgcatccgcacantccgagccttcgaccgtccctttccaggcgacag

SEQ ID NO: 518297 - DNA, 1273 bp, Homo sapiens
aggctggtggtcccccgcggggatatcgtcgctgctcgccgcccactgtgctcccgtgggttttctcttcttccgcagagtgtccccgccccagcggtggcgccaccttcggaatgttgtgggcgtctggtcccctctcgtgtgggagtgccccccgccgctccctggcctcatcgcccggggggctccgcgattgttatgaccgcctttttccgccgccccgctggtgggtccatcgggcggtggtgtttctttgttatccgccgcgtgggtgtgttttcggggcagagatggtgtttccgcacttggtatgaagggggaagggcgctttcctgaagtatggagtggcccacagagtatgtgtgctctttataaatcgcttgtgcaactggttagtcccacaggtgtggagcccacagcgcacgggctagtaacgtctttggtgtggggagatattgtgggagatttccctgcccgccctccaccacattgtgtctctcagcgaagacacaccccccgctgtcttcgtggaggaccactttgttctccacacccctctcgtgtgggggcccttctcccacgagtttggcgcacagctggtcacccccctgtttcacattttggtggcccacctcataatgggccgcccacggccccgcacttgctctccccgccgagggggctcctctttttcacaaagggcgcgccacaatctctctgggagagccacgggttttctcaccctgtcccacatgtgttctctcgccccgcgggagagagcgccccttttctccctctcacacttgtggtaacacccacgcggcgcacaggggccacatgtgagacgcaaagagatgtgagaatgtctcacccgagagggctcgagagagggcacaacacatcgagaacgagacctctcgtgtctctctgagagtgaattcacccccgctatccccacgcgagagggccccaccgccacagagaagaaggagaggagaggagattttcgcgttgagaggaagggcccgcagaagaaggagaggcgcctataaggcacgagagcccccacttaccctccacaggctgtttgcacagtgttcccctaagcccttttatactcacagctgcccctcttccttctccctccacgaaatttgtggtgttgctgccttctatttcttgtgtttttgtgttttttttttctggggggggtttatggacacgtgcctggcacacacatagtaaggcgccccactaataacttgtttgttga

SEQ ID NO: 518298 - DNA, 271 bp, Homo sapiens
cagcaggtaatcagactcaatcttatcagaaagcttatccataccacatgaacccaaattttatctcatgctcaacaaataaaatcagctgggcatggtagatcaggctggtaatcccaacacttagggaagccaaggcagggggattgcttgacgccaggttggagaccaccctggccaacaaagcaagactccgctttgaaaaatataattcgggtgggcacagtggctcacgcctgtaaatcccaacactttggaaggccacggcggg

SEQ ID NO: 518299 - DNA, 1551 bp, Homo sapiens
  misc_feature (13)..(13): n is a, c, g, or t
  misc_feature (18)..(18): n is a, c, g, or t
  misc_feature (34)..(34): n is a, c, g, or t
  misc_feature (101)..(101): n is a, c, g, or t
  misc_feature (104)..(104): n is a, c, g, or t
  misc_feature (153)..(153): n is a, c, g, or t
  misc_feature (176)..(176): n is a, c, g, or t
  misc_feature (205)..(205): n is a, c, g, or t
  misc_feature (209)..(209): n is a, c, g, or t
  misc_feature (222)..(222): n is a, c, g, or t
  misc_feature (227)..(227): n is a, c, g, or t
  misc_feature (255)..(255): n is a, c, g, or t
  misc_feature (307)..(307): n is a, c, g, or t
  misc_feature (309)..(309): n is a, c, g, or t
  misc_feature (319)..(319): n is a, c, g, or t
  misc_feature (333)..(333): n is a, c, g, or t
  misc_feature (384)..(384): n is a, c, g, or t
  misc_feature (436)..(436): n is a, c, g, or t
  misc_feature (445)..(445): n is a, c, g, or t
  misc_feature (455)..(455): n is a, c, g, or t
  misc_feature (470)..(470): n is a, c, g, or t
  misc_feature (538)..(538): n is a, c, g, or t
  misc_feature (568)..(568): n is a, c, g, or t
  misc_feature (637)..(637): n is a, c, g, or t
  misc_feature (767)..(767): n is a, c, g, or t
  misc_feature (779)..(779): n is a, c, g, or t
  misc_feature (871)..(871): n is a, c, g, or t
  misc_feature (879)..(879): n is a, c, g, or t
  misc_feature (889)..(889): n is a, c, g, or t
  misc_feature (903)..(903): n is a, c, g, or t
  misc_feature (1015)..(1015): n is a, c, g, or t
  misc_feature (1059)..(1059): n is a, c, g, or t
  misc_feature (1129)..(1129): n is a, c, g, or t
  misc_feature (1149)..(1149): n is a, c, g, or t
  misc_feature (1332)..(1332): n is a, c, g, or t
  misc_feature (1365)..(1365): n is a, c, g, or t
  misc_feature (1537)..(1537): n is a, c, g, or t
atgatgaaataanaatanatatgtaaaaaggaanagaatagagagagaagagatgtagtatgatggaggcgaaacgtagagagagagagtaagtagtgagnagnaaggagatgtggatatgagggtttatgtgtgttggtatagtacccatgngcgagtgtgctgtgtgagatgtntggagagtgaggtgtagatgaatacccanaatnatataatgaatanagagnaagttacatagagacgaaggagaggganagatgttatgaataaatctacgtaaaaatacatgaaagaagatagtagagancnagtgattacncatatgacgtatgnagatgtagtgacatactcgtagcagagtgagggaggagtcggtgagtgatngtagatgtattcttgagatagatcactacgatcgtagtgctagagtactacncagatgatngtatgggacncgctaagacggagcnagagagagtggatgcgcgagagcgagagagtgctagaagaagcgtgcgtatgagggcatgagtacacnaatgagtacgtcagcacggcgaggtacganccaatgtatcactggacagcgatacgagctcgtgtgctcgagacgttaatatacggacgcagagtggangatgaggagagatgaggagcagtgtggtgataggattatacagagaaaatctgagacgatgataagacatatatagattaacataatatcacgcgattagtatagattaagtatatagaactaacaaganatcactagacantcaagacagtaatactctcaggagctcaatatagtaagatagagtagatagagggaccatgcgcgtgatgtaacgtatcgtagatgtacgangaattatngagagtgatntcgatggtcatgcngcggttatcgattgatgtgtatcacgcatacacgcgagtaacgaagagaagtatgagataatagtaagtattacgcagagcgtgagatacgcaatgaatagatgagagaatngataatcagctagaatctacagcgacgactatcgccgggacgantaacagaagctgcgagcaagaaccagaattgagcgaacaaagcaataaattataatagatagtagagagntagtgatagagatataagangctatatagtagaagtagataatgggatgaatgagaggagaagaatggggtaagggaggatgatggttaatgtcatagagatcggcaagatgtaaccatacgcatggagacgtaatgaacgcagccagccacgctggcgcgtacgagaatgctacgaaacggatgtgacgagtacggcacagngatgggacagcgagcgttagagaaaagtaagcncaagactcgacataaactaacgacgtcgagcacacttcaagataacattatattagcgtatacacacaataatatatgatgcgtagttgagtcgagatagagagtagaagaaatatactagaacaatatcgaaaaagtgataagcaattcacataaatgcattgaattgcanaacaacaaataatg

SEQ ID NO: 518300 - DNA, 481 bp, Homo sapiens
ggtttgcagatctggtgacttatataaagcttttgtgattcctactaagctttaagatttaaaaaatgttcaattgttgaaatttcgttgtggggctctattttggcttgtggcgttcgtggtgagagagtgaggaagcattctttccttcactaaaggttgggtccttttccgttgttgttcggttatcctgggggaattgaggcacattttgcgggaatttagtttgtacacaacgggaaaggcaactttaaagaggggggaaatttttgacggaaaaatgttaagagagccattttttcagtccattcgtggcggtgggcaaacaggcagcatttttacaggactgggttatagggggctgtggcgcgggtgacgtcacatctggtaatcccagcacttgggggaaggccaaggcacgggcaggaaccactttgaagggacgtttcaagaaccaagcgttggcccaaacggtgggtgg

SEQ ID NO: 518301 - DNA, 1094 bp, Homo sapiens
  misc_feature (555)..(555): n is a, c, g, or t
actaccatgcccactatgtgtgaacgttctgagaatgatcgtgggttgtagctgggtctctactcatagtttgcgtgagcgtgaccgcgtacgatatagcgcgcgtgcaatactctgaggcttgcgtgctataacggtgagtccctttacctggtacgaacagtacgcgtgtggctcacttgtcgacaccgagtgacaaagtagtcctcacacctatcaggactagatagagacgacaatgactcgcgtgtggtgaatctaactgagtcatgaacgaaataggaatgttagttcacttcgttacgtcttcgtctatgctcttgtggcacgaggtttgcaatacctcgtgtccatggaccaggtctttctgtgtctcttgacctggacttagtctctggaatcccatagggtttccccataaacatatgtgcctaccttcgtgtagatacgcaccttagtatatttgcagagcggatacggttgccgtacggttgcgtcgactctgtgggcaggaacgctggcaagaagagatccgacgaaggaggaaagcacaantggtagccaattaggattcgcactggttatgcaatcgcactatgtgtaggagcccatcgcgatggtacgtgacactgtattcacccgatggcgtaccgtataatcagtacgagtgtctatgtaccttccgggcatcaaatgcgccagaggaatcaacaaaaaaatgcgacagagcacgaacccgcgacgtaatgtcgccctggctgatagaaggaagactgcctaacagagtgtgtatttccacaacacgtaagtcaatacttaaaaacctggtagtctatgtcgtatcgtctcggttcactacgtgtaatacctgtcaatgccgggagcctacaagtgctttactggcctcctacgcgcacgtaagcgccgagacatcttggtgatactagtgagcgggagttgagtcaataccgtcgtgtttctgtgtgtcacgttcgaacagagacgtattgacacattgaaagtcttggtagtcaactagtatacacacataatgcacagtaagttgttgccagtgcaccaccatacatatgagg

SEQ ID NO: 518302 - DNA, 209 bp, Homo sapiens
ggcccacctgccccataacgtgctgctggtctgggcagttgttctgtttgtgctgtgtgtgcgtgtgctgtgcgttggtgtgctgtgtgctcgtgtgtgtgctcgtgtgtgcgtgtatgctgtgcgtaagtgtgtgctgtgcgtcagtgtgtgtgctgtgtgtgcatgtgtgtgcgtatgtgtgccgcgctatctgatagagcaggtgg

SEQ ID NO: 518303 - DNA, 587 bp, Homo sapiens
ctcaacgctttatacttcatcatgtttttggacacaaacattcagaccatagcagaggccttggagaatggctgggaaagacagtattggaggagggttgttggatctataggctgggaattcagggcagggatctgggccaggaatgtatgtagaagatcattgttgtatagatgattgttgaaaacatgggctggatgaggtctctcaaggagagaggatgcagagggaagaaaagaggacgtaaggctgatgtttgagggacaaaaacatgatgaagactgaagaggagagaccaaacaagtaggaagaaaaccagcatttatgctgccaagaggacaaataagataaagacagaagcacttcggtggttttagaagcaaggaggcccttgggaatcagtaagccttgttccagtggagtgaagcatctcccagccagattgcattctatagagaagaccagggtaaggaatacgaacaggaatacttgaatataaacgttctttttgagaaatttaattctgaagaagaggagaaaattatgttaatagctggagaagtataaagcgtggaggggtaccgagc

SEQ ID NO: 518304 - DNA, 2129 bp, Homo sapiens
gtaagacatgacttgttcctctttgctttccaccatgattgtgaggcctcctcagccacagagaactgtgagttcattaaacctctttcctttataaattacgcagtttcgtgtatgtctttattagcagcacgagaacaaactaatacagtaaattggtaccggtagagttgggctgtaaagatacccaaaaatgtggaagtgactttggaactgggtaacaggcagaggttggaacagtttggagggctcagaagaagacaggaaaatgggggaaagtttggaacttcctagagacttgttgaatggctttgaccaaaatgctgataatgatgtggtcaatgaaatccaggctgaggtggtctcagatggagatgaggaacttgttgggaactgaagtaaaggtgattcttgctatgttttagcaaagagactggcagaattttgcccctgccctagagatttgtgaaactttgaacttgagggagatgattttgggtacctggcagaagaaatttctaagcaacaaagcatcaagaggtgacttgggtgctgttaagaccattcagttttaaaaggaaaacagagcataaaaattcagaaaatttgcagcctgacaatgagacaggaaagaaaaccccattctctgaggaaaaattcaagccagcggcagaaatttgcataagtaacaaggagccaagtgttaatcaccaaaacaatggggaaaatgtctccagggcatgtcagaggtcttcatggcaggccctcccatcacaggcctggaggcctaggaggaaaaaatggtttcgtgggctggccccagggcccccctcctctatgtagcttagggacttggtgccctgtgtctaagctgctccacccatggctaaagggggccaaggtatgtacagctcaggctgttgcttcagagggttcaagccccaagctttggcagcttccatgtgctgttgagcctgcagatgcacggaaaacaagaattgaggtttgggaacctccgcctagattacagaggatgtatggaaacgcctggatgcccaggcagaagtttgctgcaggggtggggctcttatggagaacctctgctagggcagtgcagaagggaaatgtgggtttgcagcccccatacagagtccctactaaatgctagtccatggaagcatccaggagggaggctgtaccctgcaaagccacaggtggggagctgcccaaggccatgggagcctacccctggcatcagcatcacctgggtgtgagacatggagtcaaaggagatcattttggagctttcagatttgactgccctgctggattctagacttgcatggggcctttagcccctttgttttggccaatttctcccatttggaatgggtgtatttatccaatgcctgtactctcattgtatccaggaagtaactcacttgtttttgattttacaggctcataggcggaagggacttgccttgtttcagatgagactttggactgtggacttttgagttaatgctgaaatgagttaagactgtgggggactgtcaggaaggcatgattggttttgagatgtgaggacatgaaatttgggaggggccatgggtagaatgatatggtttagctgtgtccccatgcaaatttcatcttgaactgtagctcccacaattcccctgtgtcatgggagggacccagtgggaggtaattgaatcgtgggggcgggtccttcccatgctggtcttgtgataatgaataagtctcacgagatctgatggttttataaagaggagttcctctgcacaagttctctctctttgccttctgccatccatataagatgtgacttgctcctccttgccttctgccatccatataagatgtgacttgctcctccttgccttctgccatccatataagacgtgacttgctcctccgtgccttctgccatgattgtgaggcctccccagccatgtggaactgtgaatccattaaacctctttcctttataaattacccactctcggatatatctttattagcagtgtgacagcagactaatagagggattaaagataaaaattttggctggatgcaatggctcacgcctgctatcccgctat

SEQ ID NO: 518305 - DNA, 109 bp, Homo sapiens
gcggccgcctactactactactgctcgaattcaagcttctaacgatgtacggggacatgctactacactcctgatcggcgacagagtgagactgtatcaaaaaaaaaaa

SEQ ID NO: 518306 - DNA, 87 bp, Homo sapiens
ccagagagccctgagcagcctgccggcgagctacagaaggtcatcgctaccgcaggttttgggtacagtaaaatggttcaatataag

SEQ ID NO: 518307 - DNA, 332 bp, Homo sapiens
ggggggttctctctctgtgggcgggggggggcgcgggagaaattttgttgaatgttttttaattggggggggaaaaaagggtttcccccccccccccccaaattttttttttaccccccctttttttgttttttgggtttggggggggcccggcccaaaaccccccggggaaaatttttttttaaaaaaaaaaccccctttttttgggggggggcctgggggggggttttttttcccctttcccggggggggggcaaaaaagttttttttgggggccgtttttttgggttttttttttccccccccctttttattttggggggggggtttta

SEQ ID NO: 518308 - DNA, 181 bp, Homo sapiens
taacagaagaaaggaatgtaggttttgggacagacgctgctgggggtgcgatgagaagccctagccccctgattggtgttgtgtatcggaaaagaagggtcacttgttaaactcatgctcctgctcgtccttcttgatgacagtcttgtatgctttctcgaagtccttggcccttatcgag

SEQ ID NO: 518309 - DNA, 375 bp, Homo sapiens
ttcattttgctccctagctcaaaaataacccagtgttacatacctggattcgtatcacaaactcaatgggttacagtcaacattgctggggtgggaagtgtgtgtgtattcattttgttccctaaaagagctgcagggcatgcattctaacgaatttgctaaatggccaggagtccatagagtttgggaaagttagaaggtggcctcaagaacacccagggaccggagacacacacataagaaaggggagttctaggcaggccctggtgactcatgcctataatcccagcaccttgggaggctaaggcgggagaattgcttgagcacaggagttcgagaccagcctgggcaacatgacaaaaccctgtccctaca

SEQ ID NO: 518310 - DNA, 420 bp, Homo sapiens
  misc_feature (31)..(31): n is a, c, g, or t
  misc_feature (46)..(46): n is a, c, g, or t
  misc_feature (202)..(202): n is a, c, g, or t
  misc_feature (233)..(233): n is a, c, g, or t
  misc_feature (242)..(243): n is a, c, g, or t
  misc_feature (246)..(246): n is a, c, g, or t
  misc_feature (264)..(264): n is a, c, g, or t
  misc_feature (302)..(302): n is a, c, g, or t
aaacccccccccggggggcccgccccccaangtgcaaccaacgggncaaccgcggcttcgtttaaaaactttttgtgaaaaatgagtgcgtttgtacgggaatgataaactttttatttaattcacaagaagcgtgtttgattgccgctgtgggttcgtggctggacctgcccagagccctgtgcccgggggacacgtaggnccgcgcgtgaatgggacgggttcccacacgnacaccctcnngcncttgccgttcccgacccngcctgggttccggggcctgcgtctgtggaaagggtccntgtgcgcacaacggtgaccggcggctcccgggcgcctcagtcctggacaggagcctccaccacaggctgtgtgaatgttttgtgtaaacgtacaaaaccgtttctggcgatcacgaaa

SEQ ID NO: 518311 - DNA, 264 bp, Homo sapiens
tctggccaccgaggccggtagatcgcttgagcccaggagttcgaagactagcctggcaacaaagtgagattccccctcctctctctgaaaagtaaaaaaaaattagccggtcatggtggcacatgcctgtggtcccagctaaatgaaaatctgaaggaggtggatctcttgagcccaggagctcaaggttgcagtgagccatgttcgcgccaccacactccagcttgtgcaacagagaccctgtctcaaaaaaaagtcatctga

SEQ ID NO: 518312 - DNA, 137 bp, Homo sapiens
gaatgggatcttccagcagtccgcaggtgcgcaactgagcgaggtgtagggacactattaggtatggtagataccgtcgagcgcccagatcaattcgcagacacatagctacgcccagtaagaccaaaacctgcggt

SEQ ID NO: 518313 - DNA, 536 bp, Homo sapiens
  misc_feature (110)..(110): n is a, c, g, or t
  misc_feature (203)..(203): n is a, c, g, or t
  misc_feature (225)..(225): n is a, c, g, or t
  misc_feature (240)..(245): n is a, c, g, or t
  misc_feature (261)..(261): n is a, c, g, or t
  misc_feature (265)..(265): n is a, c, g, or t
  misc_feature (446)..(446): n is a, c, g, or t
  misc_feature (516)..(516): n is a, c, g, or t
  misc_feature (528)..(528): n is a, c, g, or t
tgagcctggagaaagttcttgtggattcagtcacaggagttgtttgatgtctataacaagctagagactatacaagcacaggggggggcccttacatgatgttttcgaanactgtttttttcatcacgctcctgccacctcattattttgcattgaagatacattgccaggttgtgttttctgaaggattcagtgacttgctntctgtaaattatatggcttatnacttcttagacaaannnnnnccatagagatcattgntaanaatactgaggttctaatatactttctttagttctgtgagccaacagtaattattaagaacactttccctttaaaggaaacaaaagtgaagaccagattgttttaactgtcatagtgttgctttcttgcctgtcctgcttagttttaacccccccccccaccccaaaaagaacaaggagggngattggaaacaagataagatgtgacttagttagaatacagagctttggtaattacatcaataaaattaanaaaaaccccaanaaaaggga

SEQ ID NO: 518314 - DNA, 928 bp, Homo sapiens
agtgccgcgggactcttgggggtgaaggtgtgtgtcagctttggcgtcactcgagccctgggcgctgttgtaaaggagccgagcacgcgggtctgtcatcatgtcgcgatacgggcggtacggagagagaaccagaggtgtatgtgtggtaaccgtgggaacgtggcgctggcaaaagggagagttagaaggggcttcatcttataatgggtcctttaaagaatgtatggaattgggagaaaatcctccaggatttgggcctttgtgtggaattcggaaagatcctaaggagatgcagaaagatgcaggtacgaggacgtgatggaccaaggtgattgtgttggcttcccgagtgagcggttgactctatcgacaggcaatgcctcgggaagatcactgtgtgtgatagaccacttgccctgagtgtctcttttgattccaaattgatagatgctatgagtgtggcgaaaaaagggacatctatgcttaatgatggtcatctgttacagcctgggggaaaaaaacaggcaggtcccgggtctagatccacattctcgatccagaggaagggatactctcgcttcacgcaagagggagccagcggacgaagctcagggtccaggcatctcctcgaagatcaagatctatctctcttcgagatcaaggtcacgttcactcagaaaaatctaggggtgggccatcaaagggcagggtgatttccaacccgggagtgaagtccaatcccggttatttagggcaagaagaggggaaagccaattccatttcaaaaagtgggccctagagagttccgaagagagctgggaagttgtacaacctccgtgagaagttgggttccatcacgcgggtgggcgccaaaataccatgggttgagcaccggaatgtgtctccgggcgcagccagtgtgcac

SEQ ID NO: 518315 - DNA, 216 bp, Homo sapiens
gctttcctttccctgacacagccccagaccccccaaagccttttgggcctggaaagcctggggaaggacttccaaacccccggaccagccctggggctcagggcaccccccccgggccgctgaccgattgacctctcctcccgggggcccagccccaaagccccagggctggcccgtttggggcacctgccccataaaccctgatggtgtgtttta

SEQ ID NO: 518316 - DNA, 830 bp, Homo sapiens
  misc_feature (16)..(17): n is a, c, g, or t
  misc_feature (23)..(23): n is a, c, g, or t
  misc_feature (27)..(27): n is a, c, g, or t
  misc_feature (32)..(32): n is a, c, g, or t
  misc_feature (34)..(35): n is a, c, g, or t
  misc_feature (246)..(246): n is a, c, g, or t
  misc_feature (275)..(275): n is a, c, g, or t
  misc_feature (315)..(315): n is a, c, g, or t
  misc_feature (379)..(380): n is a, c, g, or t
  misc_feature (391)..(392): n is a, c, g, or t
  misc_feature (406)..(406): n is a, c, g, or t
  misc_feature (413)..(413): n is a, c, g, or t
  misc_feature (461)..(462): n is a, c, g, or t
  misc_feature (520)..(520): n is a, c, g, or t
  misc_feature (536)..(537): n is a, c, g, or t
  misc_feature (558)..(558): n is a, c, g, or t
  misc_feature (561)..(561): n is a, c, g, or t
  misc_feature (564)..(564): n is a, c, g, or t
  misc_feature (569)..(569): n is a, c, g, or t
  misc_feature (575)..(575): n is a, c, g, or t
tcggcacgagggcggnntgtccngcgncttgntnnagtggactccgcgggccttcggcagatgcaggcctggggtagtctcctttctggactgagaagagaagaatggagaagcccctcttcccattagtgcctttgcattggtttggctttggctacacagcactggttttctggtgggatcgttggctatgtaaaaacaggcagcgtgccgtccctggctgcaggctgctcttcggcagtctanccggctgggtgcttaccagctgtatcagnatccaaggaacgttggggtttcctagccgctacatctgtnacttttgtggtgtatgggaatgagatcctactactatggaaaattcatgcctgtaggtttaatnngcaggtgccanntttgctgatggcgncaaagtnggagtcgtatgtggatgacatctgattagcagaagtcatgttccagcnntggactcatgaaggattaaaaatctgcatcttccactattttcaatgtattacgaganataagtgcagcatttnntgcatctgacattttacctanaanaanaaaangacccnaaatttggggggggtgtggaaaaatcagtggtgttaccattaataaccctaacaggaaggtggtgagcatgtaatatgagctttttggagaccatcatagagatcgatcttgattatgatatctcttcggaacctaagggaactctcaagggtaacaggtcggtggtggcttggaaactgaaaccattcctggtcgaggaatgtggaaaaattttgggattgaatttttttggtttgaaccaggggtgaatttgg

SEQ ID NO: 518317 - DNA, 1004 bp, Homo sapiens
cagtgcccgccaaaatttgttgcccccctatgataaactacaccgcgttgttgttaaatgaatagcgccccctttggaatttgttatatcagccgccccctcctcgtaaggggtgtgcccgttctccccgctcctgaaaagatgtatgtttgaaccctccgttgtgtgaatggctcgaccacttgtcaccacaaaagcgaggggtggtcccccatctctctagaaggcttcttcgtagaacccgggtcttataacttacaagaatatattaatcgcgcggtcaattgcagaaatctctcgattataatccctggggcgggagattgctctctcccccgccttgtggtacccaccgccacgagagttcacccccgtgctattttgcctgctcacaaggtacataaaggcccctccctgagaacgccaacggggttctgtcaataaaaaaagggttgcccccgacgtctaatatatgtttggggcccccccattatgctcccacatcgttagttaattgatctgccgccgcggtagtcaaaaaagggtttcttgtgggtagtatacctgttacaagcggacccaccttatctgtgtgtgggcttataaagtctggttgatatcttaaagaggctagtctcaaccccctctcgcacactttttcacacaggtctataaagagtgacaccaactacgccctgtttacagaagatccgtggtccacgctgtacctccgcacgctctctcatagttatttctttcgacacacctttagtgccccacacctcagacactgtcacactaattttagggcgggttgttgttcttttagcacacagccaccttcccatgaatccacaaatccgtgtggtgagcccgtgttatctttgcagattcggggggaattaggtggatttgctgcccacactcacaacagaaaggtcaacaatcgaaccagggaaaaacccccatcgtaaaataacagggggcaccaggacccacataaa

SEQ ID NO: 518318 - DNA, 164 bp, Homo sapiens
tgccttctccttttggcaaccatggttatcaatcctttttctgttttagtgtcttatttcggctttcaagtgatgggctagccaaagatgacatctctgagattaggagactggggagagcttgctgcttattctgactgtgctgattttaaatgtctggatat

SEQ ID NO: 518319 - DNA, 863 bp, Homo sapiens
  misc_feature (108)..(108): n is a, c, g, or t
  misc_feature (143)..(143): n is a, c, g, or t
  misc_feature (200)..(200): n is a, c, g, or t
  misc_feature (202)..(202): n is a, c, g, or t
  misc_feature (208)..(208): n is a, c, g, or t
  misc_feature (222)..(222): n is a, c, g, or t
  misc_feature (226)..(226): n is a, c, g, or t
  misc_feature (301)..(301): n is a, c, g, or t
  misc_feature (327)..(327): n is a, c, g, or t
  misc_feature (331)..(331): n is a, c, g, or t
  misc_feature (335)..(335): n is a, c, g, or t
  misc_feature (340)..(340): n is a, c, g, or t
  misc_feature (348)..(348): n is a, c, g, or t
  misc_feature (362)..(362): n is a, c, g, or t
  misc_feature (377)..(378): n is a, c, g, or t
  misc_feature (381)..(381): n is a, c, g, or t
  misc_feature (385)..(385): n is a, c, g, or t
  misc_feature (387)..(387): n is a, c, g, or t
  misc_feature (392)..(392): n is a, c, g, or t
  misc_feature (414)..(414): n is a, c, g, or t
  misc_feature (421)..(421): n is a, c, g, or t
  misc_feature (426)..(426): n is a, c, g, or t
  misc_feature (446)..(446): n is a, c, g, or t
  misc_feature (448)..(448): n is a, c, g, or t
  misc_feature (451)..(451): n is a, c, g, or t
  misc_feature (501)..(502): n is a, c, g, or t
  misc_feature (510)..(510): n is a, c, g, or t
  misc_feature (559)..(559): n is a, c, g, or t
  misc_feature (573)..(573): n is a, c, g, or t
  misc_feature (599)..(599): n is a, c, g, or t
  misc_feature (611)..(611): n is a, c, g, or t
  misc_feature (626)..(626): n is a, c, g, or t
  misc_feature (629)..(629): n is a, c, g, or t
  misc_feature (663)..(663): n is a, c, g, or t
  misc_feature (683)..(683): n is a, c, g, or t
  misc_feature (699)..(699): n is a, c, g, or t
  misc_feature (715)..(715): n is a, c, g, or t
  misc_feature (741)..(741): n is a, c, g, or t
  misc_feature (765)..(765): n is a, c, g, or t
  misc_feature (780)..(780): n is a, c, g, or t
  misc_feature (785)..(785): n is a, c, g, or t
  misc_feature (789)..(789): n is a, c, g, or t
  misc_feature (855)..(855): n is a, c, g, or t
caagaaagatggcagtggcctgatccgggcccgttggcggcgtcactgacgcttcgctccggtcctcggatcccgagcgcggggaggcagacacgactgtgaagctgnttgttccccatcctgcggccgtcctggggacacanagccctccgtggtgacccggggattggattggagcaagaacatcacattcttcttcntnttcctntctcatgtcctccntccnagacacctgggccaaaaccactgcacgcccgccccaatgggtatggcccatgggttggctgatggcgttccaggntggggtcccctcaattggccttggcntcgntgcntgccntttgtgcntccttgtggggcantccttctgaatgganngcngtcntngatcnggccttgccaaaccaccaccgnccaccancgaanagaagagatagcccaaccangnganggagaactgagactcctgccccccacgaccaccctgaaaccgggggtganncctggganactggaccgggcaccctcaactcggcgggcttccacacaaggaaggtcnttccctagagcaanggaccctggggtggcctttgaatganggaccgccgganccgcgggcgggaacnganaggacacgcgtgaatcggtcactctttttccaangggtggaatggtgaaacacntgacccggaaagaatnagatgccaagggagantgcagcgcctggaatcaatggagaancacggccggagcgacttcccaggnaggcccatgggaggnagagncaancacacactttccgcggccgtgggaccctgcacgggggacggtcacgtgttcttggggacgagtatnaaggtgaa

SEQ ID NO: 518320 - DNA, 364 bp, Homo sapiens
aacatggcaaaaccccatctctacactaaataaaaatatacatgcagaacattagctgggcacggtggtgcggctatagtctgagctactcacgaggctgatgtatgaggatcacctgagtccaggaggtcgaggctgcagcgagccaagatggcgccactgcactccagcctgggtgagagagtgagacactgtcccaaggaaaaaacaaagtgatggggggaacgttcttaagcgctgaagatttcctttttggaaagtatttaaaggtagaaatattactaatttttcctaaaacatctcgctaagaagtcactgatcattatacccaggtcttgattcttacactacttgatttcatttg

SEQ ID NO: 518321 - DNA, 538 bp, Homo sapiens
  misc_feature (20)..(20): n is a, c, g, or t
  misc_feature (24)..(24): n is a, c, g, or t
  misc_feature (39)..(39): n is a, c, g, or t
  misc_feature (47)..(47): n is a, c, g, or t
  misc_feature (55)..(55): n is a, c, g, or t
  misc_feature (58)..(58): n is a, c, g, or t
  misc_feature (63)..(63): n is a, c, g, or t
  misc_feature (82)..(82): n is a, c, g, or t
  misc_feature (107)..(107): n is a, c, g, or t
  misc_feature (118)..(118): n is a, c, g, or t
  misc_feature (134)..(134): n is a, c, g, or t
  misc_feature (158)..(158): n is a, c, g, or t
  misc_feature (168)..(168): n is a, c, g, or t
  misc_feature (197)..(197): n is a, c, g, or t
  misc_feature (203)..(203): n is a, c, g, or t
  misc_feature (225)..(225): n is a, c, g, or t
  misc_feature (274)..(274): n is a, c, g, or t
  misc_feature (304)..(304): n is a, c, g, or t
  misc_feature (313)..(313): n is a, c, g, or t
  misc_feature (327)..(327): n is a, c, g, or t
  misc_feature (330)..(330): n is a, c, g, or t
  misc_feature (334)..(334): n is a, c, g, or t
  misc_feature (347)..(347): n is a, c, g, or t
  misc_feature (349)..(349): n is a, c, g, or t
  misc_feature (356)..(356): n is a, c, g, or t
  misc_feature (362)..(362): n is a, c, g, or t
  misc_feature (368)..(369): n is a, c, g, or t
  misc_feature (374)..(374): n is a, c, g, or t
  misc_feature (379)..(379): n is a, c, g, or t
  misc_feature (384)..(385): n is a, c, g, or t
  misc_feature (387)..(387): n is a, c, g, or t
  misc_feature (391)..(392): n is a, c, g, or t
  misc_feature (395)..(395): n is a, c, g, or t
  misc_feature (413)..(413): n is a, c, g, or t
  misc_feature (435)..(435): n is a, c, g, or t
  misc_feature (467)..(467): n is a, c, g, or t
  misc_feature (534)..(534): n is a, c, g, or t
gggggtggaatccttgggcngctnggcaagcggcgaganctggccanggccagcnagnagtangacagagggcgcgcggagngccgggacgcagccccggccgcttncagaccccgcnatggacccgttcctgngtgctgttgcacttgtgtgtcgtntagctctgtntagcagcgagctgaccgatctcaagttcntatgcntcgggcgcgttggcaatgcganattggtatcgtgtgcagatcggcctagaactttttttcattttgttggngtagaacgaattgtagttcgggtaaaactngtgctggtntgaattgtgcgtanccntgcngcgcaaagaactntngttgctntttaanaattcnnggttnggggngtgtnngngttnngtnttgtaaaaaaaattgttngtagtatttaaagtaatatttnataatgtgtggaaatatttgagaagcgcttgnttgctaagtttaaattattatacaccaacatccacaccattcaccatacatattcccccaatctcanacac

SEQ ID NO: 518322 - DNA, 494 bp, Homo sapiens
  misc_feature (61)..(61): n is a, c, g, or t
  misc_feature (132)..(132): n is a, c, g, or t
  misc_feature (150)..(150): n is a, c, g, or t
  misc_feature (152)..(153): n is a, c, g, or t
  misc_feature (164)..(165): n is a, c, g, or t
  misc_feature (167)..(167): n is a, c, g, or t
  misc_feature (173)..(174): n is a, c, g, or t
  misc_feature (177)..(177): n is a, c, g, or t
  misc_feature (181)..(181): n is a, c, g, or t
  misc_feature (185)..(186): n is a, c, g, or t
  misc_feature (199)..(200): n is a, c, g, or t
gatgaaatgaagcatttatatctcttaaagggcatccacatctgctttatccctagcggangagtgagggggcttcacacgtgcactcacactgtggagagagttggatttcccagacccctgagggcaccngtcagggtcatccccatngnnctgcttgaggnncntggggnntgnggcnctgnncgtggctgtgcanngtgtgtgtcacctgagtacattctgttgctagcagacagtggatgagggcccttcctcttcctcagcaagccgggggctgtgccagcctgtcttaggcgatgggccttggcaggaaggcgctccaggctgtggatagcatgtgggtaaaggcgtgctgctcgattgcgccttgcgtgaccaggcgcaggcggcgcgggccggctcgatgtcccgttggaccagcgatgtgcgtgggatagtataacctggctaggcgctttctggtctcagcgtatgactctcctagccctggg

SEQ ID NO: 518323 - DNA, 152 bp, Homo sapiens
tgtcctccatcttctttttcatgtcggccacctgtgcatggagggtggcgatctgcttctccaggttgtgcttgggcttcttcttcttcttcagctggttccggaaggaattcttctcgtcctccacctgcttgagcttggtgctcaagctc

SEQ ID NO: 518324 - DNA, 359 bp, Homo sapiens
  misc_feature (61)..(61): n is a, c, g, or t
  misc_feature (132)..(132): n is a, c, g, or t
  misc_feature (150)..(150): n is a, c, g, or t
  misc_feature (152)..(153): n is a, c, g, or t
  misc_feature (164)..(165): n is a, c, g, or t
  misc_feature (167)..(167): n is a, c, g, or t
  misc_feature (173)..(174): n is a, c, g, or t
  misc_feature (177)..(177): n is a, c, g, or t
  misc_feature (181)..(181): n is a, c, g, or t
  misc_feature (185)..(186): n is a, c, g, or t
  misc_feature (199)..(200): n is a, c, g, or t
gatgaaatgaagcatttatatctcttaaagggcatccacatctgctttatccctagcggangagtgagggggcttcacacgtgcactcacactgtggagagagttggatttcccagacccctgagggcaccngtcagggtcatccccatngnnctgcttgaggnncntggggnntgnggcnctgnncgtggctgtgcanngtgtgtgtcatgagggcattctcggacagcacacagtgaaggagcccccttcctaatcctctccgagcgtgggtatgtggcagcctgttttaggacagggccttgcaaaaggcgatccaggagtgggagcaccgggtaaaggtgtattgatcactgccc

SEQ ID NO: 518325 - DNA, 235 bp, Homo sapiens
tcccacgtgctgctagaagtggattcacttgtccatcccatatactatatgccagcactgggaaacttagagacagaacttgttctcaagggaatcttcagcttaggtggctctttgaataacaaaaaaatcctttccttctaaagtaacatcctctcaaggccaggaattccattagtagaaagccttcctaaaaaacaaaattcctggccaggcatgggttcacgtctgtaat

SEQ ID NO: 518326 - DNA, 547 bp, Homo sapiens
  misc_feature (467)..(467): n is a, c, g, or t
ctcaatacgggtgctctgttggattctggagtgcacagctgctgcatggcttcggtgttgtgctctgctctgctgtactgtatatgatcagttggaagcaagctgtcacgagtactggttaactgcaacctccatcagcagcagacatcgcagagacagacggggactctgcaggctcagaattcattcccctgttggcagaacccaccacaggtgttgtattttgtgtcactttggcagtctctaatccatgtcatccaggtggtcatcggctacttcatcatgctggccgtaattgtctacaacacctggattttccttggtgtggtcttgggctctgctgtgggctactacctagcttacccacttctcagcacagcttagctggtgaaggaacgttgcagtgcacttgaaggcttgggaggtgaccatgtgaggcccccccttcttcccaagacaacttattncgtttcccaaacttggcgcccttttcttcttgaatgggctaatatccctcccagcgtttatattccgcatgccgccctgg

SEQ ID NO: 518327 - DNA, 1067 bp, Homo sapiens
taagatgataaaaaggaaagtacccaatgggaccaccccctcctttcatgcgggctccaggaccaatccactatccttctcaggaccctcagaggatgggagctcatgctggaaaacacagcagcccctagcaccttgtcaccactctggggctctgtggaagaaagggcacttaaaactcccagtaaatcttggaataaatattttttctccttcccttggtagttttccagtgggtagcgtgaagtgttgctcagaattgttgagcagctcagagaacgtgacagccagtgctttcctatactgtggttcaaaggattcgagtggaccggtaaattaagcgtgccatttaacacattcttgggttacgtgcgtgttaacattgtacttaattataacaccgaacgcctgtgtttcccctttacccgtgtgttgggggacacgcagaattgaggtgaattgtggaatgttgtccaagcaagagttaccctccccaatttattattgttacatatttggtagatatattttttgggtacagggggaacaatattggacctgcagataaaaaaacctttggaccattttatatggcccattgggatactttcctttttatcatcttaaaaaaagataactagtactaatcatggaaggggcctaaggtgtgattcaactcttgaagtcacaccctccgaaaagatgcgtaaaaaccagcacccgaaaaggcccaagatcttcgtctttacatgtacttttcctccatatattcctaaagggatctgaccctttacgcgctctacaggccaaaaagaacagcacatagaaatccatataatcccgtgcacacgggttgagaacccaaattttagggacggtgatcacatcgaaaaagaccgtgggttgtggcagaaaaaatgggttaaaaactctgttaaaccgtcttttcacctgacatcaaaatctgagtgcatgaaaaagcccccatggactctgtgtcaaaccctccgtgttaggtatagacctaatgagtaacgagaataacacccacaaacagacttatttaa

SEQ ID NO: 518328 - DNA, 673 bp, Homo sapiens
gggcttgctccgtccacccccagtgcgtgggggagtgcgcgccaacaggtgccaggcgtttagagcagacaagggcgctcgtcgagtcgctgggatgccccctaaagggagcaaggttctcctatttgccagaaccccgttggcgggattgttactgaacctgtgattcagacgccaggagtgagggctgcggaggtacctaacgggagcctcagtctgacattccacgccggggatggcgtggtgggcatgagcggtgggaacgtgaggctgccaggacaccccttcactatgatgccccggttcagtcaccccagtttaactattctacgcaggaacctctaacctctatcgtcaccttgcgtattcattgctgtaatttattgacctctaagaaatgctgcgattggagagaacccttcagtggggacagggaggattcccgagaggttcccgagcacgtccaacttggaaggttggccctgatggggcccaggtgctgatggggaccctctcatagcccaggacatcgagtaggttcactctgactctcgttccaagcccggaggagacccaggttgagcacttggtcattgctggaaatacctcgaaggagagggctaacgagaatgggggacaagcggtcaggtagagcgaaatagtcaggagcacg

SEQ ID NO: 518329 - DNA, 142 bp, Homo sapiens
  misc_feature (70)..(70): n is a, c, g, or t
tcctgcaacactaccttagaagaactggactctgtgtccttcagtgggaagccaccttggacacacgcangtcattcaggtggacataaggccactcttctcgcccttgaccttaggaactcagccatgcgtggattgccag

SEQ ID NO: 518330 - DNA, 870 bp, Homo sapiens
  misc_feature (36)..(36): n is a, c, g, or t
  misc_feature (154)..(154): n is a, c, g, or t
  misc_feature (267)..(267): n is a, c, g, or t
  misc_feature (303)..(303): n is a, c, g, or t
  misc_feature (344)..(344): n is a, c, g, or t
  misc_feature (346)..(346): n is a, c, g, or t
  misc_feature (414)..(414): n is a, c, g, or t
  misc_feature (425)..(425): n is a, c, g, or t
  misc_feature (445)..(445): n is a, c, g, or t
  misc_feature (470)..(471): n is a, c, g, or t
  misc_feature (485)..(485): n is a, c, g, or t
  misc_feature (488)..(488): n is a, c, g, or t
  misc_feature (506)..(506): n is a, c, g, or t
  misc_feature (512)..(512): n is a, c, g, or t
  misc_feature (547)..(547): n is a, c, g, or t
gaaccaagttgtgtcctgtcagccgctgtccccttngccgcgatgccgctggagaacctggaggaggagggtctgcccaagaaccccgacttgcgtatcgcgcagtgcgcttcctgctcagcctgcccgagcaccgggagacgctgcgtgcgcnagagctgatggcggcgtccgcgataacaacatggctccttactatgaagccttgtgcaaaatccctcgagtggcagatagacgtggacctactcaataaaatgaagaaggcanatgaagatgagttgaagcgttgatgaggagctgganatgccagagaagaatctaggagagagcgaattcgcgatgcnantgatggcaaaggccgagtacctctgccggataggtgacaaagagggagctctgaagctttcgcaagantatgacaaaangtggccctgggtcaccgatngatatgtatctatctccttaggatnngttatttatatggntantgatctcataacgaaaanagaaanggcaaaagcttatagaagaaggaggagactgggcnggagaaccgctaaaggtatccagggtcttaattgtgtggctatcgtgattcaaagaggcagtgactcttcctggaatgtttaaacatttactctatgatatggttataagattggactatatggtagcagatggtggctgaaagacaaattcaggaaaggcttaagcgcgagtttgagggtgcagtcccgaacgggggaatgttaattaaggacggtttacaaacgtggaagaggaagggtgggcatcgatagaagaacgaggagaagaacgaaaaggggacaaacgggcaataattctcttttttatatattttttgtgggg

SEQ ID NO: 518331 - DNA, 801 bp, Homo sapiens
tgcgatggctccacatcctgtgtccctggccctggctgctggggagcccctgcttcatctgcctgtgtggctactgtgtgactgacactgcagtatctgtgcagtgttctgacaatgctgactgcctgcagatgccagcagtgatgtgacgcctgctgtgtgctgcctgttggcatagatgcagtgatggtgtgcctgtgatgtatatgcggacgacggcgacagtggcacaagttgaatgtgcccacatcacgagactcgaccctgagcagaaccatgctggatctgctgcttcctgcatactaacaaccaatgagctgatggcctgtgttctacacacgcctccgagatcgattgttttggctagccgaaacagttagcggcgatcctgtgactgtggtgtcgctaatcccttccctgctgtgggataacccaacccatgatactgcacttatctggaaccgtcgcacacaggtgaattatcaactagtactggacgccattggcacagcagacgtgcaaccattgaacagactccttttggcgaaacctcgccatgatgaccgctgcacgccacttgggcccggctggccgttcaaggcacttcaatcacgaacgggccgacaacatgattgtgtgcacgtggaccggggcccacaaattgagtttgacgccgagaggaatgacccatgactgacggacagacatgccccatcaccccagttggagaatggtgtcgaccacacagggatgggcaggtatggcgaacgtttgaggcattcccctgcgcaacggacaatc

SEQ ID NO: 518332 - DNA, 913 bp, Homo sapiens
caaaggccgggaggcgggcaacacagggtcaccgcgctcgcgctgtctaagccgcggaggggtcctcaaaaagcggccatgcagaggcgctgctatggcgctcccgccggtgatcaccgcgccggtagctgtcgctaggagtcccgacgcgcgggcgaaactttggccggccgcaggcggcaagggtgcccgacagaggttcgcgcggccacgtgaccttttgagccccaacgcaagaatgcgcacaggcggcgcaacatggagtccgcaacgcacatgggcgccacacaagggacgaggcggtgcccgcggccgcgcgcaatgacctgccgacgagcctgggcggggtcatcttgtttaagggaagaaacaactaaccgggaaacagttgcagtcaggtcaaaatgggcagaagacgcgagcatccgggcagccacccgagtgagaggtcttgccacagagaagagcagtgggaaatacgccgggtgctatgaaaaagagaaactggggtgtggataagacgatatagacacagacgccctctgcgggagacaccgctgcgaggatccgccaacaagcgttgttagcagagggtttggcaggcaacctgaatctggcccatgacccgcaggatggacacagtctgccgagaatggttatcctgaagacggcaactatttggggggaacacccggtatttcaggggcatctgtgtcgtcaaagttttgttggagacaagtccaggacaatgcgacgggcggttatccctggggacactctcttagcaaaccgcctagggttttgtacatcctcattgggtgagacataaagggtcaatgcccagcagccaatgttaaagatggagatatgggggccgttaagctaagaataaataaggaaaacccaaaataca

SEQ ID NO: 518333 - DNA, 1292 bp, Homo sapiens
caacagtgcttggacggaacccggcgctcgttccccaccccggacggccgcccatagccagccctccgtcacctcattcaccgcacccatcggacatgccccaaggaccccgacacgccgctccagacgccgacgacagacaccgacgaacgaccgaccgccatcatcctatagatcgaccagacatgacggcaccgcgataccacctcgacaggatgcgccagaagctaccacccaggactcagaggccgcacatccaaccgacacagatcaaccatggagcatcatacgcctccatacgatataccatgtcacaatgatcataacatacataaagacccgcgcatgccatgtggcctcagcacagcaacgtaacggccaacatcacgtaacaataccaccacaactcgtccatgcaggccagcagcggcaaccagtgcctgcagccacacactgcatgcaagcatgcgcagcacacccaacgcacggtggcccagacatcatatccataccaggcatcatcacagcacaaccaagccactgtggcatgccactgcgtgacagcacagcgcggcctgcacatgcgccactgacagtagtgcatacaccaatctgcaacaaaccacatgtgcaatccacgcagccaacaaactgcgaaactagcgacccaaactgggacacacctgcacaacacacaatgacgcccacacatacgcaggtgcaccatgaccgtagacgaacacccctaacgcatgcacacatgacgccacgcgtgaacaggccaatcacaaaccacatcgggtgaaccccaacgatgaccccacaaattggcagccacgacatgaggaacgacgaccccgacaaccctgcccgcttgcggcggaacagtacgtctactagagaccacgcacgacccatggaggacaacacgcggactaaaggtgacacacataacagacctacggcccacacactaacgcgccaataagccgcagagagggaggacaaccccagtggcttcaaccacagggcagcgtgtccactgaccagcaaggggaggcactcccgtatacaccctcatacgacaaagatgggaaccacgacaatccaattacaagacaaagaagcggaacccaacactacagaagcagacaatgtgaaacagcagaaaaacacaacacaaaaatagagctggagcgcaacaagctcccaacgaggccacgaacgaagaccaccgcgagtaacaaggccaacagcacgctaaacacacacgccaccacaaacgaggcgaa

SEQ ID NO: 518334 - DNA, 573 bp, Homo sapiens
aaggatctcaccgtaatagtaacaagacagagatcagaagatgtgtataaatgtgtaattcataatgtacattttaatattctaaagtgacattgattaatggacattggagtccagtagattggttaattccaccaaggagagagagaggcattcaagtcaacagaaaacaagtagattttacttctccactgggggtgttaggacattaattatgtacttggtcttacttgtttagtagtagatctatattgagtgtcttactgtgcccaaacttaggatctttgtatatttctaaaaggatgaaactgtataataaaaacactttccaattttggtagattgtagacagatcagagtattcaaaagtatacacatcttctctattgtgaaagaccaaaaaatggaaatgtgttgtgaaattagaaaagctgtatactagtatgtctgatgttgtgagaagctggatttttgaaaccagagttgtctgttcagccttttatcagtctgtactaagtttgatgtccataggtacataatataggggaatacataaaggataaaattaagtga

SEQ ID NO: 518335 - DNA, 418 bp, Homo sapiens
  misc_feature (307)..(307): n is a, c, g, or t
  misc_feature (337)..(337): n is a, c, g, or t
  misc_feature (368)..(368): n is a, c, g, or t
  misc_feature (404)..(404): n is a, c, g, or t
ctcttctgaaactacctttgcaaaaattatagcagtgagaaaattatgacagtgaaagaaatctgacctaattgactccatcttgcttctaacctcccagctgcccttgttcattcctgggcatagggagcactaactttgggaggatttagtttatagtttaactttgaaacaaagatgataacagcccctccctgagaccaacccactccttgccgggggaccagaaaagcctttgtaaaactaacacattggccacaagattagaaatgacggctcaggagtcatgcagccaaaggcttcgagntcatgaaccttcccaattgctcctgtaggntattttatttattgtaaaacctaacatgggngttttgagggtattttttcagaccctggccttttgngggttcagttgggc

SEQ ID NO: 518336 - DNA, 220 bp, Homo sapiens
  misc_feature (181)..(181): n is a, c, g, or t
  misc_feature (205)..(205): n is a, c, g, or t
tatccgggacgggagggatttgagtagatagaaaccgactgtatactccggtctgaactcagatcacgtatgactttaatcgttgaacaaacgaacctttaatagcgactgcaccatctggatgttcctgatccaacatcgaggtcgtaaccctattgttgatatgtgactctatgaatanggatttggcgctgtttataccctnaggggtaaactttgt

SEQ ID NO: 518337 - DNA, 479 bp, Homo sapiens
ctcagtattcatatggtgggggatggagtgtctcccaggttcttgggggaaaaaaatttgtagcatatttaagggaggcaataacctttccccccccccttttccctgcccaaatttgtttcctaaaattttatgtgctgtgaataataggccttccctgccccccccgtttttataaacctgaggttccagtgttttctgggaactggaacctttccttagggggaattctggtgctcaaatttccctcccaaaacaagtagccaaaaccgttgcccaaccccccccattaatcaatgggccctttttttttggcggcttttttttttttaatatgattttaaaggatttaaaaaaattgggtcgtctgcttcccctggattttttttcccttttttgtaatatttaaaacgccgatataatttttttaagtaggctataatattttttgttatatattttttttcctttaaagtcca

SEQ ID NO: 518338 - DNA, 495 bp, Homo sapiens
cttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagtcatattctgttataagtgaaattgggctccaggccaaggagaactttggagaacttttaagtttgagtgactgtctcacagctggaaaccaccccaaagtgcattgattgcagaagaatatgtttcctattatccagttctctacccaactatttttttgtagcttgaaaataataaagattttgtaagccccaaggggtctttttgatccatgaatgaagttaccctggattcatataactaaaatctgacttcctttcagccattgaaattcaaaaccctttccatttattagtatgaaataaaaaaagaccttcaaaaatgtcaaaaagaaaaaaaa

SEQ ID NO: 518339 - DNA, 178 bp, Homo sapiens
ggcatgacttcaggcactgcagcatgactacaattgtagtcatgctgcagtggcattcaccgaatgaggccctcatgacatccgcacaccggttctgccgcatcttcgtgctggcgctgctgatcccgctgactgcccttgcaacccccaccaacgatgcgcttcgcacgatcgagcg

SEQ ID NO: 518340 - DNA, 451 bp, Homo sapiens
  misc_feature (305)..(305): n is a, c, g, or t
  misc_feature (324)..(324): n is a, c, g, or t
  misc_feature (332)..(332): n is a, c, g, or t
  misc_feature (349)..(349): n is a, c, g, or t
  misc_feature (361)..(361): n is a, c, g, or t
agtatatccatacaactatttgcggtggctaaggctcttgagttcactttccttaatactttgctgaatattgaagattgtaggcaatgacaaagtctactaaatgaggaaaaccttgaataattaggtatcctaggcaagagcccctaaacatgaagcaatctgtgagtcatgtaagaaataaatattgtttggatgattcttatctaattccacccctgatggaagatgatttctttgttctttgcacctatggaagctgtgtattctctgcaatggttggtacgaatgttaataaatgtagnatattctctgagatgattntgcaaagnactattttaaatatcanatcaaccaatanatcacatttgtgttaggaaccgactcgggccgaatcgatataaagcttatagaaaccggggaccccgcgccggggttttttttttatttt

SEQ ID NO: 518341 - DNA, 116 bp, Homo sapiens
gcggccgcctactactactactgctcgaattcaagcttctaacgatgtacggggacatgtcagatctttgtacgtaattaaaaatattgtggcaggattaatagcaaaaaaaaaaa

SEQ ID NO: 518342 - DNA, 542 bp, Homo sapiens
  misc_feature (525)..(525): n is a, c, g, or t
tacgtcagagtggggataagatctgctatgcggccttgtggactggaggtggaaaggttcatggaattatatcctagcttggggatgtgcaaactgaggctcagagagtttaagacacatagtcactttcaccaattaaatgatgaagctgccatgtaaacgtatttcatcacactcccgagaccttcttctccagtagtgttttcaagctttttgagcatgcagacactaccatcaaaaaattatgtagagacatacttgagagttacagtttaaagaaaaacaaggtgtaattatttggttattagtagcatttacatatgcttgaaaacttctgctatatatacagtaagattaatttattctaacaatgatcttgataatccccctgattcccagactccttggaatagctccacagctatcagtggttctgccacaggttcagagccttcccagtactggcttcttatttgagaggtgtgctaagagctataaagcagaggcttcaattgtacacagttnggaagtttaggcaaaag

SEQ ID NO: 518343 - DNA, 975 bp, Homo sapiens
ctgccggagggaaaacgcggtcctacaccaaggactacaccgagggatgggtggagttccgtgacaagcgcatagccaagcgcgtggcgggcagtctacacaacacgcctatgggttgcccgcaggcgtcagccccttccgttatgatctttggaacctcaagtacttgcaccggtttcacctggttcccacctcagcgagcaacctcgcctttgagcggccaggtgcgcaggcagcgcttgaagagcggaggttgctcaaagccaagcgtgatgaccgacttctatcttcaaagtggtggacccgggggcacctagcgctttctttgcggccgatggggacccttgctcggccccagatggcgtccgtggaccattttggcccaggcgtcctacctgacgcaagagacacctgagtggccccggtacaaggcaagcatcgggccaagcggtgggaccggtgaaaccggggcctcgccctggagcaaactggcccgagcgaccaagggccccggttcccaagcaaagggagctccatgggcccagggactcgtttgggacgcccccgttcatcccttcaagaacgtagcattgcgacaggggaccttatacccttgtgttccagcggaactcccttgacggcggccctggggtgggccccctttttccattttcccctggggcccttgcttccgtgggcttccctggtcgtacccttcattacctaggcaatgggctccggtgacttaccccgggggcaaggaccattttcacctggggggtcgactcgaggaacccacaggtggtcttacgtggattgggcgcaaacacactcgcgagctcaggtggggggcttccaagtggtccgcgcattccggaactcccgtggcgttgttgccttgggctggaggcacccttatttcattcgtggtgcatacttagcgattcattcattggccttcttgcgcatttgctg

SEQ ID NO: 518344 - DNA, 475 bp, Homo sapiens
ctacgagtatcccctctacacccctcgatcaccgtcacggtgcccaggcgggccaggcgcgccagccagcatggtgtgcgtacaggtcagatggttaggactcgatcacctggaaggccttcagttggtcatacgcagtgccgtagatggcggtagctggcacagtcctcaccaggattgcggggaggccgctccagagggtcctggtgccctcgttgcctcacgatcttcacggaacgcctccatcgtgcccgctgaatgcgtggtcgggtcttgaaaccaggtgcgcacagcgggcaccatttggtgcgcacgtgcagaggctccaggacaccattgcggtacaggaggcacttccatttggtataggagaggctccacagtctggaggaaggcgtccgctcgctcgccatggtagggccgctcatactgccggctaaccttctccatgtccagggcgtgtcttgaacagaga

SEQ ID NO: 518345 - DNA, 747 bp, Homo sapiens
  misc_feature (608)..(608): n is a, c, g, or t
tgataaaggacccaatgcaggtaatcctgttgttcggactcacgtaatgtacgaatgcaaagtatagtgattatttaatctgggcctaagctacgtgagagtatggaacaatggcccataatggactcctaagcgccgaacgccaaggagcctccttcccttcctggttcaccccgcccaaggagacctgcccccattccatgtggacccatggggcccagctctccaatagtgtcagaaagcaacttgtggcttcgcctctgggttgtgagatgggtacattccaaaggagcagcctgggggagggggcaggctcagcccgcccttggaggctcacagccatggctggcccaggctccagctcgcctccagtgtggacgcccgagtcgccctcagagacgatccctggccagtgtcagcgctcatgccgacggcggtgtggtcccggctaatgtgatgtctcttcccgtgggcgccctatcctctggactctgcagtgccagcttggacggattgaggtctcgttgtggcgtttggtgaccctggttaagtcataccctaccgtgatcccgagtctactgctctaaggactgcctcccactgcgtgnccctcacctgacttccgggtatggggagggagggagccggtgcttccatgcctaggggcttggctctgagaatgtcggcctccggggcctcaggtggacctgtgggtcacttctggcccagtccgcagagtccctttgg

SEQ ID NO: 518346 - DNA, 414 bp, Homo sapiens
ggtttaatatattgataaaaaatcaaagcaaagcctggtatcatttatttcagaagacaaatcatttcagtacttcttccttgaaatgcctgcaatttctccctctggcctcagagacgggcattggctccatgctttacaatgtcaggataaaaatccaggagggagaaatcttgttgtaatgggtagctgttttcatctaacacaaaaaggctctgaatctttaatacacaaggttctgcgctgactgccaacaaggagtggaacaggcctgccacgaccatcccaaaggtgatctctgaggaaggaactatcactctgttgaggcagtctgcagaattgttgagaagaatcttctctatcagctttgattctacacggatacaaacatcatgtcttccaaagaagagcacc

SEQ ID NO: 518347 - DNA, 1067 bp, Homo sapiens
  misc_feature (421)..(421): n is a, c, g, or t
  misc_feature (471)..(471): n is a, c, g, or t
  misc_feature (505)..(505): n is a, c, g, or t
gctaaagctagccccaaacccactcctagcttactaccagacgaatcttaagtccgaaagccatttacccaaataaagtgataggcgagtagaacattgaaagctggcgccaatagatcatagtcaccggcaagcggaacagcatgatccagattataacgcgaatggcataatagtagactaagggtactagatcgcacctgagtaaccgtgtctgtcgagtaagtgaacttgaagctagcaagatacactgtgtgccaaggcaggagctcaaaaggctatagagcgcacaccgagagatcgctagatcgaggcctaagcatagaagaacaggtcgtacaaacgtaggcagcgatcacgttcatatgctacgcacacagatcagactggagagaggaatcttgaatagcgctagccaggngcagacgaaatcggctaacgcggagaaccgtgcgatgcactaagcctggntatgggtcccaagcaattaggaactgccgttagntctcaaaacattgttagacactgttgggcccctacaggagagccgctccctaaagtctccgctatggttacccattgtttagaccttgtgtgagaatcccaataggaggtgaaacaaagctactgtattgggaaccgactgagcgacgaatagagagtcatgtgctcacgcatgaagcacgtcaaacacacacagtgttcataacagccgccaataagatacgggccctgaacggagtcaagacgcaagtcaatatctacaggagaacagccggttacgagagacttcgaatcaaggcgcagttacgcgtaaaagagcatattcgccacatacagttattaactgggaacttccgtcagcaccccagattggggacccaaattcttgatcaccccgtaatagaaaagaaagctaaactggttgagggaataaggctaggacatgggaagacacgattgcttaccttcatcgggattaaggcccttgacgttcaagaatttgaacgacaagctggaacggtggacaaatttagataacgggagccaagtagtcattacaaggc

SEQ ID NO: 518348 - DNA, 198 bp, Homo sapiens
  misc_feature (3)..(3): n is a, c, g, or t
  misc_feature (11)..(11): n is a, c, g, or t
  misc_feature (129)..(129): n is a, c, g, or t
  misc_feature (135)..(135): n is a, c, g, or t
  misc_feature (161)..(162): n is a, c, g, or t
  misc_feature (173)..(173): n is a, c, g, or t
  misc_feature (187)..(187): n is a, c, g, or t
ttntagagggntccccgggtggcattacccgacgacgaccaccaagaagaaggctcgaggccaggaaggccagcaccccgatggcactgccatagcggcaggcatcctcgttgcggggtgagcacgcantacatntgcttagactcgtgggcattgctgtnnccctcaccatntatgcaggagaacnctgatcaaggc

SEQ ID NO: 518349 - DNA, 859 bp, Homo sapiens
  misc_feature (548)..(548): n is a, c, g, or t
tggaccttagtaaccagaagaacgatgagtcccccgcttttaggggccactggagtacgagctcgagcgttcacaccaggcgggctgggtcgccggcccacctgcctccctgcctccctgtgacggagggggacaagcaagccccacagaggccgtgtactactggacagacggatagacatacggaagcgaggcctggaccaagagaggcccaggctactggaggacgctagaaggatgtgacccctgtggggtcccgcactgaccctcggtacgaggggggcccaatgacctctggcagtgtcaagggggccctgggcacaagcgcacgatctgcgagtctgctgactgccctagctgcggtagatccgcgtgaggctttcgctgttgacacaagtctcctataaaggaactcggctcgatgaggagcaggatggtcccaggccctggagctctacgggctcctctctagagcggccatgtggagcttgacagcttcagaccccacacgtcttgagatgtttagttgtatcttaaatagtagtatnggactgcttggcacggtcgtccatgtaatagggaaacccgttgccgtcagtcagattttcaatgagttacaagctgcaatattattagcacaagtgtccttgggagaagcttgccaatgcaataggtggacaaccattcgtccagcttacaggggatatgctcgtcccgggcaccggtggcaggcagctggccattctggactaaaggcagcctggggccacaactgcagtctggcaacacacagagatctggcacccactgggtggagtgtccctcgggggctttgaaacagcatgggaccctcagacca

SEQ ID NO: 518350 - DNA, 1587 bp, Homo sapiens
  misc_feature (690)..(690): n is a, c, g, or t
  misc_feature (768)..(768): n is a, c, g, or t
gatctgatgactgctgatatcagcttaacacgggaatgtgcccataacatgtattcatggtgaaagcagatgacagtggagagtatcagggcagcataataccattttgacacatgcatggtggggatggtgagagcatgtcacgcgcaggttccacggtttcggtgagtgtcgttcagatctcgcttcataaactacgttcactagcgaagtgccaggaaggaaaagatgatctagccacgaggtatggatacagagcactgtaaaatatgaggcaacggacttgtggacttcacgatgtacttgtgctcggaccaacgacccttattcatggatgagtgctggataaccatgacgagaacgagtcgcaggccgtgtcatgagctcccgttgcaacttggtagcctgaggtgagatgaggcgaaggtgtggccaggagtgcttaggatgactggacctttaaataaccgcgtaagatatgcgatccggggctggttgcagtgggtatactttcgagcctagaaaattttcgcccgaacacaatcttgggaggagggtacatcgacggatcgggacacagacaatactggcgtaatggagcggcctgagagaatgctctactaacccagtctaggcctggtcgtagggaccaggccaggtgggttatgtccctaattaggggccattatncccgaaaacctttgcgcgaggcaacattccagaaaagggtaacaatgaaacacccttcgttgaaatccgttcgtgtgnttaagagagcaccaaaccagctaaggaaacagccgctgtaaaaaccaatttggtgggttattcgccgttaaagtaggtccgcggttgtgtgcacgttccaacacttatcacttgaagcgccatttttgtgcggctgattcgacactgggaggtggcccaaatccacaagaaaagagggtgtgtgagcagacattatactggcgcacggaccaacagacaattgtgttattgtgcggtacaaaacccttatttttgaccccaagaggcgtgtgatactggtactgttgtgcgcacccacggcgttgtgcacaacaaggagagtgaaaaaagtcccgtcgttaataagggagaattgtgcccaaaacactggcgtaaactcagaggtagcgctttgggaagacattccttcctggatcccttttcagtgtgggtagagagacaccgcacgggcatttagtaacgggagggccaaagtgatattgtccacgcacgtgtacatagagccgttgtatagaaaaatagggctgtgggaaggaaaaaaacgcccgagttggaatgggtttccaagaaacacacagtggtggcgtttagtgaaacacccccacaagagtgtgcgtattaaaccttacaggattcccttaattccaacgactgttataacagcccatggttgacaactatgtgatgggccacccatgggtgtgtcacacgggaagtttgcgtggtgaaaatgcccacacgcgggtagttcaatcacttcgcgcggcgtacggcagtttgtgacgagtgttaacgcgagacgtacatttagtagcgacg

SEQ ID NO: 518351 - DNA, 664 bp, Homo sapiens
acaggatcccgtatgtctcgatctgttaagacaagtagacccatcacactcagctacccagggacattttatttatatcaagggtagacctgatcatcgtttcctcaaacaattacataagatgctggtctagtgatgccctgtggggacctacaaacccaaaggcaactagcctcttcaggcaataacatacaggacataggaatgggcaaagaccttcatgacctacgaaacaccaaaagcaacaggaacaaaacggccaaatggagcaaatgggactctacttaaactaaagagattctgcgcagcaaaggaaactatcatcagagtgcacaggcaccctacagaatgggagaaaattgggcaatctatccatgtgacaaagggcctaactatccagagatctataaagaacttaaatttacaagaaaaaaacaaccccatcaaaaagcgggcgaaggatatgaacagacacttctccaaagaagacatttatgcagccaacaaacatgaagaaatagcggatcatcactggtcattatagaaatgcaaatcaaaaccacagtaaagatactaactcatgccagttagaatggcgatcattacaaagtcaggaaacaacagatgctggagaggatgtgcagaaataggaatgcttttatac

SEQ ID NO: 518352 - DNA, 284 bp, Homo sapiens
agtactattagcctctcctacaaaggtcctgaacccattaaaacaccaaaaactttaacaaagatgattggacaaaacctgggtagtagtacatctacacattataaggtacacatacacaaagtaacgctatttacgtacatacagatggcagcacttgaccctaaatgtacccaactcctaaactggtacataatcagctggggcaattttttcacccagcatcaccacgtatttttataacaacaaaccagtgcttggcatcttcccaccccacctgcaat

SEQ ID NO: 518353 - DNA, 377 bp, Homo sapiens
caaagatctttgagcatcacctggaagcttgttagaaacacaaattctcgacagggcacggtggctcacgcctgcaatcccagcactctgggaggccgaggtgggcggatcactggaggtcaggagttcaagacaagcctgaccaacatggagaaaccccatctatactaaaaatacaaaaattagccggatgtggtggcagatgcctgtaatcccagctactcaggaggctgaggcaggagaatcgcttgaacctgggaggcggaggttgcggtgagccaagatcacgccattgcaccccagcctgggcaacaagagtgaaactctgtctcaataaataaataaataaataagcgagctcggctgggcgcactggc

SEQ ID NO: 518354 - DNA, 324 bp, Homo sapiens
tccaggatgtcaccatttttcccttcagaatttctcagcatccctttttggtcatagctcagctccatgagggctgacattgtcatttgattgtctggtctggataatgggtatatgttaatatttaaacacctgaatattaaatagtacaggaaggcaaaaattattaagacaatcacaaatactataaggaatatttggccaggcgcagtcgcacgcctgtaatctcaacattttgggaggccgaggtgggcagatcacttgaggtcaggagttcaagatcagcctggccaacatggataaaccctgtctctactaatcata

SEQ ID NO: 518355 - DNA, 241 bp, Homo sapiens
tgtggtgttgggccacttctggggtcacaaggggtgtgtcctcgctgcggtagtatgtctgccggttctgacagtggcattaccgtgcccatcatgctgctggtcctagctcccgtgcctgggggctcctgattgccaggcggcgtgatgcgcgcaccgtgcacgaatgatccagtaagcgcaggttgggagagccgtggagtaggcggcccatggaccatggcttccctagcctagagga

SEQ ID NO: 518356 - DNA, 290 bp, Homo sapiens
atactatctgtgacttgggattatcgtgtgaccgagggctggcacgaaattgaccaaccctggggttagtatagcttagttaaactttcgcttatattgctaaacggctaactcactgctgtttcccgtgtgtggatgtggctaggctaagcgttttgagctgcattgctgcgtgcttgatgcttgtcccctttgatcgtggtgatttagagggtgaactcactggaacggggatgcttgcatgtgtaatcttactaagagctaatagaaaggctaggaccaaacctatt

SEQ ID NO: 518357 - DNA, 776 bp, Homo sapiens
  misc_feature (316)..(316): n is a, c, g, or t
  misc_feature (410)..(410): n is a, c, g, or t
  misc_feature (548)..(548): n is a, c, g, or t
  misc_feature (562)..(563): n is a, c, g, or t
  misc_feature (586)..(586): n is a, c, g, or t
  misc_feature (592)..(592): n is a, c, g, or t
  misc_feature (606)..(606): n is a, c, g, or t
  misc_feature (613)..(613): n is a, c, g, or t
  misc_feature (619)..(619): n is a, c, g, or t
  misc_feature (635)..(635): n is a, c, g, or t
  misc_feature (657)..(657): n is a, c, g, or t
  misc_feature (660)..(660): n is a, c, g, or t
  misc_feature (662)..(662): n is a, c, g, or t
gttatgaataagaaaggcaaacataggtctgggcattaaattatacaaactgaaaatgtgttacaagaaaaatatgagagtttaactagatgtttttcaaggtaagttcaccttttgtactttactatttatttcagaaatgttgacaatacaacatagcatatgtcttcatctcactaagaaaagagcagttgtaactcaatgaaatttaattaaacatgctacttttgatttcatttacttggctgatagaaactctgggaaacagaacctagatattttgtgttcaattgttagaaaaggtgccaaacagatnatgaaatttgtgcctaatttaacttaacatgtttaattaaatggaaccactacttatatacagatttacatgcaatccagatctttaattttgncttcacaaaagcctaatgtctgtaattaacctttaatttttatttctgtatgagacaaaagttgaggacttggtgaaaggaaatagcagttacagcaaaacctcagtgattacaatgaggaaaaagtcaaattataanatacctttaaaganntgcacttccatattttcaagtcnattttnactctaagatatgnttcctantgatgntggttgactgacgggntgattattttagctgtctttgnacntnaactagtagaaaatagcagttttaaaagttttctatttcagtttgtttacactcctaattgctttaagcacttttttgtgtgtgtaaactgtaaagtctagcccagcccttgtg

SEQ ID NO: 518358 - DNA, 623 bp, Homo sapiens
ggaatgaaagtatagccaaaacataaaaaaaaaaaaaatcctcagtatagctggcaattaagacctaaaatcacagtattacaagtgttggcggttatatacaatgaggtcagtgctacagccacctagcattgaactaacccagtttccacctccataaagttacctagagttgtctgagtgggaatatgttcggggcatttacctgaccggccaattattagggagaggcaacaaggtaattcagcctttcctcctatcagcacaaagaaactcaaagctggtttttcaccctttcgtgttccaaagcagtcttatcctgacaggagcggtctatactagtgcagatttcaacactttttttaaacggtttaattaactatagggtatggtacgagacttggattggagcacgctaagggtttctggaactttactttactaattttccagggtgcctaaaggggttctgtagtgttatcaaaggcaaaaaggaaaatggtgcttaaaaataccaaattcagaactgttaatagtcagatcatatacctcttaataaatagcatcttatgctaattagcctgtaaattatgtcagaggaaacgtgtcaagtatgggattgg

SEQ ID NO: 518359 - DNA, 486 bp, Homo sapiens
  misc_feature (199)..(199): n is a, c, g, or t
  misc_feature (333)..(333): n is a, c, g, or t
  misc_feature (335)..(335): n is a, c, g, or t
  misc_feature (397)..(397): n is a, c, g, or t
  misc_feature (439)..(439): n is a, c, g, or t
  misc_feature (486)..(486): n is a, c, g, or t
ctctttagaaagaaacagaacccattaagaggtggagcttaggctggaagtggtggctcatgctgtaatcctagcagtttgggaggccagggtgggaggatcacttgaggtcaggagttcaagacctgcctggccaacatggtgaaactctgtcactactaaaaatacaaaaattattcaggcatgatggcgcatctgntaatcccagctactcgggaggctgaggctggagaatcgcttgaacctgggaggctgaggttgcagtgagccaagatcgcgccattgcattccatcctgaggcatgagagggaaaccctgtctcaaaaaaaagananaaaaaaaaaggagattataaggcaaatacattagatttgccaaattttccttccccctttgnacaccacttgagcaagaacatttgctaccagatcccagggangttctcatatcctttcacccagcccatgggagcccttgtcttctctn

SEQ ID NO: 518360 - DNA, 221 bp, Homo sapiens
tcttcgccaccatgccgccctacaccgtggtctattacccagttcgaggacgctgcgccgacgcatagctgctggcagatcagggccagagctggaaggaggaggtgtgaccgtagagacgtggcaggaggactcactcaaagcctcctgcctatacgggcagctcccaagatccaggacggagacctcaccctgtaccagtacaatacatctgcgtacct

SEQ ID NO: 518361 - DNA, 392 bp, Homo sapiens
gactttgaatgcaattgcaaaggacgtcctagtttagttaaacttgtcggagagacatgggcatcaacagtgtgaagggagaagttggactgacaatacctgacgaagctctaacctttcacatggccatagatgtttgtaagaagaaaaagacattggaacagcaatgcaattactttctttagtagtcattggtgtctgtcatcatggataaatttagtctgtacttcttacaagaagagaggcgtagtcattctcagtgggcttaactgatgaactggcaaagttcagctgcaaagtatgaaatcagagtttgtttcagggtcaatttagtgccacttttttgccttttggttttgtaaaataaaaattctcattctattgtgaaaaaa

SEQ ID NO: 518362 - DNA, 205 bp, Homo sapiens
cagggtggtctcaaccttttggcctcaggtgatcctcctgccttagcctccaaagttttgggattacaggcatgagcccccacacctggcaaaggtccccctcttttatttcctgggtgttttttcagactcctttttttcagctccatagaaaagctgcctgccgcctcatcctttaggtgctcccatccccccataaacacca

SEQ ID NO: 518363 - DNA, 742 bp, Homo sapiens
gctaacgttactcgtgttcaggatgccatagggatcgtggcttgctgagtggctatcaagtgctgttggatagcttacgcatcccatcatttcgtccgtacttcggactatcctaccctatgtacgcatctcgtcttctcgtggataaattcaggcgatacatagtgatgaatgagaatgatgactcatgataatactggtactctctgattgttgaggtaccgagaggtacggggtattgcacgcattatgctcagcgaggacctcatgggaaccactacgttcaagagcgataaggtcattgcgtgtgtcgtaacgaagttagcgtagcggacttgactggccttctacgtctttcgaatgacgcgccgcgagctccaaggggccaatacttcacccatatggatccacatcggatagataatacttaccaaaaacgtctacgtagcagcaattcctctggtggcgtatttgtcacaagaatattacacccttagaattacacaatagggacgagcccttcggaagaatcctttggctcataggagggattgaccaacgggaaagacgatattgcccctagctcacattcttgccatttgccatttgaccttcgagtggcatagtgcttagtccttgactcgtggctgggcatacgcacgacgatttgactcggccataccgacgagcaatttctccgtagaacccagagatggacttgcaccaaatctttctgcatttg

SEQ ID NO: 518364 - DNA, 544 bp, Homo sapiens
gtgtgttagttcatgtatcaatgttaggtagaatctactgagtgaagccatggttccagatttttatcttgacatcagattttggatactgattcaatcttcttagtattcatagcatattcagatgtttgatttgtggttaggtctgggtgcatttagtgtttcttgaaaattgcgctgtcatctgggttatcgaatttttggccacacacttgctcatagtactctctaaaatcttagtaattgtctgtagaatcgttagtaatgcccctactttaatgtaggtgatttgtagtgtgattttctctgtgggtttccatctgtggctatggctatgttgagataagtttacttctattcccagtttgttgaatatttttcttatgaaaggatatagaatttggtcagatgctttgctgtgtcaattgagaagatacattgtttaccattctgttaatataatatatgaccttgatatgtcggtagagtatccgttcgttacgataagtgatttgacttgggcatgatatatcagacttgtaat

SEQ ID NO: 518365 - DNA, 397 bp, Homo sapiens
aatataacaaatcataaacatattactcacagtcaagtaagagagaaataatgtgtatgggtgactagagggaaagcagagagaacgatttatcttagataatatccagaagtgaagagagaggaaaggataagggtaaataaagaacagaaacaaatatccattggctgccctctgtgggccgagtcttctgctgtgtacttttgaataattttacatcaaagacaaggttgggctatcccggaaggctctgcagatgtgaactggatgtcttgcagctgaatcagatttgaacatttttatgtgaatatggcttaagggtacagacttttgagataagcaaggatttgaattcttccttgacattggacaaattattttaaggagggatgagcag

SEQ ID NO: 518366 - DNA, 831 bp, Homo sapiens
tggggttcgccttgtggcgcattgtaccaacgtggggccccccagtggtggcgccctgattttaagggcccgtccccccaaagtgagaccctccgcgttggtaaaacatttccccgccccccgggggttccgcgcccgcccctggggtccgcgacttttgcgagtgttcccccaaactcgttccgaaatcgcggcgcgcagctttggtagcgcgttcgtgcgcctctagtggtccaaaaagattgctgcaacatatgtgtcggcggcaccacctaaagagcccccccactccttgtttgttccctgaaaacgtctataaactcccggaaacccccgcctttttctaaaagcaacttcctcaccaaggaggttgcaccctccttcccttgcaggcaagaccaactgttcccccaatacccccccatagacgctcccctttttatgtagtcatcccacaggcagccccacaactgccttccgccgcacctctcttccgtggaaagaaaacatcttcccccgccacttctttttttttctcaacgacaataaatattctcggaatttcctcccccagttgtcagtttcacaataattgtcttacccgatatcggtgcagagaacgattcttggtgcttctagcaacacaatagaagcgattccaattttttattctgcgcacgtcgaaataacggagagcacttgggaacagggttcgcggagccaacatggtatacaaaacaggtagactggggaacgcatggggttgtcaagagaagacaggcccggtatataactgcggcatgctcccaatatcttccttgcgaatagata

SEQ ID NO: 518367 - DNA, 716 bp, Homo sapiens
tgcgaaggctcacgcctgtaatcccagcactttgggaggctgaggcagggggatcacttgaggtcaggagttccagaccagcctggccaacatgatgaaaccccatctctactaaaaatacaaaaattcacagggcatgatggcgtgtgcctgtaatcccagctacctgggaggctgaggcaggtttctggaacccagagggcagacagaggttcaagtgattctccttcctcagcctccctagctgtgactacaggcgtgcgccaccacatttggctaatcctcgtattttcagcacacacggggcttcaccatcttgtgtaggcttcactgcacctcctgaccttgactgccacccccctcggtctcccaatactcgctgccatcacacgatcgactcattcgtcctaccttgcccacccataatatctctaccacctcctttcacgccctaaccactgctgtctacaccctaactcctcccacacgctccatgcattacaatactctcactctctctcactcatcaatctcaagccacctctcaccactagccgcaactctacactctgcattcccacatctgcccgcttatctctatcgcctgtcacccgcccaccctctcactccccttactcatcttccttacctccccactcactaatcctccttctactccatcttcactgcacacctactactcctccctttttccc

SEQ ID NO: 518368 - DNA, 869 bp, Homo sapiens
atcatattgaccagttccttttcagaaatttattttgttgtcgctatgcgtaaatcattgcacatctgatcaattcttatatgttaaagagtctctactctcgtctatgtaagggtaccaatgtggtatctagtggctgagaaatgaagtaattctaagagtatgagagttacctatctgaagaatgtacttcaacgagagatactcgatatatgtaacatatagggatgtcgttcttttcaagaatatttttgtaactcttctcatcacatatcatagtgttaatatatagaattctattgtagtagtttctatttaaataaaattagtaggaatttcgccttagaaaattgttggtgttcgtatcgttgacctttatattctttaattgtcgatttaagtgggttactgcccagaatattgagaaatggttcaagatatggagtgtgtttcaatatattatctggcttattctcagcatgagtaagatgaggcagaacataaagttacaacctgcgtctgagtcaattgtcctcatgactcagaactaaaacagtaacatggtggacagtattaagcctcagataatcatctccaaactcctgtctaacgagctttctaaaatcatgattggaacgacgagtggacgaactcacggtacactgtgttgccatcttctatgtccttatgccgaataatccaaggatcatcacatatggtagatattcaacatgggagtttcaaaattcagaatagaattaccatgaactttcctgaccttacacaatcctacatccttatttaacagttctaattttgggagttccgttgctggaagttaaaaatcaggcgcgaagggtcataacggc

SEQ ID NO: 518369 - DNA, 776 bp, Homo sapiens
tccttaataattttaaatggatcaaaacaaagcatctaaaaccgcagttccgggaaaaaccactggtcctggccggtctggtatctctcttcaaatttgacctggtggccccccgtgggccctggcgttaaaaagcaggatctctgaagacatccttattggacgacagtttggcccagggggataatccacagagtacctggggggcataaggtagatggtagtttatcacccacttccacaaaagatttaatcttgtggatctctgggcgatcttcttctggcccatggcagctgtcacttggcgggggtagcggccaaatcccagccaccagaagcagtggcttgaaggggcgactcggtggagggtgccactcatcaagtgtcctctcagcgaagtaacagcttggcgtctccggaagatagcgctccagccgaggacaagccaccaccctccccaagcttccatgaactggccccatttcggcagcaaccacccgggcctacagcaaaaaaaaaaaaaacaaaaacccccaagggcaactataaatgcggggcgcgcggaaacagaggggtaaatgtcaaaggttgcgcccattggtcagattacgacgtgtcccatgaaccacagcttttctttggcacaggcgtgccacactcgccacggcccccaataggaagcgagaaaaaatttcgaaaacccgggtacccggctagcaacgtccgacaagacaccaactccaaacatcaacaactcaaaaacaaggcccacacgt

SEQ ID NO: 518370 - DNA, 1347 bp, Homo sapiens
agcgggagcgctgacttccgggcccactgatcggtgtcctgcatccgattacagctaggtagtggagcgccgctgcttacctgcgtgcaggagaccgccggtgtcgctggtggagctccgcgccgccggacgcccgtgagcattgtggaggctgctggctcgtgctagtgtcgcctgctcctgtcgggtgtccttgtcagacttccttgggcagctcctcaccctgctcagtgctggtcgtttacagtacgaactgcttccaccaagttaccacggtttttgaacgaatgatcttccatttcgcttggaatagaatcctcgatatgcctttaggaattttaatatggaacacacgtggacacgcgacggtatgctgacgcaaatacattgatataggacatgagtcaaccttaaataatgttagacgtttgacgcattaacgcgggggaacccttgttctcaccgtgaaaagacctagcgtgacaggttctctatccagcaaagggggcaactttattgccatagtactttgagaaccactttggtgagtgagtggcgggctaaccccttgccattttgtgtggtcccaccttttggaaacacttggaattggcggcccctttgacgaaggttcgaaagcccggtcttgcttacttgtgtaccccgcgcaaaaaggaaatccactgatttatagcccaagttactgggccaggaggtttaaccccaatgggcacccctttttttcgaaaggctcccaaattcgaacattcggagcaaaagacacgggtggtaaaggtggccacttcagacaattgggtgggcgatgaaacggtgcccacaccacggcggttggcctgtaaatttttggaatgcacagcccttcaaccggttgaaaacaaacgcccttgatatgataaaagtgtggcatgggggacgcaggtcacctttgggtttgcgtcagcaaacgcaattggggcacttggggagccccgtcctttagctcggaaagactttatggacaacgcgcacaaacggttgtgccaacaacgaggggttaaccgccgtgttttgtaaacccctaggggcagatagggacaccgcccaaccaaaaaggagtttttgggaccccccttttttccggacacaatggccccacaatagaggaggcagtcttaggttagtaaatagcccacaggactgcgatgggcaccatttccatatacggcaaggcaacacagagaaatttgcgcggaaagacagagacggcgagttccacgagcgcaggtggagaccacagaggacaggcagaccggtgtaacaccagaagctccagaggaaaaggccctc

SEQ ID NO: 518371 - DNA, 181 bp, Homo sapiens
tctagaggatccctgccccaggcaataagaccagtcacttggctgctcttctcaagaaccaagggtgagtgctgtagtcacacaggtgagtggggtggggtctgagcctccactttgtaagaacgaagaggaactcttgttcctagtaggtcacgaagggcatgaaggcactggatatgaa

SEQ ID NO: 518372 - DNA, 794 bp, Homo sapiens
gcaacagaagcaaaaattcacaaatgggatctaattaaactaaagagctgcacagcaaaagaaactatcaagagagtaaacagacagcttacagaatgggagaaaatgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcatgtgttataaagacacatgcacgcgtatgttcgttgcagcactgggccatcagtgacagactggattaaaaaaatgtggtacatacacaccagggaatactatacaggcataaaaagggaacaagactgactgggcgtggtggtcatgcctgtgatcctagactttgggagccaggtgggtggaattgcccggtcaaggaagtaagaccaagctggggaaacgtgaaacccatcttattaaatttaaaaatttgggctggg

SEQ ID NO: 518373 - DNA, 464 bp, Homo sapiens
ggtcaggcactgaaagcctggtcaggcactgaagcctgaaacacgcccggggcagggggtcttggcgaacaaggtcagtttggaccaacttcagctgtgggggtccagctgcatctcctttatcttctggtggtgacggtagatctggcaggcgatctgcacgttcacgggacaacaacttcccggcttcttgaacaccggccggtacgggtcagacaccttaagctgaaaagcgccctgcagggacccgaaggggccggggtgtgggagcagggtgggcagtcccgggatggcaggagggaaggacgggaagaaactcacgctggaatgtcggaagtaggggctgtccagcttgggcgcatacttgtaaaacgggcgggggtgcggcggggcggcgtcggggggcagcccctgcggggaagggggcgaatgtgtgtaggtgctggagtgtgtaggtgcgtgtg

SEQ ID NO: 518374 - DNA, 1049 bp, Homo sapiens
cgagctgagatcgcgccactgcactccagcctgggtgatagagtgagattcagtctcaaaaaaaaaaaaaaaaaaaaacttgtgcaaaaattttggttttcctctggggccttttctttcttttcttttaaaaactatcccaaaaaattttacttcccagttttaatacaaggggggaccttccatacttttggttttatatttacccttcataaagccccatttcccctttaaagttctgtagtcctagactataaattcattcacccaccattattaacattgttgttacagcctttggtcttacaacggttgagttctatcaataaaactggctgttccccctccgagttcacaccctttcctaggaccttctactgtgatttacatccccctctcctcttacgtgctaataacccagcagaagcacattacttccattacgaactatctgcacttatttttataaacggaccaagggttgacggacggctgcagggcacgagagcaatgtggttgtgaacccctgggcagaaactgggacggcttgcagctgacgctgcagaactcatcgcccagtgttgaacctccagcccttggcgttgaccaacgaacgtttagaacagacttccggtctcaaacaccttacaattgaccttgcatctgcactcaattcacattggacacgaaaccgaaacacaaagggctgcgcttctaaagtgctacgagcaaacacccatccacgttaaaagccaatttttggacctcccccacaaaacccattatcaaagtgtatcctccaaagcaaagccccttataactttcaccctttaaccgcccgtcggaccaatcatgcaacttcaacattggttcgcttcttactaccagacaaacaagctatctccatcttatcgcgtgttcacttgtcccccacaacgtacaacaacataggtcacagcaactccattcgggaccaacggactatctgctccacccaagaagaaaccgggctattaacctcaacgacactacacccagtcaacaacagg

SEQ ID NO: 518375 - DNA, 261 bp, Homo sapiens
gcggggtgcatgcatgcagactatgggcaggaggcccccgccgttgtcttggaagcgctgattgacggccagcgggcgcatctggttggacatgttgcgcagtttcctgcccagggactgctcgctgccgtgcaccatgctgacgtccacgatggaagtgtgcgcgttgatctggttgcggatggtgatgttgctcccggggcaagccgagcaggagcggaagaacgggatgcagccgtgttgtctcttgaagcgggggtc

SEQ ID NO: 518376 - DNA, 347 bp, Homo sapiens
tgggcagatcacctgaggtcgggagtttgagatcagccttgcaacacagtgaaacctcatctctactgaaaatacaaaaaattagccaggcatggtggggggcacctgtaatcccagctactcgggagactgaggcggaagaaccacttgaacctgggaggcggaggttgcagtgagctgagatcgcaccactgcactccagcccgggcgacagtgcgagactctgtctcaaaaaaaaaaaaagccttccccttgtacacgggctaatttacccttgtacccggtatttgcagatgtgtgtctggaaacctataaaagttggctgaaagaacttccagaagacttaa

SEQ ID NO: 518377 - DNA, 257 bp, Homo sapiens
  misc_feature (127)..(127): n is a, c, g, or t
  misc_feature (140)..(140): n is a, c, g, or t
  misc_feature (144)..(144): n is a, c, g, or t
cctagaggatcccggagtagtccacatgagtgttggagggacattcaaccacagcagtatgaaaacaatattcactccaggtatatggtccagattacaggtggtaaggataggctagagaataggnataggctaaattngctngagatgtgctgtggaattatctgtatttctagctaatcttagcttcctcaagtccatttcattgccagaatatgaacaattaaattgagatcccggttctttttttatttttt

SEQ ID NO: 518378 - DNA, 442 bp, Homo sapiens
  misc_feature (330)..(330): n is a, c, g, or t
  misc_feature (388)..(388): n is a, c, g, or t
tcccctcacagagatgtacaggatgagatgtagtaacttatagcagcgtcatttggaaaagttgaatttggccctacaagggcatggttctccattcaaggggtctggtggtaaacggttggagacacagggtggcagcttggagaactcacctctgggctctggtggcttttatggttgggacagctggctaaattaggaactctagaactggttattgggttcccaactggttgggccgcaatgaattcttcgcaaaaatataggtgggtttccaggggaatttggaatgattggtattttggtggtcccatgggaacggtttatagnacatgggagggccgggccataaattcctctcaattaaaacaattacacattcactggnccggcggttttaccacggtcggtggactggggccctgtgcggttacccactttc

SEQ ID NO: 518379 - DNA, 204 bp, Homo sapiens
  misc_feature (16)..(16): n is a, c, g, or t
  misc_feature (96)..(96): n is a, c, g, or t
  misc_feature (129)..(129): n is a, c, g, or t
  misc_feature (174)..(174): n is a, c, g, or t
tccagctaatgttttncgttttggtagagatggggtttcaccatgtagtccaggctggtcttgaactgctttcctaggctctgctctcagctcctnagctcaagcagtccgcctgccttggcctcccanagtgctgggattacaggcgtgagcactgcgcctggtccttaagtnaacagtttttaaaagcagtgagaaccattt

SEQ ID NO: 518380 - DNA, 254 bp, Homo sapiens
ttttcagcataaagctctacaccgacctccggaaagccaaaccttttctgaactacagcagtcagttcccgaatccgccggtccttctcaccaagaacattctgtgttcttgtggctaagataatggatttctgtcctggtagctgtaactcgcaactcaactccacagtagccatcttcagacagctcccgagtaagaaacactcataccagttcaagctttgaagatgccatcagcgacgaacttcctcttc

SEQ ID NO: 518381 - DNA, 448 bp, Homo sapiens
gtggtaagtcgcggtgagtttactaaacatagacagtggaagtatgtaatactctgtgcatcccagtgattcagatgactctggttcttatggtaaaagcagaatgaaaattgctggtggaggattgggcgcggtgactcatgcctgtaatcccagcactttgggaggccaaggtaggtggatctcgatgtcaggagttcgagaccagcctggccaatatggtgaaaccctgcctctactaaaaatacaaaaattagccgagcatggtggcacgcgcctgtaattccagctgttcaggaggctgaggcaagaggatcactggagcctgggaggtcaaggctacagtgagcagggattatgcccctgcactccagtttgggcaacagagggaaactgagaaacaaacaacagaaaaccaagaagccaaaccaacaaacaaacacagaca

SEQ ID NO: 518382 - DNA, 166 bp, Homo sapiens
gcagaggtatacaccataggactggggcgtggacctggtcactgtctcctcagcgggaagacttggggctggtcggggatgctgaggagacgatgaccaggtgcctggccccagtgcttgggcccccaaaatatttcgcacagtaatatacggcaggtgtctggcc

SEQ ID NO: 518383 - DNA, 285 bp, Homo sapiens
gacttagaggatcccccatcgcccaacacaaagccctgccttctggggcttcagctaagttttttttaaaaaatgtgggttttttttggtccatttcattaaggcttttcccttggcctcctcctgtgggtggttcagagttaaatccgaggtgaataagagagggaaatatacaacactgaatttgcaggagaaaatgaaggttctaagtagaattgaagctggacgatcacttaaaagtgtaatggatgaatttggaaccagtaagtcaacattttatgacat

SEQ ID NO: 518384 - DNA, 763 bp, Homo sapiens
gactagttctaggggccaggcacagtggctcacacctgtaatcccagcatttgggacgccaaggcaggcaaatgcttgagctcaggagtttaagaccagcctgggaaacgtggtgaaaccctgtctctacaaaaaatacacagcttagccgggtgtggtggtacgcgcctatggtcccaactacttgggaggctgaggcaggaggataagttgatcctgggaggtcaaggctgctaagagcccgagatcgcaccactgcactctagcctgggtgacagagcgagaccttgtctcaaaaacaaaaatctatgccaggtgcagtggctcatgtctgtaatcccagcactttgggaggccgatacaggaggattgtctgagctcaggagttcaagaccagcctgggcaacatagtgaaaccccgtctctacaaaaaatacaaaaattagctgggcgtggtggggcacacctgtagtcccaactactccagaggctaaagtgggaggatggcttgagcctgggaatcagaggttgcagtgaagcaagactgtgtccactgggactccagcctggacaatagaatgagaccctgtttcaaaacacaacaatttttttttttcacacaatcgggactagttcttccatattgaaggggtattgggtgagggattccacggatgagtgccagagactcttaactctggagtcttccagcttttcccaataaagtcctattcctattgcagtcttccttgttctttctact

SEQ ID NO: 518385 - DNA, 313 bp, Homo sapiens
ccatataggttggacgagagactgattcagtagtttctcttgataagagaccactggccgtgggcgggttctggacagtttacagaagctatgcacttgattgcctttgtgtccctgcttcaccttttgaagcatagggcctaattataatgtatttaaatgttgcctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactat

SEQ ID NO: 518386 - DNA, 299 bp, Homo sapiens
gtcgacgaaatatctgcaatccaacttaggtttgcaaagtatccacaccaaggaataccaaaggtttctaaattagttatttcgtaagtcgaataattttgaatagtaacaatatcatttgttgtacccaataaaatattttcgctcagttgtttgatgtcgggaattgcatcaatactttcttttaaagtacaaaatgaaattattctgtttacaccacgtccagtgtttggatttcgtttttaagctatcaaaaatgtagttactacatctgcattatcaaaccattttccttttcc

SEQ ID NO: 518387 - DNA, 323 bp, Homo sapiens
cgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgtacagtttatatacagaaaagtttgctctgcatttttgatgatggtttggaacattatctacaattttactctcaaatagtcaaaataaaaacatctcaatttctaaaaaaa

SEQ ID NO: 518388 - DNA, 277 bp, Homo sapiens
  misc_feature (18)..(18): n is a, c, g, or t
agaccgtaatatagtatnccatctttaatatggtgggactaacagcagtgtagatggtaccttaatatttttggctgggaccttctacctgccttacactacacttaggaaaaagtattacatatggttaatttggaaacttcaagtataatggccttaaggtctcttaacccggttacacgcggctggtagacttgttaatatagtaatacctttatgatatatggagtttaaggactactcttttccggtttaatcaggtatgctcagcgctggg

SEQ ID NO: 518389 - DNA, 537 bp, Homo sapiens
cttttacaagaaaagtcttttctttttacaacttaagccaaacttaagggtggttttttaccgtgtggtgtccccaccttttatcctttactcgggactcttcagcccagacacggttcaaaaacaagcaacaacaaggcttgtgacatcatagaaaccaatttcattgcatgtttccatggtattaaagagttactttaaataaacgtagtcaagaatgtaaatgacccccatttttatcccaaaaatagcaggctggccaggcacagtggctcatgccgataatccctgtaatcactttgggaggccaagatcgggggattgcttgaccctaggagttcaagaccagcctgggcaacatggtgagaccctgtctctacaaatttttttctttttttaattagccaggcatggtggtggacccctgtacatccagctactcaggaggctaaggcaggaggatcacttaagcccaggaggtcaaggttacagtgaacagtgtttgtgccattgcactccaggctgggcaatagagca

SEQ ID NO: 518390 - DNA, 800 bp, Homo sapiens
  misc_feature (689)..(689): n is a, c, g, or t
  misc_feature (691)..(691): n is a, c, g, or t
caagcttttacttcatctgtacaatgataaaactacaagataaatattaaggcttttttttaagtaattttaaacatcagactaagcatagcaattgttacattgccaagtttatgttgattcctattaaagaaatcttctggttgtagactggcttatcttactcatgttacttacacccggtagagttcttgaattttttatcacaatgcctagttatttagtctagctgctttaagaaaaataggtacgtatgagtcctttagtagtacatttaacaaaaagctcattgttttttaaatatagaaacttaatattttaatgtaaaggcactaatatgtaaacgaagttttcccttgttaatactaaagaaatccacattttaaggataatgtgaactatttgcccctgtcatccttctaggataggcagtactttgtgaaccagctacaacagaatcagctgcagtgcttgttaaaagtctggattctcaagttcactccaaacttattcaatcagtttgtgagagtatgtcccaggaatgtatatttttaaagaagttccttgtgtgattctaatgcatgcaactaattatattgttatagttaattgtctaatcaaccaaagcatcctattcatcattactttatctgctgttaatgtcatattttatctttacttttcagacntnttgaaatcctttgagtataactgactttgaccatttcattatatccctagtgggttcgggctaatagtcctatcagtgctctaatccaccttcccgggttgtttcaccc

SEQ ID NO: 518391 - DNA, 87 bp, Homo sapiens
atttaaagactaatgttaattgttcttaaaactgggatttttttccttaaagcaatttttttcttttcgatttaatgaagtattgct

SEQ ID NO: 518392 - DNA, 129 bp, Homo sapiens
ggacaggtcagctgttactgaatcatcggttacagatcatgtggaacaaatcatacatgtagaagattatgtaagaaattcattgttaggtaaggagtagagagtcaggaagaaacagctggggatctc

SEQ ID NO: 518393 - DNA, 387 bp, Homo sapiens
tttttttttgaaacggagtctcgctctgttgccaggctgaagtgcagtggcacaatctcggctcactgcaacctctgaattcctgttcaagctattctcctgcttcagcctcccgagtagctgggattacaggtatgcaccaccacgcccagctaattttttgtatttttagtagacagggtttcaccacgttgaccaggatggtctcgatctcctgacctcatgatgcacccgccttggcctcccaaagtgctgagattacaggcacgagtcaccgcgcccagctcaatgtgaatactttctacatatttactgtatattatctcctgctactcttccatgcaccaggtaatgaaagttaacaaattagtgaggagcccgccatac

SEQ ID NO: 518394 - DNA, 1123 bp, Homo sapiens
  misc_feature (383)..(383): n is a, c, g, or t
ggtcggatcctttcgctaaaatctcaagaattgctgctttgagtttatactaatgtgtggctctcaaaatctgaggtgtcctggccattctcagcgatttcctcagtggcgcctcccacgctctgcacaacctgcgagtgtcttatggctagagttacactacccttgatgctatagaagcttgatatgctagtagattcatgagactcatgtttattatattctcacatctctagtaagctaatttgatcaccaattctattacttcgcgaagtgtctcactgtgtgaacacttgtatcttatgtctcacactgttatatgagaacatcgttgcacacacacatttactattgaggcgcctttcctaccgtttcttagaacntatcaataagctcacttcttcacatcgtaggacgcatcgcaccttactctcctaactgtatcatggcttcgcctttctgactatctcctgtcctaattaaggtcgttacaagtgtccggtgattgccctgtggacggcgaagtgatcttgtacaacgatcgctgcataaacacacaatacgcgctttttagacacttagttgccagcatattttacctcaaatctcacaatgtggatgctcatccccgttttaagtagctcataacattcttcgatttgctttaccaacttctataagcataaacgctaagggcctgagaatttctttaaggctttttcgtatctttcctactcatggggggagcctcaagaggccttgtgtttggcgttcccccattaatcattatcaagagtacctatttgtagaatttgcctactctcccttgtgaacttcattatgggctttatccgaaccacagaagctggctcgtggcttaggcaatattccgttggggggtaattcccgattttcccctaacaatccagaccacgtgcaccgattcctttaatcttaagcgattctctcaattcctttcttggcacaacaagcggtatctggtttagacagtggcaactgggagggtctccccacctaaagttttttatagaacaaaacccggggattattcgggtcaccattgctaaacgagagatcatcctagcgcctttctaagacgcca

SEQ ID NO: 518395 - DNA, 438 bp, Homo sapiens
catctcttcaacagacactggtatctatcatatagtatctactttacggaagcgggagagatcttcgatagataagaagctcgtggtatgatagttaattgtccatacctcttcctgactctgggccatacttgagaataccgtggcagccgtgtgtccctaggctcaggctcgtagcttcttctcgcagattgtcatcggtgtaacactcttagcagacccatgttgcttcaggcacaagaggtacctcattctagccttagagatgtcatgggcttataacatacttgtcttgctttgtgcagtttcttctgtctctcatataatcattttgtctgtctacacagaaatctctacactccaagtagagttaaatgtctaaatctaagttaaacattatttcccatgaagccttccccatttccacgaggtaatttg

SEQ ID NO: 518396 - DNA, 157 bp, Homo sapiens
gtggacgctaatgctttctgtccccttttaggtgctgctccaaatgtggggccctcccaaagggccttggaaacaccataagggaacaaggaaaggggctcggtccctgggcctgacacagccctgctgctcaataaataaatgcaggtggccttta

SEQ ID NO: 518397 - DNA, 850 bp, Homo sapiens
ccacttttcgtgccccggggtcctttaattccccccccccgacctcttctgtcggctctccgctcccacccccacactggggcaccacatgtgatgccccgccccttcttggaagcccactccaatcgtgttgtctcagtattacaatagccaagcactcgcgtctcggaaaaacacactttgttcctccccgctcgcaatatagccgcctgcgctctcacacagctactaatacacacccgggtgacacctgtccacacacagtttaacacgcccccacatacatttctgccacccagcttacgcccaccccatcatgcactatattgtattccactccctcactctatggcatagacgcctccacactcacgacggcacagcatgtctcacacaaagaggaaagaaggtttttactacaaagacatactcttatatatagcgatactctcgcgcgcacacactttctgtctctctcacccgcccgccacgtgtttcaccgctcacatacaaacacttcgcaaccctcgctgtagcagctctcacactcccacttctcatcctttataagtggcccccccccccctcctcgttgcgcaccagcgcgtagacgacacacacgtgttttaacgcgcccccgcgcggatcgcccttaacctccgacccaaacagcgacggcacacaacagcaccgatggtgtctcaccataacatatgggagcccgctatctgtgacaggcccctccgcagaggaggatcacaccgagtcgtctttgcctttcttacaccccggtgaaggatgaccccgccccccttgaaaggggccgggcccaaccccgccccacaatgac

SEQ ID NO: 518398 - DNA, 130 bp, Homo sapiens
cgccggaagtttcgcaagccccgcagccttgaattttttgaattccgaaggggaagcccgccgggtttaaacccgggaccggggcctttggggtctctaatttgggttccggtttccccggggggccccc

SEQ ID NO: 518399 - DNA, 154 bp, Homo sapiens
ttgggagctaaggcagcggacacctgaggtcaggagtcgagaccagcctgccaatatgtgaaccctgtctctactaaaaagcaaaagtagctgggtgggtgcgcatgcatatagcccagctactcagagctgagcagaatgcttgacccaggag

SEQ ID NO: 518400 - DNA, 169 bp, Homo sapiens
taggttggaaatgcagtgttatgggagatagataacctaattttcatcagtagggtgtgtgtgtgtgtgtgtgtgtgtgtgtgtgtgtgtgtgtgtgtgtgtgatctccttgtggctggacagtgatgatgttagctagatctaattttccttaatgtgcagagggatt

SEQ ID NO: 518401 - DNA, 497 bp, Homo sapiens
ccttaaatcatagatggccttacagatgaattcttaccctgcagaatgggttaaactgtgcttaacagctttaattcgtgtgagattgacagattgtgaagtataaacttagcccaatctcatgttaggataagaaaaagcgatgtcccacaaaactcaatgtgacactaaagatctaaacaattttttgtaacttttaagtttcttatcaaatttcaccacccagtatataataagcactgttaatattggcttaatataacgtagctggtgaatttgtgcccgcatttaggcggacgggaaaattaacgccagaatatcccgaaagtctgatctggtcatctcacagttacgaagttacgtttatagattctcacgtctcttagtgtttttcttacgcgccttttgggaatctccagttacctcgtggtttccgtcatcaggttcttggcatagatttctatacattcgttttagaactattttaactaggtctt

SEQ ID NO: 518402 - DNA, 1694 bp, Homo sapiens
tagcgaggcctgggtggagcaggcgcctgtgcctcctcctacgtcccttcgccgcgtccgcgacagcctggtagccgtgcgggtagccccgcgctacgccatgtctgggcgagctcagcaacaggttccaaggagggaaggcgttcggcttgctcaaagcccggccaggcagcaggcaggctggccgcagatcaaccgggagttactgctgtgcaccagcacagtcacagtgatgcaccgcagaaccttccagacaacagctcaccagccttccaaagagcaagtacatggcgttcgcacctgcaacaatgcaaggcgcagcattgcacctgcatgctctttcaacagcaggcatgcatggcgcaagcttgcgtgtaccccaagcacccaacctggcagcatgacagcaagcatgcatctccagcaggtccaccagagacgggcagtccagccgcagcaatcaataaatcctcacccggcagcactaacagccgcaacccatgaatcccctagccgagcaacaaccgcgaccgagcctggcccctcccaagatacaggtcccatcgcaacgtcagcaccgcgcaccaccgccccaacgcggccaccaagacaagagacacagaaaagcgcccacgaaatggggaacacaccaccctacacgacggcatgcacaggcaagcagaccaattagactcacacaccgaggccaccgatgcgaatgagaacaccacccgcagaccaatcaagcgaacacataccagccccaacacgcacactccacacccgaaaacaacaaccaccaccaccaacataccacatccgccagacagaccaccgacaagagacacaccacagcacgcgaaccaacagaccacaagaaagcaaaaccacacacaacaacacacacctcccaccactaccacagccccaaagacagacaacgacaagacgcaagcagaccaagaacagatcgacagaacaacaacccacacacgccacacgcacgcaaccagcacccacgcacgaccgacacccacacacgcaacaccaacacacacacaagagcgagcacaccaagacagcaccaagccgaacaacaccagacacacacaactaaacgtaataacgcgcacaccaaccgccacttcatcccaacagcacgaatcagacaatcacaccagacgaaaaactccacacgcaacagccagacaacacaacctgacaatgctagcaaacatcagccaacgtacacgcacagcaaaacgagcgcgcaccgtgctaaatcgtgccacgtggacatgccatccaatcagcaccaccaattcctacactacatacgtagatacgcagaaacaccagacaaataaatcgaaactacataacggcaacaagctacatacgtacacaaataatgagaagacatgacactcacctactacaacatacctcagacaactataaacaaaacgcacactaatacacgcacaaaccaactataagcaatcgcatactgaacaacaacaccatcggcccaaccagaacaacataaataactcacacgcacactccactaccaacttacatcaatacacagaacaccagcaaacatacagaccagaacacacagccgacgaaagaaactacaagcaacgctccgaccccacactaaccagtactacccacacatcaagacc

SEQ ID NO: 518403 - DNA, 428 bp, Homo sapiens
ctatcatgcagctgcagtagatggtgcgtccggatcagtccacaaacagctcacacgcatctgatcgagcctcagactcgccgtctcgtagcctcagattcgccaagagtaaccattatctgccccgctggagggtgccaaggactcacccgtacgtcgtgctgtgaaagacacccttgccaagccacagtccccacagccatcagcttacaactcccctaaagcaatacacaaagtcacatagtagcttcgagccacccggcttgggacatgagtggatagcgccaaacggccggcccttcttcattgatcataacgaagagactacaacctgggaagatccacgtttgaactttccagtacatatgcggtcacagagcatctttaccccccaagacttgtcagtcaccctcactcctattataata

SEQ ID NO: 518404 - DNA, 265 bp, Homo sapiens
gctgttcttaaggatggtgcataagtgaaccatggactgactgggatattgtcccccaataatggccttaagacatttgctctcgggaagtataaagatcattccatggttccagtttaaaagaactacgtgtgtatccaagcagagaatttaagagcttgcttggaacaagtgagaaagtattcagaattctatactctccacgaggttcccatgctgaatgggattcttcccattcagagtagagatgggattacagttagaa

SEQ ID NO: 518405 - DNA, 443 bp, Homo sapiens
cgatgagtatggcaatgcataattaggtgtttttaaatgagatattatgtaaaattgattgcaataactgtcacacacctctatggccattgtagggtttatctctttctctgatactttttatgtgtgtgtttattcaatcatttatcaagtaagaattttacgtgctttcactaatgagccaagcaccgacacatcctgatatgcttccatctaggacttatagctgcttatttttacatttaacatgcttcttttcctccagcaaactcttttaaaaaaaaaaatgaaactctttccttcaatggagattatttcagaagttgccagtcatcttggaacccagaactcagtaataagcaactgcggcaccacaagtggaaacctttggatgatgggcccagttggtttcatggaatacacgggtttactgctataaccca

SEQ ID NO: 518406 - DNA, 2044 bp, Homo sapiens
  misc_feature (1527)..(1527): n is a, c, g, or t
cgtagatccagtctagggaataaagtcggaggctggcttggctgcgaaaagagaaaaaagaaaagagaagagaaggaagaaaaaggaagaacaaagaaggaaactagaagaaatgaagccaaaaataaagagaactttgaactccaagctgctcaagaaaaagaaaagcttaaagttgaagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaaattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccacaaatacaacanttcatcagcttcaacggtgctggtacatctacaaatggcagtccagttcaccttctgtccgaaggcagtttttgtcacagttgttaaagacttccatgccacacaaacaacggtacaaacacggtaggaaaacaacactgggcccaaaatgcccatataccatggccttggccaaggacacctttccgtttatacgccatattccataaacagaccacagagggggtttctaaaaacgcccttgtttgcgatgaccaccatcgcagaaaaaggggtgatatacgacacacagaaacgggtgtaccccatgtgtgaaaaagacatgcaaccacaacacagacgtctggtgacaaagcacaatctataagacacaggacgatatgtaagaaacaacatactaagtgtcaccaagcaacattgaactaacataagcaagcgtgcgagccaatacaagccagctcgacgacaactgacaccaacgtatctctactatgtacctactatctagtgaatcgaa

SEQ ID NO: 518407 - DNA, 1251 bp, Homo sapiens
  misc_feature (734)..(734): n is a, c, g, or t
gctcgcggcgtatctagaggatcccattatgcacgtggacggatctgctggaaagtctgagcagcaagcaaagcatgtgcaaactgtggaggaggatatgctaacagaaagacaagactggagaccggataatcactataaggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccacaaatacaacanttcatcagcttcaacggtgctggtacatctacaaatggcagtccagttcaccttctgtccgaaggcagtttttgtcacagttgttaaagacttccatgccacacaaacaacggtacaaacacggtaggaaaacaacactgggcccaaaatgcccatataccatggccttggccaaggacacctttccgtttatacgccatattccataaacagaccacagagggggtttctaaaaacgcccttgtttgcgatgaccaccatcgcagaaaaaggggtgatatacgacacacagaaacgggtgtaccccatgtgtgaaaaagacatgcaaccacaacacagacgtctggtgacaaagcacaatctataagacacaggacgatatgtaagaaacaacatactaagtgtcaccaagcaacattgaactaacataagcaagcgtgcgagccaatacaagccagctcgacgacaactgacaccaacgtatctctactatgtacctactatctagtgaatcgaa

SEQ ID NO: 518408 - DNA, 157 bp, Homo sapiens
attcgcggccgcgtcgaccttggctgatccatttgcctccgtggctgttgcccctgtggctgctgccaccacagctgctcctgctgctgctgcagcctcagctaatgttgaagccaagaaggccttgaccttatcagcaagtgggaaggtgtaatcc

SEQ ID NO: 518409 - DNA, 220 bp, Homo sapiens
gggctacagcatcagctcacttgcagctgtcaggctttcccaccaggaatctgccccacagccatgggcaatgtctgtctctttggctggcagacagaacagtttttatgggcatttggtgcctaagatggtgcaaaagaaacatgtctaaatgcagcctatctctgcactgtggcagtacccgtttatccactcatttcacagacccaggtggccactt

SEQ ID NO: 518410 - DNA, 297 bp, Homo sapiens
ttgtggactcatgcgacggcggacgtttgcgagctgctgtgccaccatataccccattctctcaggatataattcgcccagtctggtgctgtgttgtcttttgtgccagctacttgaaggctgcacggtagcgcggattgctttagctcgggaggttgaggctgctgagagtggtgatcatgcctctgcgttccagccttggtgatcagatcaagaccctggtctcaaacaacaacaacaacaaggatcaagatctatgccaaattgataccctgtcttgcgctagccttatgggaa

SEQ ID NO: 518411 - DNA, 101 bp, Homo sapiens
  misc_feature (1)..(1): n is a, c, g, or t
nggactatagagcatccccgactacatacttccgcaacttcaacaccaccttcttcgactcccgccggaggaggagaccccactctatgccacgacctatt

SEQ ID NO: 518412 - DNA, 430 bp, Homo sapiens
ggggagtgatcttgagtatcctcgaatatgcatactagccaggtacgttatgactgtctccttctagtgttgctggatacttgcagttctgccatcagctccactgtagcaagtagttgctgggaagtaagctggatgatccaggctgctggagatccaatgcctagttgtctccagagtcttttatgagcgcgaatctctgccaggggctccggcataccagtgattccccttctgtgctatagacaagtctacagtctgcaactaatgggaaagggcaccattctcctcaggcacattattggggcccccacagcaagactgctagggtctcaaggaaaatcgagcttaatgaatgcgagcaaaccctcttcatttggccaagtcagctttgtcaggaagggtccatcaatcaggcaccacatgttca

SEQ ID NO: 518413 - DNA, 125 bp, Homo sapiens
ccgtcagctggtgagtggataaactgttgtagattaatgcaatagaattattatttcagcccagaaaaggagtgacgtactgatccatgctttgacatgatgcaccttgaaaacatcgttaaccc

SEQ ID NO: 518414 - DNA, 260 bp, Homo sapiens
cggcgtccggctgtgggtatggctgtgtactgtgtcttggcttcacgagcagcctctgacggtcttgtagaggaggctgaagtgctaggacagccacgtaggccatgccgagttaggcagcaatgcaaacagccaggagcaggtcaaagacggccggcttgactctgtacgcatacatcacttgcttcagctggtcgtagaagacaaactctgggtcccgccgtacatcagggggttaccgacgctcgcattttcgtaac

SEQ ID NO: 518415 - DNA, 897 bp, Homo sapiens
gcaaaataggtcttatgatgtctatcgtgcggacaggaaaactgagatttagggaagttaagaaaggttcccaataattatacagtcagtaattattggatccagacctgatggactccaaagccccatgtttttccactgcctctcttggggagctttcaaaaacttctagaagacatgaattttggttccgtgatgcataaaaagaaacgaagcctgcaatagaaaccagttcagccctcttttgctttataaagagtccctgggactgggtccttggaatctgaatgtttcccaagggttgttagccagattcctgatttgtttattgtacttatcacaagtcagagatagctgaatatttgcatttctgaataggatctttttgtacatttcacttagtttttgaatggcttgtcagaagaaactcaaatttggactgggtcacccagcaacctcaggccagagctttgagatggatcagtttccccctggacttttacagcatcctaaaatgatgagaattagtacatttgtaaggaaaggtcctactgagctaagaaaattggtctttctggacaaggctgatctcatattgggtacacagtactctccataggagttagacttcggggggactggctgtgaagagttgcaggagggtgggtatgatttcattctatcaaatcctttaccaatctgtgctcgggatgatagaatccgggatcctaactgaaaagcaggtttccaatgaagcaactttaagaactggcggttccggacctgtgtggacacgtgatccttttggtagttcgcaagaactcggaacctgttgtttggtggcatttactggccggactatgggacaacgagtgaatgctcctactttctcaatat

SEQ ID NO: 518416 - DNA, 290 bp, Homo sapiens
  misc_feature (174)..(174): n is a, c, g, or t
ggcagctatcggttcatgtggtggactgcactccattgcagaagaacggaactacttgtgtgtgaagtagataggactcgaaaggcacccaggtgttgtcacaaatttttgaatttccgaatgagggagaacaggtacctgtggatgtggtcgagatgaaagagaccatcatangcctttgctgggaaccaaatggaagtaagtttgctgtgctgcacggagaggctccgcggatatctgtgtctttctaccacgtcaaaaacaacgggaagattgaaccggatagcttg

SEQ ID NO: 518417 - DNA, 1488 bp, Homo sapiens
  misc_feature (326)..(326): n is a, c, g, or t
  misc_feature (937)..(937): n is a, c, g, or t
  misc_feature (1174)..(1174): n is a, c, g, or t
  misc_feature (1188)..(1188): n is a, c, g, or t
  misc_feature (1488)..(1488): n is a, c, g, or t
ggccctggtacgtcggatcgcatctaagggtccgtctatccgtcccccacagcaccatgctaaccgccctgcagacgcgagctggtcctacggaggtggcgatccccccgcgggcaagtgcgtgcctcgcacttgcgcctgcgtctggtcgcttgctcacgcgggttccctcagcgcgagtagtactcttgcgtttcgcggattatcgcctggtggagcccactcctcgccgaggctctcctcgcccattacatgctgagtctagccttggtgcagagacagctctgggaaactggtccacgccatacttgtcggcgccccgagangctttacattgcggtagagacgcacacggtgccatgatattagcattgtagaggtgtatcaacttgtcgccaggatttagtcctagcggaccacatgcgtgtgccaccccgaaccttagcccttacctacgagcttgcctcaactagaggcaacgattggtcccttggacatgggatggcgatgcttaccagtacgtctcctagcgttcgcgtatgcaccaccatctgtgatccttgggtattgtacttctcaatacgtcgaacgagttccaaatatgtcgtatcatttatccgcaatgcgtgtataccctagtgcaacacctgttcactacgcatgtgtgggcatggctcctcttgcggtgtccggttactccgatcgaggagccaggtttccgttggtgcccgtttaccctcgtggtcaaaaccctagtggaatcttcttctatccctccctccctcgtggtacgcaattacccttctccgagtaggcgctatctttccgcaactccctaaacgcattcgtggactggtgccctgtccgggcgcgaattcctatttggcacgagacacgccttttgatttcccttttgcgaattgacctcccctagggnactctcgggggcggagaggtccggggcacggacctccgagtcctacctcgaaagtctccatcctaagcttattggtctttcagaccgcgtgaacgagacctgttttttccccccggcgagcctggtcgttcctcagttccttccttgtgcggaaagcttgggggcgttctccggggcaggcttatcgccacttttttcccgaccgcggggggcctttggcttttttttgagggcccnttctcaacctctcntggccgcaaagtttcgcgctcgttgtttaacagaggcggccccttggggagtccgcaggccaaccagagcgtccccggcggtaacaaatggagggagaaagagatataacaatatctaatagaaccagtccgcgatatataaatatataacccccaacaaaagagttgcctccacaaaaaagcggggcggagccgacgaacaagttggcgaaggctttaagctcgcgcggcggagtaaataagtacccccgacgaggaagcagcactacacactacaagccactacgtgcatacccgacn

SEQ ID NO: 518418 - DNA, 248 bp, Homo sapiens
gcaacagtggctttaactatctaatcagtgtcctagggaacctatgtcaaaacaatttttgtcttactccaaacagaaaaaatggtacacactttaacaaaagccaaaacttaattgtaagatctgtactgtaaagctactagctatagcccatatatacagtctgttcaacaatctcactcatgacagaaaaagtcagcaaataagaactggaacaaaattattttctatcagtctccacatggaaa

SEQ ID NO: 518419 - DNA, 173 bp, Homo sapiens
atcatgagaaggaggctaggaatacatgccaggcaatgtgctacatgaacctattgagactgagacatgagcccatggttgaggactgtatggacgtgtgttaatggacgtgtgagggagaggacgggtgtgagggagaagatggcatgtgaagaagaggatggggtgtgaag

SEQ ID NO: 518420 - DNA, 627 bp, Homo sapiens
  misc_feature (149)..(149): n is a, c, g, or t
  misc_feature (174)..(174): n is a, c, g, or t
  misc_feature (213)..(213): n is a, c, g, or t
  misc_feature (277)..(277): n is a, c, g, or t
caaaaaacccgtttttttccccggcccttcgtttgaaaccgggcctttgtggtttaatgggggcgggcacccccagggtaccggctccgttccagaatataaatttccccaaaaggatcagtttaatttaagaagttcccaccaatccnttctcttttaaattttcttggaaangcattttttatgaatagaatcaggctagagtgggagagnaatgcaccagctactgggaagggggagctcagtctgaacctgggggatcagggcagtagggacntctcgccttgtccactgatggggggtctggctgttactcctctccgttcagcacagaaagaacttggtcagtaaacatgcctgtgtaagtgctcatgcctgctgtgcttttgctgtacaagtccttgagtttctcatctacagcggcatggtatgtcttctcgtacaggttctgggcggctgtctttgctgactcccagtaactggagagagattctttcacttgggtgagtaaaggtcgtggctaggcatctcttctgcttggggctgttgggtcccttggacctcaaatcccaataccagtaggacaagaacaaaagctgggagcagtcgtgggcccatagtgtccag

SEQ ID NO: 518421 - DNA, 357 bp, Homo sapiens
  misc_feature (22)..(22): n is a, c, g, or t
atacagacatcctctcttctcngaagccctggctccatgtgataaccaagcccttttccatatctttgtaaataaaaattatgatgacaagtcaacaaaatattcttcacctgatttttaaaaaattcctaaactatcccatgccacagtttctttttaatgatattcgatacggtttggctctgtgtcctcaccaaggtgggtggatcacttgaggtcaggagttcgagactagcctggccaacatggtgaaaccccatatctactaaacataaaagaattagccaggcatggtggcacacatctgtaatcccagctactcaagagtctgaggcagaagaatcacttgaacctcgg

SEQ ID NO: 518422 - DNA, 107 bp, Homo sapiens
gtgagaggaactggattcactgataaatcaagagatacatcaagaagactcgacggttccagtccgggcccccggaccacgtccaaacttactcgcacagtgacaca

SEQ ID NO: 518423 - DNA, 101 bp, Homo sapiens
  misc_feature (95)..(95): n is a, c, g, or t
gaactagagaatccccggggttccgactgtgtgactgcaggtattccacgtacccggtctccaggagcccttataacagcagtgcgtgtgcacgncagggt

SEQ ID NO: 518424 - DNA, 936 bp, Homo sapiens
ggagtctaaagaatttgcacccactgaagtcaatgacatatggaagtatgaagatgataaaaaagaatgggctgggatgttgaaggaaatacgttatgcttcaggagctagttgcctagcaacacgtttaaatctcttcaaactgtctaacactgtgaacaaggtgacaaaacataatagattgggaggtggttgcttggtgaatggggctttaatttattctgttttttaaaagcttgtacagacactcatgtagaacattattcacggcaggtcatggcctaggaagttgaccgagaatgggtagagaaacacctcagtctattgactcttcagtgtagtgatcagagtttaaaaccattttctaatacataaattacatcttcagttgaacaaattatttgtgaatctgtttcactcaatggattgtcaagaaggctcctaaattgagtgttgctaatcatttcatttgcatcattagggtatccttaaactgattttctattacaatggaagtggacgatatgtgcatctacactaaaaaatgtttagatatcaaaaggctctcctcgtgcttcaaaatggacagggaatccctgtggccatattactaaggaatttacatggccattaggaaggacttcagaaatcctacttccggaaggttatacccgggcggcgactcggttgaggggggaaagccctcgggtaagtcacaggtggtccatcccaaacaaacaagagaaacaacaaggtggcgccgcgcgccccgaaagttcaacacacgtggggcggggccccaaggatcggacgagaacggcccagaaacgcgcggcagcggggtctcaacaaaccggggagaggtaaaccagggtgactggcacaggcggcacacgccccacagggcgagaagccgaagacgagcgcacaccacat

SEQ ID NO: 518425 - DNA, 213 bp, Homo sapiens
tattttccacagggcctcggatcttcttaaacacgttgggatacttcttataaacccagggggttaagtctcccccatcatccaggatcatgtgggccggccacccatccaggttcacacagcgggtcaatacaccaccagaaagtcatcttctggactcgcccttccaagcggaacactggcaatctccagcctcaagccaagtggctggca

SEQ ID NO: 518426 - DNA, 101 bp, Homo sapiens
tgttaccactataggaacggtgcagagggtagaccgtcgtgagaaggttagtttaccctactgatgatgtgttgttgccatggtaatcctgctcacgacgg

SEQ ID NO: 518427 - DNA, 225 bp, Homo sapiens
tgtatccccaactgacctctgaatgaggctaaaggaggagcagcatccagtaaggaccgaatgaacgctgaggtcactttctgggaagccagaacaggaagtatccatatgctgaggaagaaaaatcagtttctggaactgatgtcccagaagagtgcagagcaaaaaggaggctcaggagaagcagggagacggtagtttgtgagcatagtattacatagtgtg

SEQ ID NO: 518428 - DNA, 359 bp, Homo sapiens
  misc_feature (77)..(77): n is a, c, g, or t
  misc_feature (83)..(83): n is a, c, g, or t
  misc_feature (174)..(174): n is a, c, g, or t
  misc_feature (311)..(311): n is a, c, g, or t
  misc_feature (316)..(316): n is a, c, g, or t
  misc_feature (335)..(335): n is a, c, g, or t
  misc_feature (350)..(350): n is a, c, g, or t
tcctatggcacatacctaacccacaaatatatccataatttcattattattatttcctaatataggaattgccttanacgtanttttcgttttttgagacagtcttgctctgttgcccaggctggagtgcagtagtgcgatctcggctcactgcagcctctgcctcatgggttnccagcgattctcctgcctcagcctcccgagtagctgggattacaggcgcatgccactacacccagctaatttttgtatttttagtagagacggggttttgccatgttggacaggctggtctcgaactcctgacctcnggttntccactgcactccagcctntgtgacagagtgagnccttgtctc

SEQ ID NO: 518429 - DNA, 896 bp, Homo sapiens
  misc_feature (820)..(820): n is a, c, g, or t
tacccctccttagttttatgcgctcaaaaaccaatttaaaccccccccccaatgtaacgggggggcgggacaaaagcaaaaacgcaaaagccgccgggaaaccaccagttctggcccccgcgaattaatcgccctgatggtgttttgggttttcatctggtcccggtggctgggtgtagagttggaggggttggacgcctccgggggggcacgggccattgagccccttgggagaatgtcagaggggatgtggaagaaggccattgtccgggcctgggtctcctgggggacagtgcttgtgtcccaagaatgtcctgacggccggacggggggggtgcgccagggtctccccagtgtgtcagagaggggtgctcgggaggccacgaggaggggggccccgtgggagtgaacctgagggtgttggccgaaggggcagcggggtataccagcggtggtgttcacaccaggcgggtcccatcaggtgggggcaagggtgggacgcctctccgaacaactttgaggaaaccctccctctcccttcggggaaattttgggcacgcgcccctcaggaaccctgtgacttgggttctcacaggagggtcagaacctcgtggggggaccccttgcggcaacggctggggttcaagccggaaaaaagagaagcagggcaggattgaacccaaaaaagacagaaagcagcaggttcgccatcacacagtttgtttgggcccgagaccagggcttggagtgcataaaacacaaggggggaaagggtgaaaggaatggccggaagtaacacgcccatgtgcccggctaaccngtgacacgaaaacatagaaaaatgccgagcagggaacccaggcaagaacaccaaagtcaacacgatgtcataatac

SEQ ID NO: 518430 - DNA, 304 bp, Homo sapiens
  misc_feature (107)..(107): n is a, c, g, or t
cgatatcagcatctctagaatataatcagaaaatgaaaacagtcaataagaattggacacaaaagtcatagtagcattattcatggtagccaaaaagtacaaacaanccaaatgtccatcagctgatgaatggatacataaaatgggacatatccatatgatagaatattgtttggcaataaaaaggaatgagatgctgattcatgccacaggtgggatgcaccttgaaaatatactcagtgaaaaagaccacatgtatgattccatttatatgaaatgtctagcatgggcaaatctatagaga

SEQ ID NO: 518431 - DNA, 115 bp, Homo sapiens
gtgtcggggtccacggtgtatctgaggcgagcgaaccgcaggacagcagtcaatcatgagcgagaatgcggagcttcccctccccctctctcccgggaaccggatttggcggccg

SEQ ID NO: 518432 - DNA, 570 bp, Homo sapiens
tgggtgtttcatatcattggaggtttgtcagagagaggtgatctggctggagaaaggttcatctgatggctatggacagatgacttgaagaagtggggaacgagggaaggaggtcagtgtgaaaatgataacaagggtccagactctgtgatgcagctgtgaccatgacaacagagcagctgtccggttagaagctggagacatgaactggggcagctctggtggatagtaagccgggtggaacagatgatgtcaggtttatacctagaggacacatgatccattcacaaagccagggaaacctaaagagaaaacacttagaatttgaggagaagaggctagggctgggcctgagacatgggctggcctccaggtggaggggtccagcaggcaggtacaagccggatgagagttcagggcagagggcagagccggaaacagaccaaaagctgccatggagtggcgagggtggaagcagcggcacaggccgagggccatctcgccggggaagggtgggtacagcacaaccctgtgggccacgtttcctcacacaggaaattcccacagaac

SEQ ID NO: 518433 - DNA, 435 bp, Homo sapiens
tctcagtaatagaaaccaaatcaattaaaatggggaaatgattttaatagatgcttcactaaagaagacacacaaatggatgactgtacctgtttttttcctttttatggcaaaatacaacatgaattttactgacaaatacgacatgaatgggtctcaaaagcattgcactaagtgagagcagccagttaggcacactaaactctgcattattccattcatatgaaattccagaaaaggggaaactatagtgaccaaaaacaaatctgtgattgtcaagagctagagataagggttggatggggctgttctatatggtgactgtggttatgattacataactgtaaatttgttaaaactcattgaattgactgcttaaaatgggtggattttatcatatgtaaattatacctcaataaagcttatttttacaaa

SEQ ID NO: 518434 - DNA, 113 bp, Homo sapiens
gggtttgcccccccccccctttttttttggggttttttggaaagatttttttttttgggttttgggaaaacccccccccgggggcggggaaaaaaaaccgggaatttttttta

SEQ ID NO: 518435 - DNA, 339 bp, Homo sapiens
gatggaaaagtagccaggcatggtggtgtgtacctatggtcccagctacatgggaggctgaggtgggaggatgacttgagccctggagattgagtctatagtgagctgtgatcatgtcactgcattccagctggggcaacagagcgagaccccatctccaccaaaaaaaaaacaaacaggaaaaggatttaggctaggtgtagtggctcgtgcccgtaaccccagtgattttggaggccaaggtgggagaatcacttgaggccaggaattcaagaccagccccagcaacataccaagatcccatttcaacaaattaaaaaaacaagcaaaaaaaaaaac

SEQ ID NO: 518436 - DNA, 259 bp, Homo sapiens
  misc_feature (96)..(97): n is a, c, g, or t
  misc_feature (107)..(107): n is a, c, g, or t
  misc_feature (150)..(150): n is a, c, g, or t
  misc_feature (171)..(171): n is a, c, g, or t
  misc_feature (223)..(223): n is a, c, g, or t
tggtaccgtggttgcatgcaaagctcggagggtgaggcaggcgtggtctgcgtgctgagacaggctggtgcacaggagggtcagcacagaagcccnntggctggtgntcctgggcccaaagggggctggggctccatgggagagagacgnggccaagtgctgtgcaccccnatgtgtggggctccacaagctggaggggcccctggacccaccgaggaagcgngcaaaaaacagggtctgcagttcccagccatgccgg

SEQ ID NO: 518437 - DNA, 258 bp, Homo sapiens
ctccttggtaccggatctgatagcaattagaaataagacatttgcggccaggcacggtggctcacgcctgtcaatcccagcactttgggaggccgagacaggcggatcacgagttcaggagatctaagaccatcctggctaacacgataaaaccccgtctctaccataaatacgataaaaattagctgggcgtggtggtgggcacctgcagtcccagccactcgggaggctgaggcaggagaacgcgtctaatactcg

SEQ ID NO: 518438 - DNA, 685 bp, Homo sapiens
ctgccgctcctggtgctgcttgtgtgctcgttttggtgcggcacctggtcacctctttctgtgaagcggcagctgaggagactccggacggctcgtcaatggccgaccgaaaagcccaaggaaggagtcacagactgagaacaacgatcatattactttgaaggtggcggcgcaggaatggtccctgtggttgcagcttatcaacgattacggacgggcatactaccaaactatagtacaactaatgacaccagcctatttgtgaacagacaggggatttgtcaacatgagcgcagatcatgattccgatttgaccgggcaacccagatcaattgacaaaccaagacaacaccctgcaccagttcgcgcccaattgcgacgggatgacagcattccaagcttgactgtgctccaacgagtccgacggccgcggttgtctactgacaaagcggaaccctgtttcttaactccgcgaacctctgttcttttgacagacccataggattacgttctcacttcgagacactgcatgtttggggttcagccagcattcctggactacttaccgtatagtcttctctattcgtttccatttcccctttcccattcttcatcgtccctcacgtcactggtattgtgcacacagcctattgcactcttctttcttttcctcaaccggccatgt

SEQ ID NO: 518439 - DNA, 151 bp, Homo sapiens
aacatacacaagacaatactatatctctaactggtctccctgatatcaacatctcaggtccaattcggactacacactgatgccagataattttcttatttaaaaacaacaacagaaacactgctacagactgcttcttagccatgccatt

SEQ ID NO: 518440 - DNA, 886 bp, Homo sapiens
  misc_feature (13)..(13): n is a, c, g, or t
  misc_feature (101)..(101): n is a, c, g, or t
  misc_feature (226)..(226): n is a, c, g, or t
tatcatccacacnacgactccccattagtattatgccttattaccgtcaatttttgtcaaaggagtgttgtgaactctagtatgatctccccttgaatgtnacccgtcgagactcttcagcaacataaactgcttaaggtgattaggaagaagctgttcgtaaaacgctggacatgatcaagaagattgctgatgataaatacaatgatacttttggaaagaattnggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaacagtgagaaaactaaggagagtcgtgaagcacgttgagcacagaatttgagcctctgctgacattggatgaatagataaagcccttaaggacaagattgaaaaaggctgtggtgtctcagacgcctgacagaatctccgtgtgctttggtggccagccagtacggatggtctggcaattatggagagaatcatgaaagcacatagcgtaccatacgggcaaggagatcttctatctaattacgtatgcgagtccgtaacgaaaacatttgcatattaatcccagattagccgctgcatcagagcacatgcttgacgcaattaag

SEQ ID NO: 518441 - DNA, 125 bp, Homo sapiens
agcggagtggagaagccgggccgggcggaggcagcagcagcgcgcagtccctccggcctgcgccctgagtgcggacggcagcctggaggaggtatgcgactccggatgcctgtatggaaagggga

SEQ ID NO: 518442 - DNA, 868 bp, Homo sapiens
  misc_feature (72)..(72): n is a, c, g, or t
gataatgctggctacattatctcaaatgagtaaacgggtgtggtggagtcagatgatctccccttgaatgtnacccgtcgagactcttcagcaacataaactgcttaaggtgattggaagaatcttgtgcgtagaggctggtcatgattaagaatgtattggtgataataacaatacgtatgagtagggttttgggataagtaactttggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaacagtgagaaaactaaggagagtcgtgaagcacgttgagcacagaatttgagcctctgctgacattggatgaatagataaagcccttaaggacaagattgaaaaaggctgtggtgtctcagacgcctgacagaatctccgtgtgctttggtggccagccagtacggatggtctggcaattatggagagaatcatgaaagcacatagcgtaccatacgggcaaggagatcttctatctaattacgtatgcgagtccgtaacgaaaacatttgcatattaatcccagattagccgctgcatcagagcacatgcttgacgcaattaag

SEQ ID NO: 518443 - DNA, 333 bp, Homo sapiens
  misc_feature (83)..(83): n is a, c, g, or t
ggagggcgtaggtgcaaaggaccctagggccactcctgtctctccccctccccggggaagtggactgtggtggccacctttantgcaagactccatggatcagaaaacacctgttcgtggtgggctgtccagtggcacgaccccttggagcccagtgccaggcacatgctcaccatctgggctgctaaccagtcagaagctgtttcgtggaaagagtcgtgatgtgggtcaaacagtcccctgaaaagacatgtccaagccccagtggccacgtattagtctgttctcatggtgctaataaagacctacccgagactgggtaatttgtaaaga

SEQ ID NO: 518444 - DNA, 982 bp, Homo sapiens
ggagagagagagagagagagagagagagagagagagagagagagagagagagagagagagagagagagagagagagagagagagagagcgcgcggagcgcgcgcctgtggcgctctcgcgcctatgagtgattggggttttgtgtgtgtgtgtgtgcccgcccttgttgctcgccctctctctctctggtggtgtggtgttgtcgtgttgcagcctagtgttgtgtcgtcggcaggctcatctcgccggtgtgtgattatcgtgtgtcgtcgtgagagatagaagatagtagtaatagtagttgttcgtggagagagatgttgtgtattatgtgggtgggggtgctgatgatgaagaagagtcccccccgtgtgtggtggtgaagtaccagcgcaggcgtcgtcgtgttgcgcttataatcgtcgtcgacggagagcacgacaccacatatagtagttggtagcgtgtagtataggcagagtatcgttaaccgacgcgcggtcggcgtctcgatcaagcacgaggcagagaagcagagtagttgtgtgtgggcagggcgcgcgcgagggcctcatctactattatgtgatgtgtagttgtgttgaagtagagaatcgcgggggtgatgatgtgtgcgcgaggggctgtgtggttcgagggacggccactgaggtgtcagaagaatctattctgcgcggcgtgccaagcggggttgttcgtgctgccggtggtagaagatggcaacttttacagacaagcagaggagcagcatacatttttatagtgcgcggcgcgcctcttctgtggtgtgtggcgccaatagtagtcgtaggcgccgcctgtttaaaaagaccaaaagaatccgggcgtctttttgtcgggggaaaaacagaagtaccaacgacgcagttgaggtggccagcacccttttattaaagggaagtgcaggcctccagtggaggtataaccgacgggctcttaa

SEQ ID NO: 518445 - DNA, 106 bp, Homo sapiens
aattcatagccaaagccaaagaagattttcttacaaaaatgggaaagtcccgcatcagaacacagaccacattggatcagtttgaacgaatcaagacccatcggcg

SEQ ID NO: 518446 - DNA, 795 bp, Homo sapiens
cctcagtgtcatgctcaggcatgatgcatgtatctgtcctgtaataatgcaatattactatactatcttccaaatgatcaaacaagataagcaagatgataaaatacaatggataaattaaagaaaaagaataaaggtaccaacatcaagcttggtgtgattgaagaccactcgaatcgaacacgtcttgctaaacttcttaggttccagtcttctcatcatccaactgacattactagcctagaccagtatgtggaaagaatgaaggaaaaacaagacaaaatctacttcatggctgggtccagcagaaaagaggctgaatcttctccatttgttgagcgacttctgaaaaagggctatgaagttatttacctcacagaacctgtggatgaatactgtattcaggcccttcccgaatttgatgggaagaggttccagaatgttgccaaggaaggagtgaagttcgatgaacagtgagaaaactaaggagagtcgtgaagcacgttgagcacagaatttgagcctctgctgacattggatgaatagataaagcccttaaggacaagattgaaaaaggctgtggtgtctcagacgcctgacagaatctccgtgtgctttggtggccagccagtacggatggtctggcaattatggagagaatcatgaaagcacatagcgtaccatacgggcaaggagatcttctatctaattacgtatgcgagtccgtaacgaaaacatttgcatattaatcccagattagccgctgcatcagagcacatgcttgacgcaattaag

SEQ ID NO: 518447 - DNA, 304 bp, Homo sapiens
cctagatctacccttgagagccaacctcaggcaaatacccagcagagggacgttctacagtatccctgaccagtactgctcaaaactgctaagaattatcccaaataggtaaagtctgagaaactgtcacagacaagcaggcagcctacggagacctgacaacgaaatgtaatgtaggatcctggatgggattctggaatagaataaggacactaggtccaaaactaagataacatgggctgggtgcagcggttcacacctgttatcccagcactttgggaaggccaagcagttcgtcgctaat

SEQ ID NO: 518448 - DNA, 251 bp, Homo sapiens
gttagtcatcactgaatttgaagtttgtttccagctttgttcaaattctctgtttttttacttttgcattttttaattatacttcagtttggggtacatgtgcacacgtcaggtttgtacatatgtataatgtgccatgtgggtgtgctgcaccattaactcgtcatttaacatgagggttatctctaatgctatgcgacccgctgccccaacccacacagtcccagagtaagacatatgcatatactgct

SEQ ID NO: 518449 - DNA, 756 bp, Homo sapiens
ggccattatggccgggcacgttggttcatgcctgtaatcccagcactttgggaggccgaggtgggtggatcacctgaggtcaggagttcgagaccagcctggccaacactggtgaaaccccgtctctaccaatacattagctgggcgtggtggcgcacgcctgtaatcccagctactccggaggctgaggaagaactgcttgaacctggggggtggaggctgcatgcagctgtaatcatgcctgtgcactccagtccttggtcccaagcacgaacctctggctcacacttatactcctctatccgttatgctttactccttgtccttcactgatacccatctaatacacatgtcctgacccctgcctccacttgactctccagcttctactacatgtcctcctaccattatcttcccacctcctcactcagccccttttcttcacaattctacccattctcacttttactcctccgcacagacctacccatctttaacctctctcttccatcgtttctctctgcctctctcctctctttcaccacgcctagctctacttcccctctctcgacttgtctcgccttcatcccgttcctatctttcgccctctcgccctcccaccatcccccttcacctcttcctcatttccacgcttctacacccttacctacttaccccctttctctctcctttcatcctactcccgcactctattcccgtccccatccttcgtcctccttcactcctcctcccccc

SEQ ID NO: 518450 - DNA, 434 bp, Homo sapiens
  misc_feature (14)..(14): n is a, c, g, or t
  misc_feature (167)..(167): n is a, c, g, or t
  misc_feature (234)..(234): n is a, c, g, or t
  misc_feature (424)..(424): n is a, c, g, or t
agatgggtcccccnatgaaaatggctgtgtgtttcaagaacaagccccattgcaaggttaatgaacattggatcaagttttccccaggcctgctgtaaacaaagtaacccacaactagggaccctcatgacaaaaggaattatttctccctctccccagctctgganaccagaagattgagatcaagatgtctcagggctctgctccatccggaggttctagggagggatcaantcctgcctctcttagttcctaggggctccgggcatccctttgacttgtggttgcatgactccagtgtcacatgcgtgtaatcccagctacttgggaggctgagacaggagaattgcttgaacccaggaggtggaggttgcggtgagccgagatcgcgccattgcaatccagcctgggaaacgagtgaaantccgtctcaa

SEQ ID NO: 518451 - DNA, 246 bp, Homo sapiens
gtcgactaaaagcgatgctggcaaaacacggcattcgccatgacaccacggtcattctgtatgggcgtgacgtatacgctgcagcgcgtgtggccgagattatgctttatgctggcgtgaaagatgtgcgcctgctggatggcggctggcaaacctggtccgacgcgggactgcctgttgagcgcggaacccaccgaaagtgaaagcggaaccggatttcggcgtgaagatcccgggtcgacgcgg

SEQ ID NO: 518452 - DNA, 1133 bp, Homo sapiens
gccgactgaggcacgagcgggtgacgctggtgcctccagcgcgtgagtcagaatagctacgaacccgcagagtcctccctgctgctgatgtggatcggacacgtggtgcacaggcagaagtgggaccctggtgaaccagctggactggattctcgtggaagggaagctaccagtgatctggcggtgatgggctcagtgctgtatcaaaggtcaccagatactttctcttcctcttcaacttgatcttctttagtcctggcgcgcagtgatcctgggctatcggggtgtggatcctggccgacaagagcagtttcatctctgtcctgcaaagctcctccagctcgcttaggatgggggcctatgtcttcatcgtgcgtgggggcagtcactatgctcatgggcttcctgggtctgcatcggactgccgtctaagcgaggctccgtagccctgctgtgggctgtactttgctttcctgtctcctgatcctcattgaccaggtgacggtcggggacctctactagttcaacatgggcaagctgaagcaggagcatgggccgggcatcgctgacctgagcttcattcggagatctacacatacgcagctcgccgagcgacagtctgcatgatgcctggggactaacgatgcagggctcagcggtgaagtgctgcggacctgggtcagcgttctacaaacgtggacaggacgcgacgcatgagctcatggcactcgccctgaaggtacaactacccctggtaccctgccaatcggtcacatgcgggatcgaagaacaagcagctcttctctgcgcaggaatgggttcttcggcattgccctgggagcgcgggatcccgaatcgcgaccaactgtatggaaacatgttgccgtgtgttacccaagtcgcgatcctgtgggaacttgtccctgtgttctacactggtctaatgacggcgatcaagataatatcgtaaactcataatgaggctctccacactttttcatacaactactaaccacaattccgttctgcgacccataatatgataccacaggattggtgagaccacctagatgcgcacgcagtagacatcttgtaccactatacaagattggtatggacaaccattgctctag

SEQ ID NO: 518453 - DNA, 198 bp, Homo sapiens
aaaatactcaccacagcatcatcacatgagtttgagacaccgggttttgccatattgccgaggctggtctcagactcctgagctcaaacgatcagctggcctgagcctcccaaagtgctgggattacaggcatgcaccactacgcccagcctgtattagcttttaggatgtgaaacggtctgctcctcatgtctatgg

SEQ ID NO: 518454 - DNA, 252 bp, Homo sapiens
cagtccaacatccggggtgacagggcgagactccatctcaaaaaaaaaagaaaaaaaataaaataaagggagaagtgttttggtatatggacccacaaaattactggcatgtagaaacttttaatttttttaatggattggggaggacatgtccatgtagtctcggaggccggagttcccggtttcgggggatcagtcacggtaaactagctcacctggttcccccaacctcacccaggaggtgggacgggg

SEQ ID NO: 518455 - DNA, 629 bp, Homo sapiens
  misc_feature (75)..(75): n is a, c, g, or t
  misc_feature (118)..(118): n is a, c, g, or t
  misc_feature (268)..(268): n is a, c, g, or t
  misc_feature (299)..(299): n is a, c, g, or t
  misc_feature (314)..(314): n is a, c, g, or t
  misc_feature (319)..(319): n is a, c, g, or t
  misc_feature (328)..(328): n is a, c, g, or t
  misc_feature (331)..(331): n is a, c, g, or t
  misc_feature (337)..(337): n is a, c, g, or t
  misc_feature (341)..(341): n is a, c, g, or t
  misc_feature (347)..(348): n is a, c, g, or t
  misc_feature (356)..(356): n is a, c, g, or t
  misc_feature (384)..(384): n is a, c, g, or t
  misc_feature (389)..(389): n is a, c, g, or t
  misc_feature (392)..(392): n is a, c, g, or t
  misc_feature (397)..(397): n is a, c, g, or t
  misc_feature (416)..(416): n is a, c, g, or t
  misc_feature (421)..(422): n is a, c, g, or t
  misc_feature (428)..(428): n is a, c, g, or t
  misc_feature (432)..(432): n is a, c, g, or t
  misc_feature (435)..(435): n is a, c, g, or t
  misc_feature (438)..(438): n is a, c, g, or t
  misc_feature (440)..(441): n is a, c, g, or t
  misc_feature (446)..(446): n is a, c, g, or t
  misc_feature (451)..(451): n is a, c, g, or t
  misc_feature (457)..(457): n is a, c, g, or t
  misc_feature (465)..(465): n is a, c, g, or t
  misc_feature (470)..(470): n is a, c, g, or t
  misc_feature (473)..(473): n is a, c, g, or t
  misc_feature (475)..(475): n is a, c, g, or t
  misc_feature (478)..(478): n is a, c, g, or t
  misc_feature (495)..(495): n is a, c, g, or t
  misc_feature (497)..(497): n is a, c, g, or t
  misc_feature (503)..(505): n is a, c, g, or t
  misc_feature (510)..(510): n is a, c, g, or t
  misc_feature (526)..(526): n is a, c, g, or t
  misc_feature (529)..(529): n is a, c, g, or t
  misc_feature (533)..(533): n is a, c, g, or t
  misc_feature (540)..(541): n is a, c, g, or t
  misc_feature (544)..(544): n is a, c, g, or t
  misc_feature (546)..(546): n is a, c, g, or t
  misc_feature (551)..(551): n is a, c, g, or t
  misc_feature (554)..(554): n is a, c, g, or t
  misc_feature (557)..(558): n is a, c, g, or t
  misc_feature (563)..(563): n is a, c, g, or t
  misc_feature (571)..(572): n is a, c, g, or t
  misc_feature (577)..(580): n is a, c, g, or t
  misc_feature (582)..(582): n is a, c, g, or t
  misc_feature (584)..(584): n is a, c, g, or t
  misc_feature (593)..(593): n is a, c, g, or t
  misc_feature (599)..(599): n is a, c, g, or t
  misc_feature (603)..(603): n is a, c, g, or t
atggcagtgtttcatgcgatggtggaaatcgaggacttccaatatgacgaggactcggagacgtatttctatccntgcccatgtggagataacttctccatcaccaaggaagatttgnagaatggggaagacgtggcaacgtgtcctagctgctctctcattataaaagtgatttatgacaaagatcagtttgtgtgtggagaaacagtcccagccccttcagccaacaaagaattagttaaatgctgaagaagccttcaggaatccnaatcctgaacatttggaatgagcccagatanaaatatcgaatgcanagctnctggcttcncanagacanccanttatgnntcgtgttntgtaagagtgtggattctttctatcaantgctnatntcatnttcaggaagcaagtccatnacatnncatatntggnttntgngnntaganccttnaattgnaagcattnttaantangnatntaaatttaaaagaaganantttcannncagtnctttctttcccttggnttnatcnttttcanntcntnaaccnaantanntcggnatttgacnncagcnnnntntncctcagtcnttaggntttnttaataaaaccccgattgtatttttg

SEQ ID NO: 518456 - DNA, 131 bp, Homo sapiens
ccgtccgtctcggtgcattgaattcgttctcgtggctactattccattctcatgaatcactgccagtatccctcttggagtgaacgggcgtgtcaatcctgcgttcatttttacccctatctttcggactt

SEQ ID NO: 518457 - DNA, 350 bp, Homo sapiens
  misc_feature (185)..(185): n is a, c, g, or t
cttgcttttaagggggggtggccccccctgtttaaaatgacccttgggaacagtgaacgtagagaattgtttttaacagagtttgtgcccaaagtcaaagtggatcatggtggtttggcaccagggaatttgttttgttggagcctggtttgggctcccccccccatttttttgtccctctgccntgggctattgggaagtggggatgcaaatggccaagctccccccctgggtatttaaaaacggcagacacaacatgtttctccccgggggtcacttgatgcctgcaggccccagggggggcctcaactgattttgacttcaggaaaagtaacccaaaggggccttta

SEQ ID NO: 518458 - DNA, 974 bp, Homo sapiens
gtcatatggttgtgaagcaatgtgttttggtgggttcacacttacgccccaccagagggggtgtgttggtaaggccactacgccccaacatggctcaacaacagcttgggggcggggagattccatacatacaacgcctggtctgatacacgagcgatggcggcgaaccccaatcatgataggcgttgtcgacacaagagtgtgagacacctgtttgcgccgagcgcgggatggagatatccaacgcgggatgacacgactgtactcggcgtttatgtagtaacccactcgtgggttgagtatactctggcatatcttgtcatcttgtgatatataatcttatatatagaggtgttgcttgatatctgtataccacaactgtggccccacaacacttgtgcgaggacaacattcatcatttttcctcgcgccacagactgtgcccctcgaagacacgtaggccgagctctcctctgtaaatggggtgccactgtcgagactcgtgaggatacgtgattctccacgcgcgattataccacatagagggccactgcaatagtatagacaaaacactctttgtgataagaagttctttagtaaacttcttgtggccacactgagaaatgggcctcgtggtttaacactgtccgcgccgcaaatgtgggctgacacttctcctcgcagggtgattaattctgagcgtggaaggacacatatttttcgccctattgacccagccctctttagagcgcttttgacacaagagttatccgattctcagtttattggtgaaaggatgtggatcccttatgtgtggagttaacataccctctccccaaagagaacaatccagagagtttttaattctgtaaaaagaaattgttaaaaccaggaaaatgtttatagggattaaaaaaatatttttttatatttgccaaaattttttctatccaatataaaattatcccttgtga

SEQ ID NO: 518459 - DNA, 585 bp, Homo sapiens
cgctgatatacaaccgcatatgagacccgctttcggtcaaggcgagatattgtttactcctaagagatgtcaaggtgctgtcgttacagggatccgcaagagtcagacgttccatgacacaggagaagttgatcaacctgccaacattgtggttactgtcctagctctcatgccgggacagtttatgcaaccaacggagcctcttcacctgtcgtcggcattgaggtctaacttgttacacacccaggttcatacttattctcacggactcttgttcctcagaagtgaatgcagaccgcctgtattgacacaaagggccattctacacatacctgtgtccctgttcaggagtatactgtaatgtttatgcgaatggaccacattcgcgaatacactatgtctatgcactagaggcgcttaaataaccacttgcgtatcaaagctaacgccgtatgactagcgtgactcgggaggctcaagacttatcacacacattgctatagggtacggagctattgctgagtgtgcccgtattagaagcactgtatcccctgtggcggtactccgagaccctatatgtgtccc

SEQ ID NO: 518460 - DNA, 422 bp, Homo sapiens
ctagggaagcttatgagcctgggagcctactgggtggttatgcttcctccagaatgtagcctggccagccagctgctggggaccctttcagcatcacctttcagttatcaaaggatcagaaagagaacgcaaggcccagaggtggcctcaggaagtagagaaggactgggcctgtgatttgaatgtttgagggctctgctaggagaatgtgagaggaagcccagttaatcctcccaggactccaggagcagggcattatcccaagttgggaaggggattcagaagaactaggcatctaggagtagaggtgacagggtgatttgaaaggaagactttttagatgcaaggaccagcacaagagaaggcgagactcttacacaggggcagttagagaggcaggccagccccaaccaggaagaagt

SEQ ID NO: 518461 - DNA, 413 bp, Homo sapiens
  misc_feature (373)..(373): n is a, c, g, or t
  misc_feature (376)..(376): n is a, c, g, or t
aggatcacgatgtccgtatttcggaggcttgtttgtttctttttattctttttctctaaacttctcttctcgcttcatttcgttcgtttgatcttccatcaccgataccttttcttccagttgatcaaatcagctactgaagcttgtgcattcgtcacgtagttctcatgccatggttttcagctccatcaggtcctttaaggacttctttgcatgggttattctagttatccattcgtctaatctgttttcaaggtttttaacttctttgccatgggttcaaacttcctcctttagctcagagaagtttgattgtctgaagccttcttctctcagctcgtcaaagtcattatccgtccagctttcttccatngtnggtgaggagctggacggacatcgtgatcctcgggtac

SEQ ID NO: 518462 - DNA, 232 bp, Homo sapiens
atttaatttagtatttaaagccaagagaaaggtgttgatcttttggatttttgatagagtgttttttagttgtgttttcccacggctaaatttaagagcttaaatttgataactgtctatttaatcatatgttttcgcctttttttttcgttccagaacagggtctccccatcgttgcccaggctgcgagtgcagaggtgtgatctcggctcactgcaacctcgttaagctt

SEQ ID NO: 518463 - DNA, 115 bp, Homo sapiens
  misc_feature (92)..(92): n is a, c, g, or t
ggcttccctttccagtcacccttggtgccctgtacttcactgtggtcctgaactgaagagctgtgtttttcaggaagacttgtttcttccgngttccgtgtctctggattcaagt

SEQ ID NO: 518464 - DNA, 378 bp, Homo sapiens
ccctcagattacctcaacaacatcagttattttttgtctttttgataaaaagcaattgtaacttgggtgagataatattttattgtggttatcatgcacatttccctgatgattagtgatgtcatgggttttttttttatatacccattaaacacttccgtgtcttcttttgagaaatgtctattgagagcttttgcccattttaattctttttttttttgctatggagttgtttaaattttctatatattctggttattaatctctttgcagatggatagtttgtgaaagagttctctcattctgtaggttattcagaggttattcattctcttcactttgttgattgtttcctttgtggtgcagaggctttttagc

SEQ ID NO: 518465 - DNA, 387 bp, Homo sapiens
cgtcgactgtagagatgtagaagttttgcaccaggaaaagagcccaggagaggctattggtgaaactacagcctgggtacacattggtttgcacgtgtgtgcacttgctatagcatgtgtgtagaaatcagagggcaaccaatgggaatcagtcctcgagtttatgggcaagacaatttggactcagtgcagtataagaaagaagaaagaggaaaggatggaagggagggagggagagagggagagagaaagggagagagagagaaaaaggaaaaaaaaagaaagtttgggaggcaatagcagagacgatggtgaatctgggaggagttagaaggtgtggtcacgccacactaaggtgtatataagcagcgcctttttggtcgacgc

SEQ ID NO: 518466 - DNA, 433 bp, Homo sapiens
gacaagcatgacttctattaaacctataggtaagattattttctacttttaatgcagtatgtttgtttttatcctgacttttgattcattaggccatgtggtttaagtctaaactaagttactctgatattcggaatttcacctttaataattgtctggaaattttcttttaaaggtgatattagaaatctccatttcagtctcagcatttcactagcattgcatgatgctcttgtcttttgcgatttaatattcaaattacatagatattttttattactgcatgtgaagtccttcctcaacttataaagcagttagaacatactaatactttaatacttctataagtgacgagctggcaactgaaaaatgttcatctattatacatatataagcataagtgtgtgtatgcctaaatgtatgtatgtataca

SEQ ID NO: 518467 - DNA, 336 bp, Homo sapiens
aagaaccccccccctccccgggtatgcaaccacaagtggaacccatttgaattccagagagtcccttttgccttcaaacaggggagcacttagtgaatgctgagctaaggagaactgccagggaatcttcaaactttccaacggaactggtttgctctttgattgggttaaaacctgagctggttgtggagcctggaaaaggtggaagagagagaggtcctgagggccccagggctgcgggctggcgaaggaaatggtcacaccccccgcccaccccaggcgaggatcctggagacatgctcctctccctggctccggggaggggtaccgagctcg

SEQ ID NO: 518468 - DNA, 735 bp, Homo sapiens
cacgcgtcgctttttctttaatctccctgtttcttgggctgggggaggggtggggggaacaactggctattcagtaccaaggggccagagtggagggtaggagtgccactctctcttaggtttaggtttttgaccttattcttccttagtttttataaaaggtttatgacagcttggctccccgcgaacactcgcgcagcaatccccagtaccagaagatccatatgagttggctggagaaggtccttaaagccccctaacatcccacagtcttcacgtttcctttccaccttatcattctcgtgtacttaccacagtattattgcacttagattacatatccattcaatctcttactcttcatcccatcagccacctaaataggtcaggtgagggaggcatgggaagaggtgggaggaggggcagaagtgaaggaagaataggaaggatattacctcttctgtcatttttataaagaaacattgtatggtggcagaaatctccctgtaccctatcactgtgagaggcctaattaaatatctatatatatattcaaaaagcaagtgcaaacataggatgtatacaaggtaaaattataagtcaaaagtataaataagctactatataactctgaaatgcaaaaaaaagggacttaagaagtgaacaaagagtaaatgggtgtggaagtgacaacatgggagataagttaaactcagaagaatgatcactagagaa

SEQ ID NO: 518469 - DNA, 160 bp, Homo sapiens
aggactccgtactgtggtgtaccggctgcagatacggaaaggacagtattacatggtagaagctctacaaacaggaactttgaatttacaaccaattaatagacacaacaaaaatgtttattcatcaggtgaataaacaaatatatatcccaccacagta

SEQ ID NO: 518470 - DNA, 121 bp, Homo sapiens
ataagttcttttattagcaatcccttatgcatagactaccttgtgcaaaagagcatacgagtgacattgaaatgctcttatgcaaggtagtctatgcataagtggattgctgggtaccgag

SEQ ID NO: 518471 - DNA, 704 bp, Homo sapiens
gcagaccatatccctatcatgttgttggctcaactgtttttttttttcccctaatagagatggagtatcgctcatgttgctcaggctggtcttgaactcctggggctcaagctatcctcctgcctcagcctcccaaagtacggggattataggtgtgagctactgtacccagccttaaccgtgtttcacagttgattatacttcagtgctgtttcccagcagtggtattattaagggatttaaagttggggttgcatgcctgtaatcccagcatttggggaggccgaggggggcggatcacgaggtcaggagatcgagaccatcgttgactaacacaggtgaaaccccgtctctaataaaaatacgaaaaattagccaggcgtggtggcgggcgccttgtaatcccagctactcgggaagctgaggcaggagaatggtgtgaacccagtgagccgagatcgtgccactgcactccagcctggggcaacagagtgagacttcgtctcaaaaaaaaaaaaaggttgggctggcaagaatcaatgcgggaatatctctatttctagtctttaacattcgaaggctagtgcggacgccaattaaatttcctttttttgccaaaaaaaaacaaacaacaacagaaaagaaaaacaatgtcgcgctctgtttcgggggggacacaagttatataagcacagggtaaacat

SEQ ID NO: 518472 - DNA, 1011 bp, Homo sapiens
tgaagggtgcctgtaatcccagatactcaggaggctgaggcaggagaatcgcttgaacccggaaagtggaggttgcatatgagctgagattgagccattgcactccagcctgggcaacaagagcaaaactccatctcaaaaaaaaaaaaacaaaaaaccgaaagattgcctgagactgggtaattataaaccaaaagaggtttaatggactcacagttatgcacggctggggagaccccaggaaacttacagtcatggcggatggggaaacaaacatatccttctacccatggtggcaggtaggagaagaatgagagctgagtgaagtggatgccccttataaaaacatcagatctcgtgagaacttactatcactacaatacgcatgggggaaccacccaatgattcagttacctgccccaaggtctctgcacaccaacaaatggggattatggcgaccctacaaacacaaggatgagattggggtgggcgacacacggccatattatatcagcctgtaggagctcatagttggtatatcatccttggatccttaacactataacggccaggattgagtctagcaacacgaaaccattcagcatgacagctagactattactgtcatgacccttatgcacaagtagactgctctctggactagcacagtatgcaagaaacgaaacaccctaatgaccgggcccctgggctcagcctgaaagctccaagcattgggaagacgaggcaggccaatcaagtcggtaggagacgagccaacacggcaccaggtgaaaccgactgcatcacaataacagtagcggcaagaggaggggccaaaccgaaacgggagagcgcacagacggagacacagagtgggcactcgtggcaacaccccagctcacgtggacgcaaacacgcacaaaaaaacacgcgcgactacatccgcgccgcacgccacctcacaggaactagcatactctggcatgcgcacatgacgaacagcacatacat

SEQ ID NO: 518473 - DNA, 1038 bp, Homo sapiens
  misc_feature (1038)..(1038): n is a, c, g, or t
cacattcagtgtagcaactacacgcttttcgtatgcattctaaacgtgtcactagctagtgtcagatctaagatctgaatcttataccttagaccatctacgtgtgaccatatggtgattgaatgcaagtggaatcaccatggagattgtctacaaacttttgatgtggtcacgttcagttgagaaaagggagtctgtccagagtcagggccagaactgtgcccaggaccgaaggagacaactaactaaagtagtgagatagattctaagggcaagagcatttttccaagtctgggccatatttcacagccaagaggtgcccaggcctgaggtactcacataaatgcttggttttgctggtgatattaaccagtgcttggaaaaatcttgcataggctatgtctgcatcatttcttaaggctgcttctctctctgagtacgttgccctctgtgctatcaatcatcttatcatcaattattagacaaatcccactggcctacagtcttgcttctgcagcacccactttgtctcctcaggtagtgatgaattagtggctgtcacaaaaggagggaagtagcacccaaattaaattgttcagagaggacatgtacatcttgtataaacttagggagcgaagaaaatgtcggcgcgaaagtgacaagtgaggcagctagttcttcctattccattctcgaccaaccggcccttctaatatgactagggggctggacgctcagaagtcaactaaacccaggtgctgggattagcagcagaataggaggaaccgtggaaacagattcggctgccgagtcatgcgccaagaacatttacccccacgccacgctcgcggcgtcagagcaagcaggcgccccaaaactgacaacgccgaaacctccccccagcacacaagagaagacaggccggaacgaccgccacacacccacatctacatgacggcacagcccggaaaccgaccacggcaagcacaacacacgcacagaaccacaacccaaggcggtgtcgcagctctgcgcccn

SEQ ID NO: 518474 - DNA, 774 bp, Homo sapiens
ctcccggtctgcgatggggttgcgactgggggaacaatccccaagaggcatgaatctggtgaaggggccgaagaaaggttgagaaggtcgacaaagatgctgatatgagtggactcaatggaactatgtactctaagtcaggaaatattaagacgaacaatagttgcctgttgaactgtagcagactttataacaaagatgccgtctgttgaattgtcgtcttggacaaatctgcagaaaaggctctgtgggaaggcagtcactctcaacagttgaaaaagacacttaacgaatgtgacagaggcgtgaagcatttctgtatagtcctgtcctgggaaggggcagtaaaaggataactactaaaggtgacaagcgaacgactgaccgtccagcgggcgcgtttcatctgccccgatggatgggcctggtagatgaacggtcgacacaggttctgcattccattcggtgcgtgcggcctgtgtgttgactgaagcgagccttgaacagagataaaagcggaagcttggccacacgtgtgcgggcgtgccttccaggaggcactgatgtcatcagtggctcaagggcatccacaggaggcatgtggacgtgcgtgcatgacagaggatgcgaggagaagaacggctgagagctgaacgcgggaagaagataactgaaggaatagccgaaggcagcagagtctgcttcgaaacctagatgtcacggaggaaagccccagggcccactcaaacagttaagacagggaagcctgaagat

SEQ ID NO: 518475 - DNA, 629 bp, Homo sapiens
  misc_feature (14)..(14): n is a, c, g, or t
  misc_feature (32)..(32): n is a, c, g, or t
  misc_feature (36)..(36): n is a, c, g, or t
  misc_feature (45)..(45): n is a, c, g, or t
  misc_feature (49)..(50): n is a, c, g, or t
  misc_feature (63)..(63): n is a, c, g, or t
  misc_feature (69)..(69): n is a, c, g, or t
  misc_feature (75)..(75): n is a, c, g, or t
  misc_feature (78)..(78): n is a, c, g, or t
  misc_feature (106)..(106): n is a, c, g, or t
  misc_feature (135)..(135): n is a, c, g, or t
  misc_feature (148)..(148): n is a, c, g, or t
  misc_feature (165)..(165): n is a, c, g, or t
  misc_feature (185)..(185): n is a, c, g, or t
  misc_feature (188)..(188): n is a, c, g, or t
  misc_feature (194)..(194): n is a, c, g, or t
  misc_feature (203)..(203): n is a, c, g, or t
  misc_feature (210)..(210): n is a, c, g, or t
  misc_feature (221)..(221): n is a, c, g, or t
  misc_feature (224)..(224): n is a, c, g, or t
  misc_feature (228)..(228): n is a, c, g, or t
  misc_feature (230)..(230): n is a, c, g, or t
  misc_feature (236)..(236): n is a, c, g, or t
  misc_feature (240)..(240): n is a, c, g, or t
  misc_feature (243)..(243): n is a, c, g, or t
  misc_feature (247)..(247): n is a, c, g, or t
  misc_feature (251)..(251): n is a, c, g, or t
  misc_feature (265)..(265): n is a, c, g, or t
  misc_feature (268)..(268): n is a, c, g, or t
  misc_feature (280)..(280): n is a, c, g, or t
  misc_feature (283)..(283): n is a, c, g, or t
  misc_feature (285)..(285): n is a, c, g, or t
  misc_feature (295)..(295): n is a, c, g, or t
  misc_feature (301)..(301): n is a, c, g, or t
  misc_feature (304)..(304): n is a, c, g, or t
  misc_feature (319)..(320): n is a, c, g, or t
  misc_feature (325)..(325): n is a, c, g, or t
  misc_feature (331)..(331): n is a, c, g, or t
  misc_feature (340)..(340): n is a, c, g, or t
  misc_feature (350)..(350): n is a, c, g, or t
  misc_feature (371)..(371): n is a, c, g, or t
  misc_feature (386)..(386): n is a, c, g, or t
  misc_feature (389)..(389): n is a, c, g, or t
  misc_feature (436)..(436): n is a, c, g, or t
  misc_feature (449)..(449): n is a, c, g, or t
  misc_feature (457)..(457): n is a, c, g, or t
  misc_feature (460)..(460): n is a, c, g, or t
  misc_feature (484)..(484): n is a, c, g, or t
  misc_feature (490)..(490): n is a, c, g, or t
  misc_feature (511)..(511): n is a, c, g, or t
  misc_feature (517)..(517): n is a, c, g, or t
  misc_feature (523)..(523): n is a, c, g, or t
  misc_feature (626)..(626): n is a, c, g, or t
tggggccaattttnaatagttttttttaaganattncattttccncttnnaatacagtgtttntaaagngcaatnttntttccttcccctgtgcatttgttccatnttcaagttttgggaatgcccagtaacttnctatagcagcttnactttttaaaactgccncagaatttgctacgaatttnggnccttcnaatgttttnaatgtgngggacaatgcnacntctncncttggntggnttnatcnaccncttcaatggggggnccngggggagccccnccngnggggggggcncccccnccngggaatccccccggnnttccncctggnatgcctccngccctctggnacagcttgggggtggtggggntgcaaactttctccngcnctttctgttggtgttcaaattcttccttctcagcagtttgattcttntcaagccagttgntaatttcnttncacttgtccagaatcttctgtttntcctcntcgttaatcttgccttggagnttctcntcttcnacagttgctttcatgttgaagggatagggctcaagtgaattcttgggtgacaccttgtccctctgcttctcatcttcagctttgtacttctcagcttcctggncca

SEQ ID NO: 518476 - DNA, 114 bp, Homo sapiens
gcagatgcaaggcaaccccactatggtgtccctgccacacgagggtccagccgcctctgccgcctggggccctcacgtgcgctgctcagcgctggttcgcgggatggatcgtcg

SEQ ID NO: 518477 - DNA, 192 bp, Homo sapiens
gggccaagccccgagggcccctgcaagcccttttcttcctgttcctccccagcctttaccccaaagccctcctgccccccaaaaaagccccttaggctggccgagcccccctgtttccccaggggggttgacctggcccagttgggtccccagggcccgcccatggaattaaatagcccgggcccccctcca

SEQ ID NO: 518478 - DNA, 682 bp, Homo sapiens
  misc_feature (19)..(19): n is a, c, g, or t
  misc_feature (61)..(61): n is a, c, g, or t
  misc_feature (73)..(74): n is a, c, g, or t
  misc_feature (86)..(86): n is a, c, g, or t
  misc_feature (88)..(88): n is a, c, g, or t
  misc_feature (91)..(91): n is a, c, g, or t
  misc_feature (93)..(93): n is a, c, g, or t
  misc_feature (97)..(97): n is a, c, g, or t
  misc_feature (101)..(101): n is a, c, g, or t
  misc_feature (106)..(106): n is a, c, g, or t
  misc_feature (112)..(112): n is a, c, g, or t
  misc_feature (133)..(134): n is a, c, g, or t
  misc_feature (147)..(148): n is a, c, g, or t
  misc_feature (154)..(154): n is a, c, g, or t
  misc_feature (166)..(166): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (227)..(227): n is a, c, g, or t
  misc_feature (232)..(232): n is a, c, g, or t
  misc_feature (235)..(235): n is a, c, g, or t
  misc_feature (281)..(281): n is a, c, g, or t
  misc_feature (313)..(313): n is a, c, g, or t
  misc_feature (332)..(332): n is a, c, g, or t
  misc_feature (336)..(336): n is a, c, g, or t
  misc_feature (392)..(392): n is a, c, g, or t
  misc_feature (463)..(463): n is a, c, g, or t
  misc_feature (502)..(502): n is a, c, g, or t
  misc_feature (523)..(523): n is a, c, g, or t
  misc_feature (578)..(578): n is a, c, g, or t
  misc_feature (585)..(585): n is a, c, g, or t
  misc_feature (607)..(607): n is a, c, g, or t
  misc_feature (682)..(682): n is a, c, g, or t
cttaagtgccgtgtaaccngggccaggaactcgctcggagtcttcttcacagctggaactnaattatacatanntttgtagtgttntntananaatntttnatcancttctnatgctgttctttctgttattnnatataaatatttnntttttngttattatttgngtttttttttgcggaggatgaggaaatgtacagttttntttntntttaatatttttatatncagcncangtaaaaagcagtatctattggaagctaactaggctatttctatttntcccatgatattattgtggttacgtaggatanttggcaccataaaacagtnacanaatgatagagaaacggtttacaaaattcttaaaagtgtacacccaggctagctatnaacttcacattcagttcttaatattacacagaagaacggcatgggagttacggcccgctggtgcagacgtnctgtggggccgattttacccacgatggcgaggccatgtnttttttttacgaatttgtgtnttgatggacacacagctgaactcctagactccaatgccgcgtgcggatgggactntcctgtncgttcatactggaaagtatatntagcataagtcttggtaagatttataaattatttttaaaaagtatatatttatatatatttatatatatataaan

SEQ ID NO: 518479 - DNA, 901 bp, Homo sapiens
  misc_feature (136)..(136): n is a, c, g, or t
  misc_feature (234)..(234): n is a, c, g, or t
  misc_feature (242)..(242): n is a, c, g, or t
  misc_feature (291)..(291): n is a, c, g, or t
tgggcagttaagatccagctcagtctggggattgatgagaactcgtgcatgttctgaggactcagagtggttcatagggtggctaagaggatctctacatctaagtaggctagctccgaggcctcactatgtgacnggaggtgttccacatgttgcaagagagatgtaagtcccatatggtaccaaactattttcaagggcctccaacatgtgtcactattgtggctattgtcnccatgtgncaaaggaaaatcaccatggccaaacccttaaacctaacaagtgggcaanagtcaccaatggcagaggggtatactagtaccaggaggcattgaacaaatgtgttttgttatttattaaataccattcaacacttgtaacttaggtttcctccttctgtagaaaaatgatttacccatcttatgtggctaatataacacacaagtttgttgtgcagcttttgtgggcaaattacaaagcgtaattaatggtataggtgtgtcgtgtgaacacatacggttttctggcctaggtcattgtgctagagtttataattagctttatagtaaactgcaaatttacttaccaaagtggttgaactgttttacgttcccatatatgagttcagttgctccacatcttcaccagcacttgatattgtcaggcttgttgaagcgcattgggcaaagggtgtgttaatggcgatctaaataagcagttacatgtttcccatgtggtgtaaattcaatgcatgacaatgtgtggggcctttcgggcttttaccaccgttttcttggcgaggcgggcgagggctgcggctttaaaaaaggggcgggcagggggatatattaagccgggatagtagaaaaaaccgggggggttaaagcagcacagcttttgc

SEQ ID NO: 518480 - DNA, 187 bp, Homo sapiens
  misc_feature (132)..(132): n is a, c, g, or t
  misc_feature (141)..(141): n is a, c, g, or t
ccagggcaacctccaccttcaagggcaacttctactctgagaaatatcccttggatgtttatggagatgagtaacccaccattccatctagtttacctggaccctctcaacctcgtgcttctttccatacgngaaatcctnattgaacgaacgacgaagactagacagtttagagaagagagacaaa

SEQ ID NO: 518481 - DNA, 158 bp, Homo sapiens
tccacccaccccagtctcccaagtatctggaattacaggcttgacgcaccacacccagctaagggaagtcttagtgtaatgacagaatgagctcagaagcagcagtcatcaagtgctacagaaaagagatacataaagcatgggtgggtggagagcgg

SEQ ID NO: 518482 - DNA, 336 bp, Homo sapiens
ccccatccatccttcccccccttttcccccccaggtaaagggccaattttagcccccattgagtcccccaataagtttccccagggggggggtttgctaaaattgtccaccggttgaccagtttggtttccccccccccgctagttgagcccaaaaaaagacaaaaaactttttcatggtttttgaaacaaaaagcttatttcggggccaagggctttaaaaaaatttgttttttgtttttttcaccaaaccccctagttttcccctaaaagaaattgtaaaaattaaagtaattttgaaaatgttttgccaaaagtaaaattaaagggccctcca

SEQ ID NO: 518483 - DNA, 973 bp, Homo sapiens
aggctgttccggcatgaggcgagtgacgctggccgccaacgagggtatactgtagctgggactctcgccctcagtctcgctctccgtgctgcgtgttacctgccccggttttccctgtgagttgacctgctcctgggccgcgggccgcacaatggcaggggccgctccgaccacggtcttcgtggcaggcggtgatctggcccgccggagttcatgggaagaccacagtacttgcctgtggcatgatgtgagttcctgcgctgcgctggtgcctggcagctgtggccggtggtgaaacctggaacccaggaccaacgcagagggctagcctgtcacgcagtgtagccagtgagcactgtgggcagcagactggatggggcttggtgcgcaagatgattggcacgctgctgacgcaatggggcccaacaggacgggcacctgactcttacctgcaatggcagtaaccatgggaaagccaaaccttggaacatgggcctgacgttgccaaaggactcggaagccacacatccggacgtgcacaacataacatataccatctctccgaacctggccactaggggcccaagggatgtggcatgctccatggacaacggacagtcaaacgggcagaccatttggcacgccaaagcaaatcttatctaccgcacaaattgggcagcaatgatggggaacacattcagcggccttggtcatggcacaggaacaacgcttccgatgggaacttacttccacagtaacgtttgcaacagggaatccccgtgaggacaaaagggttgcacattattcaaagataccaatgggataggaaacccaatccaccatggaggaccaacaccaatttggaatagcaccacgttgaggcaccattggcccccacacaactacaacaccatcacattaatacccatagattggagacatacgatagagagcacataaatggggaacagcg

SEQ ID NO: 518484 - DNA, 125 bp, Homo sapiens
  misc_feature (118)..(118): n is a, c, g, or t
aattggctccaagtagacaggccagaccctcaggctgcccgctcctctagtgttcacttgccgacagaactgctgagcgcccagtggtctagacaagcccagtctccattcccaccgnctcccgg

SEQ ID NO: 518485 - DNA, 149 bp, Homo sapiens
tcactccagtgtgcgcagctgctcactcagtgtggcgagctgctaaactcagtgtgcgagctgcaccctgatgcgggcgtgctgctactacttgtgggaggagtctccgagggtctctgcgggccgccgccggaggttggggggcgggg

SEQ ID NO: 518486 - DNA, 136 bp, Homo sapiens
taggttgggaatgagtgtcactgacaagtgttcgcccattccggtaatcatatctacgccctcctaacagagggcctcagtgagggctctacccacccgacgggggccattctaggggttgccacagtgatgggag

SEQ ID NO: 518487 - DNA, 598 bp, Homo sapiens
cgactggaaagccacttgaggtgtcatgcacactgagtaggttagcagatgagaactttaaggaatatactgagtctcctccttcagaatagataaggttattcagttggacactatctgttccggttcgcttaacccctactgggcgtcgcatgaaaaatctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggttaatctatgctttaacagaccttatgacagaagctgaggtgactgaaaatacagaggttgagctttttcataaagatatagaagctttcaaagaagcatataaaacaggctcattagtagatca

SEQ ID NO: 518488 - DNA, 164 bp, Homo sapiens
gctattactctcactctctctctctctttcttttgtggagacagggctcgctctgttgcccaggctggaatgagtgcagtggtgtgatcatagctcattgcagccttgaactgctggactcaagtgatcctcctaccttggactcccaaagcactgggaatacg

SEQ ID NO: 518489 - DNA, 1526 bp, Homo sapiens
  misc_feature (7)..(7): n is a, c, g, or t
  misc_feature (1168)..(1168): n is a, c, g, or t
  misc_feature (1188)..(1188): n is a, c, g, or t
  misc_feature (1196)..(1196): n is a, c, g, or t
  misc_feature (1202)..(1202): n is a, c, g, or t
  misc_feature (1231)..(1231): n is a, c, g, or t
  misc_feature (1266)..(1266): n is a, c, g, or t
  misc_feature (1273)..(1273): n is a, c, g, or t
  misc_feature (1281)..(1281): n is a, c, g, or t
  misc_feature (1296)..(1296): n is a, c, g, or t
  misc_feature (1311)..(1311): n is a, c, g, or t
  misc_feature (1347)..(1347): n is a, c, g, or t
  misc_feature (1356)..(1356): n is a, c, g, or t
  misc_feature (1381)..(1381): n is a, c, g, or t
  misc_feature (1410)..(1410): n is a, c, g, or t
  misc_feature (1421)..(1421): n is a, c, g, or t
  misc_feature (1491)..(1491): n is a, c, g, or t
  misc_feature (1502)..(1502): n is a, c, g, or t
gcacggngctttcttcaacctcaccatagccttctcactatcacttctagggacacttatatttcgctctcacctaatatccacattactatgcctggaaggcatagtattatccttatttattataacttcagtaacttccctaaactccaactccataagctccataccaatccccatcaccatcttagttttcgcagcctgcgaagcagctgtaggactagccctactagtaaaagtttcaaacacgtacggaacagattacgtccaaaatctcaacctactacaatgctaaaaattattcttccctcactaatgctactaccactaacctgactatcaagccctaaaaaaacctgaacaaacgtaacctcatatagttttctaattagtttaaccagcctaacacttctatgacaaaccgacgaaaattataaaaacttttcaaatatattctcctcagaccccctatccacaccattaattattttaacagcctgattactgccactaatattaatagctagccaaaaccacctaaaaaaagataataacgtactacaaaaactctacatctcaatactaatcagcttacaaattctcctaatcataaccttttcagcaactgaactaattatattttatattttatttgaagcaaccttaatcccaacacttattattattacccgatgagggaaccaaactgaacgcctaaacgcagggatttatttcctattttataccctaatcggttctattccactgctaattgccctcatcttaatccaaaaccatgtaggaaccctaaacctcataattttatcattcacaacacacaccttagacgcttcatgatctaacaacttactatggttggcatgcataatagcatttcttattaaaataccattatatggagttcacctatgactaccaaaagcccatgttgaagctccaattgctgggtcaataattctagcagctattcttctaaaattaggtagttacggaataattcgcatctccattattctagacccactaacaaaatatatagcataccccttcatccttctctccctatgaggaataattataactagctcaatctgcttacgccaaacagatttaaaatcactaatcgcctactcctcagttaggccanataagcacttggtaattggnatcaatcntaatcnaaactccatggaaggcttcatagggaggnaaccattcctaattaatcggcacatgggcctccanattcatnaactcccnaattctggcctaggnaaactcccaactaangaacgggattccaaggccggaacaataattcatggnccgaggacnttcaaaatgggctttcccacttatngcccaatggatgactggatagcaagtctngctaatctagntctaccccttcaatcaatctaataggggaattattcattaccatatcattatttctggatcaactttacnattatcttatnggattacattattattccgggata

SEQ ID NO: 518490 - DNA, 137 bp, Homo sapiens
  misc_feature (54)..(54): n is a, c, g, or t
ggagagaaaagttcctgagtgacagagaaaaagaacaaaaagctgcagaaggcntcagcagaggccactgctggccctgaggctgcaccaagtgacgaagaaccggctccaagcattcgtcacagcactaatttaaa

SEQ ID NO: 518491 - DNA, 112 bp, Homo sapiens
tgcctcgagtgccggaatcagcaggacgaatcgggtcccagatgtgggcagactgttccgagggtcgcaactctggttcagcgataagattagcaggtatatcaccagagtc

SEQ ID NO: 518492 - DNA, 607 bp, Homo sapiens
  misc_feature (255)..(255): n is a, c, g, or t
  misc_feature (468)..(468): n is a, c, g, or t
ctcctagcgcaggggggggggttttgtgaaaggccccccgcggccgcacaaggtttgttattcaagggcgccccctcttgggcaaaacggtgaaaggcgcccggcgcttttgcccgcacatcctttttgggctttttcttgtgcggggcattcgggttatgactcccccttcccagggggaggcggtttttgccggccccaaaaggggggggaaaagggttttctcccggggtttttccctttcccccccccccnccgccaaagggggttttttttggccccaaaaaaacgggggcttttcaaaatttggttaaaccccccccccctttccccaaaaagggggggggggggggggggggggggttttttaaaaaaaagcttttttttttaccccccggtttgccggggggccccccccccccttttttttcccccctaaaaaaacccgggggggttcccccccccggnttttttaatttgggcggggggggggaaacttttttcccccggaaaccccttttccccttgggccctttttgggggcccttttaaacaatttttttcaaaaaaaagggggggggcggggcggggttttccggggttttta

SEQ ID NO: 518493 - DNA, 141 bp, Homo sapiens
tgattactcaaacccggctgaggcacggagaatcttgaatccaggaggcagaggtatgcagtgagccaagaacctcctagagaatcatggtgcaggcaataacatgagatagcatattctcaaagctggttttagccagca

SEQ ID NO: 518494 - DNA, 565 bp, Homo sapiens
gggccccgggggtttggtgcccccaattttcttttacccgaaaaaatcaggggaagggggggccccccccccccccctcccttttatattgtttttcccccccaggggggtggggggagagaattttcctctcctttttttttccccccccaaaagagggtttgtgggtgtgggggggggcgggcccctaaaccccccccgcccccttttggcccctttttataaagtatggtgctcccgggggggggggggggatgggggggccctggaaaataaaaccttccccccgccctttggggttttgtaaggagtttttccaaaccaaatccgggggcccggggggggttggggaaaaaaacaaatttaggggtagggctttgttttcccccccggggcggggggaaaaaacccggaccggtgtctttttttttttttttataaaaaaaaaaaatgggggccggggggggccccccccccccccccttttttaacaagggtttcttgggccggggaaaatttgccgtttttggaatttttaaccttttaaattaattgggaaagggga

SEQ ID NO: 518495 - DNA, 135 bp, Homo sapiens
  misc_feature (57)..(57): n is a, c, g, or t
ctatccccactgcctgtggtgtcactgcctgtctccaccgcctgaggaatctccctntgtcccacctgctgaggagtctcccacgtcccctttatttttttgagatctagggctggagtgcagttgagcggtctg

SEQ ID NO: 518496 - DNA, 426 bp, Homo sapiens
ggagaattgcttgaacctgggaggtggaggctgcagtgagccaagacggcaccactgcactccagccaggcgaccgagcaagactctgtctgaaaaaaaaaaaaaaaattatgaaagagggtgggtgcggtggctcatgtctggaatcccagcgttttgagaggcaaaggagcgaggatcactttagttcaggagtgctagaccaacctgggcaacatagtgagaccctgtctctaccaaaaattaaattatttgggcatgatggcacatgtctgtagtcccggctgcttaggaggctgaggtgggaggatcacttgaggttttagtcatggaagtctcttgccctggaggtcgaggctgcagtgacccatggtcgtgccactgcactctagcctgggcagcaaagccagacactgtctcaaatta

SEQ ID NO: 518497 - DNA, 300 bp, Homo sapiens
  misc_feature (182)..(182): n is a, c, g, or t
ttggagggtaggattttgggaggaccaccaggggatccccccttttatcccatattggctcaccagcccaagagtgttcaaagcttggaggactgctatcgggaagccgggcaactccttcccaaaacagggtttgggtccaaagggagtgctcacgggggtcctgcctgcagcaccagagntagcccatatggcatttccatttgagttggaaaaaaggacccctttccctatcactttacctccctttggtggatggtaaacaccccagcctgggtgacagagcaaaattccgtttca

SEQ ID NO: 518498 - DNA, 216 bp, Homo sapiens
atcccccagtcaagaatggcatatcagcaccaataatagcatccaaacaattgactctacccggctctgttccttccaattaggagcatctagtctctcttatatagtaatgttcttcttctttgactcagttcaagtagttattacaatatgtacagcagttcttgcaacgatagcttttgcttttcttctcctcctgatatgccattcttgctg

SEQ ID NO: 518499 - DNA, 930 bp, Homo sapiens
tcttccggtaccgatcgggtgcgggtcgcctccagagatcctgtgccttaaacgtagagtccatattagccaaggtgagaaggtaaggctcacgtctctgagtgaggcgtccatgtcggcaaaggtggagtgggagttttgaaaagatcccaatagtttacttgcttgggaaactctttccataccagggcgtatgttgacagttgtttggtatatattataatgtgattaatgagttgtgtgattgacatttgccaaataaaggtgggttcgcctgatcttaggcatggtggaatgttggaagtagtgtagagatctggaatagtggcaaatggttggcgtaggcgaggggtatgttgtggtgagtcgctggaacattaggatttgagggactgcgttggggataaattattctaatgacggaattgcagaagacgtccgtgtgtggagggttcatgcaaaatatttggactggttcactgtgctcgatgtgtggcgaaatagatctactcagatagtgttcctatgtacattcgatgacgtacattattggatcctctcttgtgttacgcaccacctcatataggggccgctttggctggtcctaaaagacctgcttttggaaaatggcaagaacaggtgtatattttcccttaacaaaatcctcaaattagagaacattgttccaaaagaaagggtggcggcaatggaaatccagatagatttataggagaacttgatatgacgtggcagcatcattcaagttccccacacagaattcaggggccttgaggtggacctaattcggttgccttttaaaaggccggaggaaaaggtgttgaactatttagcggatacaattgtttacccagaagaaaaaaaaatatggggggcgcaagattaaaaaatatggggggggaagaaataatt

SEQ ID NO: 518500 - DNA, 447 bp, Homo sapiens
  misc_feature (328)..(328): n is a, c, g, or t
  misc_feature (382)..(382): n is a, c, g, or t
caatgggtgtaggggtaggagattttgcatttgattccagccaagttatgtccctactgaaataaaacccaaaaatattaatgctgttcagattataacagaatccagagtgtttacaacatatccctaatgtcctgtgttcaatacaaaattacttgacctcccaaagtgctgcaattacaggtgtcggccaccgcgcctggccatgttgttagtataagtggatttgaatccctgctttattacatataagcttgaacatgcccccttatagcgctatgtcttagtttcctcaactgggaaatgatgttcatcatatgttagactnggcctggcgtgtagtagccatctaacaaactcattcatttattgaataaatgantcaaccccagtggggcactaacagaaacagggaaaacaatcatgaacaaaaaatcaaagaaaaaa

SEQ ID NO: 518501 - DNA, 883 bp, Homo sapiens
  misc_feature (530)..(530): n is a, c, g, or t
  misc_feature (552)..(552): n is a, c, g, or t
  misc_feature (554)..(554): n is a, c, g, or t
  misc_feature (578)..(578): n is a, c, g, or t
catatagtgaggagttactaggacacaatgtgatcacttattttgaaaaaaaaatcagtgaaagacttcgacatttgtgttcactgtgtaaacactacccagaccaacagataggacattaggatacgattttaggttgatgtgtcttagtagataggctaatgctgggggggaaaaagttacaaagatgaggtgcgagaaagaatgagcctttctgaagagttggtggtaggcagggtgtaatgtagccgcgttgggaggccaggtaaatattttgtatttaacttgccccgtagtcgttagtagttacttttctttcttgtcttctggtggcagtgttgctttaaaatgctgactgcagcttcccatggatgaagtgattcttcttagtaacatattctcatgatccagcgaataggctgtactttgaaaccttttattcaaaaagagaagaaagacaaactctagaattatgacgcagatttaatggtaaagcccagatgagttttggaaaggttagactttttacnaggacaataaagtttgagagtnanccacgtcgatgcttcattacatancatctcttgattattatttttaaaacgtttggggaaaaggtaatttaataatatatcattaccatttgggagattatttctttggaagaaacaagctaaatttactctgtaagaaaggcatatacatattcacactcaagatagttgattttatgctacagcatagactgttgtagaaagacagcgctttggtaatgtttgcaccccttccgaagttaagattggtgtgccatcttctacacgggctgttgtgaattggctctgccatttcacctcctcagatgtacctcaggcatgacagctga

SEQ ID NO: 518502 - DNA, 109 bp, Homo sapiens
agagttcatgagcctgcagtgagctatgattgcaccactgcactgtagcctgggtgacagaccctgaccctgtctggaaagaaagaaagacagagaggggcggagcagg

SEQ ID NO: 518503 - DNA, 695 bp, Homo sapiens
tgtataaagggcaaaaagtcgtgaacccttgttttctgaaatctaatcagttatgtatggtttctgaagggtaattttattttggcaataggtaagaggaaacctgtgttgttctgtttttcctgagggctagatgcatttcttgtctcacactcttaatgacttgttaacatttatactgagcatccatagatatattcctagaacgtactgacgaacgaattattgcttgattggaccattaatgtcatgtccacttttaatgtaatataagttgagatgacctgttctctggttggaacagatactctactttgtttgttcttgcaactctttaagaatacatagatctagaaattcattagcttgacccctcaaagtaacttttaagtagacagattacagcttgttcttctcaggtgaatatatctgctagaaggaaatagctgggaacgaatgtgactggatcagggaaattcattatttctatatgtggaaacttttcgcttcgaagtatggtatctttttaaatctaaagtgttcatatttgttcctgaagaaaccactgtgtaaaactcagatttaaattctgaatggaatactttcaaagaactatgaagatgattgaagctctaatttatattagtcacctataagatgtgcttcatatgtgtccataagtaaattgatactga

SEQ ID NO: 518504 - DNA, 165 bp, Homo sapiens
gctcggtaccggtcaagcatctcctgcctcagcctcccggctaattttttttgtatttttagtagaggtggggtttcaccatggtctcgatctcctgaccttgtgagccaccgcacctggctgctaacacttatttagtgcctactgtgaaccagtcagcattaa

SEQ ID NO: 518505 - DNA, 285 bp, Homo sapiens
  misc_feature (8)..(8): n is a, c, g, or t
  misc_feature (23)..(23): n is a, c, g, or t
  misc_feature (30)..(30): n is a, c, g, or t
  misc_feature (37)..(37): n is a, c, g, or t
  misc_feature (40)..(41): n is a, c, g, or t
  misc_feature (45)..(45): n is a, c, g, or t
  misc_feature (50)..(52): n is a, c, g, or t
  misc_feature (87)..(87): n is a, c, g, or t
  misc_feature (123)..(123): n is a, c, g, or t
  misc_feature (125)..(125): n is a, c, g, or t
  misc_feature (131)..(131): n is a, c, g, or t
  misc_feature (135)..(135): n is a, c, g, or t
  misc_feature (141)..(141): n is a, c, g, or t
  misc_feature (143)..(143): n is a, c, g, or t
  misc_feature (161)..(161): n is a, c, g, or t
  misc_feature (165)..(165): n is a, c, g, or t
  misc_feature (171)..(171): n is a, c, g, or t
  misc_feature (188)..(188): n is a, c, g, or t
  misc_feature (198)..(198): n is a, c, g, or t
  misc_feature (228)..(228): n is a, c, g, or t
  misc_feature (238)..(238): n is a, c, g, or t
  misc_feature (242)..(242): n is a, c, g, or t
  misc_feature (247)..(247): n is a, c, g, or t
  misc_feature (264)..(265): n is a, c, g, or t
  misc_feature (284)..(284): n is a, c, g, or t
ggcagttngagggggcggaagtnggagcgnacgtctnganntcantcttnnnggagggggaaggaaagggaggcggggcaggtctcnccgcgagcccccaccccatcaccccgccgcccccancncacganctcncgcganancagcaagccacccggccnccgncagcgnaggggtctcacacctcntgtctctctnctcaaggacgacgccatcgtgtgcgcgcgnctgccggccnctgncaccngcagtagtcaaggcagnnctcccggagctgcccagcng

SEQ ID NO: 518506 - DNA, 362 bp, Homo sapiens
aatttttttttttcccctggggggcccccccccgcccccaaattgggggacgggggatttttccggggggggttttttttcccccccaaaaaaaacccctttccggggggtgggggcccccccttttcccccccccccgggtgtttccctttcccaggcccttttttggggggggggggggtttttttccccctcccccctttggcccggaaggggggtaccccttttttaataggggggtttttgggtttttttttttttttaaaaaaaaaatttttttttcggggcccctttttttttttttttttttttttcccgggggtttttttctaaaaagtttcccccggggggccccaggccca

SEQ ID NO: 518507 - DNA, 139 bp, Homo sapiens
gtacaactacgcaaaggccccaacgattgtggcccctatgtggctactacaacccttcgctgacgccataaaactcttcaccaaagagcccctaaaacccgccacatccactcattcagcctctggacacgaatgttca

SEQ ID NO: 518508 - DNA, 440 bp, Homo sapiens
agcggtgttgtctgttcgacacaggcttggggccgacgggggagacggagccccaggagtgttgaagcctggaaatcccctccctccgggtgtggatctccatgacgcagaacatagagccaggctggtgtgtagcaagcatgagggggatggcatagcacgacacaccaaggtatggacgctacgcacaaagagcctaagaacataagcattccagtcgccagtaccccgcgtcagacgacacaacacccatacggttaacacgcacaacatgagacccgatgggctcccaaggggcgtgcacataccgtggagcaggcttccgaatacatggacgagcaattagggacacgcttacagggccagaacaaaagacacaggcacgccttgtcggccacctggacgcgtagtatgcccgctaccgtctgggggctttgggg

SEQ ID NO: 518509 - DNA, 699 bp, Homo sapiens
taaccgatagagagacttagctaaaatataagatcaggctctgccaaatactgttatacatgatttattgtgtgttacatagttttattcggttgattttgctatacccctgttgcactttttctcttccacttccaacttatgagaagagaagaatgagttggtgtcagggattgtccccccggcgccctccggtcactgctaatatagtttacctcctcttacaagactgctttggctctcattaataacagactgtccttttgagaaggtctgatgaaggatattgaaggaagaagagaatgactctgtctagttcaaaggtggcagtggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcactcattcattatctctatattgaataggttgaaagataactgtagtcaggtgaaaggcattcattatttttaagctgaaaggggatcttgaaaacccagtgaaaacctctacaacaatcttcaggaagcctgtatcttgggattcactaataataggccagaacaagggcagcttcattcctcatc

SEQ ID NO: 518510 - DNA, 789 bp, Homo sapiens
tattgttcgcaagcgggtttgcgccaggaacacaggtgtcgtgaaaatacccctaaaagccaaaatggaaaggaaaagatcatatcaacattgtcgtcatgtggacacgtagatcgggcagtccaccattactgccatctgatctataaatgcggtgcttcgacaaaagaaccattgaaaaacttcgcgaaggaggctgctgagatgggaaagggctccttcaagtatgcctgggtctgtgataacctgaacactgagcgtgaccgtgtatcaccatgatatctccttgtggaaatttgagaccagcaagtactatgtgcctatcattgatgccccaggacacagagatttatcaaaaactatgataacagggacatctcaggctgactgtgctgtcctgatggtgtgctagctggtgtgggactggaagctggtatctccaagaatgggcagacccgagaagcatgccctttctggttaacacactgggtggtgcaaccacactaaattggtcgggtgttacccacacagttgggattccccacttggaggccaaccctaacaggccaggacaagatgatactgagggcaacgtggtccacggacagtccagcacttaccttaaggacaacatgtgggtacaaacccccggaacgaaagtaggccattttgtgcccaattttctgggtgggcactggttgccaaccttggctggccgccagtggcaaccatgccttggttcacaggctggacacgtctcccgaaggttgcactccgggcacacggtgg

SEQ ID NO: 518511 - DNA, 331 bp, Homo sapiens
gagtatcgcccgaccaggacttattgggagcccgagctctgccggacccgtccagaggctgtccgcctagtcagtgacttccttcccagcactctgacgctttccatcaccaggtgcatgatgaccatcttttgtctccttctgaagagtacttcaaggatagggaacgccccatgtactgccgggacagagcctaccaatagctatctcgcactaccgccctgtttcagcctccaggagctcccttgacctgtcctattgtcctacttcctcctccagctcttttatgtcctcctcctcatcttcctcttcctggctcaccccccggggt

SEQ ID NO: 518512 - DNA, 825 bp, Homo sapiens
ggaacagcaggtgcgactcatgctaccaaggcagctgcctaggcgacgacaccgcagacctctggcagcctttcaccctccctcccaactgcgttctgccactgcgacgtgtccaacgagagtcggtcccccaaaatcgcccctgcaccacacggggtccgagccccggcccactccgggcttggtaattcgtgcagtcctgctgctgccccttgcctgctcctgtcgtgcttgctgctgtctctggtaactgccagatccagtaccggcccttctttcccctgaccgccaacttctgggccctggccggcttcaccctgcttcctcagtctctctggcctttttgccatgtaccgcccgtagtgcctccgcgggcagcttggcagcgtagccggcccctccggaccttgctccccgcgccgcggcagggagctgctgcctgcccaggccacgcctctccaggcactgcctcttcccgcatgccactggagcccagcccactagcgcacagcagaggactcccgggactaggccggaggccccgcccctgcgaccgcacggggcatcggggccacctccacggggctgctgaccctcagcccgcactgggagtgggctcctcggggtcgggcatctgctgtcgctgcctcggccccgggcagagccgggccgccaccgggggcccgtcttagtgttctgccggaggacccagccgcctccaatccctgacagctccttgggctgagttgggacgccaggtcggtgggaggctagattgaagggagcgggaggcagagagtttaccgaacccgtgcaataatactt

SEQ ID NO: 518513 - DNA, 381 bp, Homo sapiens
  misc_feature (64)..(64): n is a, c, g, or t
  misc_feature (92)..(92): n is a, c, g, or t
  misc_feature (127)..(127): n is a, c, g, or t
  misc_feature (168)..(168): n is a, c, g, or t
  misc_feature (301)..(301): n is a, c, g, or t
  misc_feature (341)..(341): n is a, c, g, or t
  misc_feature (348)..(348): n is a, c, g, or t
  misc_feature (373)..(373): n is a, c, g, or t
caggcctcatgcctcggtcaggcagggcccaaaccccaactgccggcaggggtggttttccaanaaaggggggtttagatttatcagagtancgagaagccaaactccggccctgggtttgctcccngattaaagggccttcagccaagaccatttttccctcctggngaagggggacttcgaattagtttgcacttcctgttggaaggtaaagccccctgctcattgtataagccccgaggcctaaagtggcagccaaaagccatttgaagccccctttttgcctgttcctcccaaaaanccagggtggccaggggtggtgagggcagttttgcccccanccaaacncataacaataaaaaccaaactttgngtcggcca

SEQ ID NO: 518514 - DNA, 197 bp, Homo sapiens
gaaatgacaaacatgtagaaacacactggtgtgaggaaagctcaagaggactgggtaggaatcctagacatggtctaatctccattatgaaaagcttctgctttagtgtcatattttgatgctgcctatagtccttgtggcagtttggcacaatgaaccacagttaatcatgacccgatgtgattttagcgtcccta

SEQ ID NO: 518515 - DNA, 183 bp, Homo sapiens
aaagacaaaacagaatatggtatatagatacacgtaacatacaaaataggcgaagcaggcatcacacctataatcatagcactttaggagactgaggcggatgggatagcttgaagcccaggagtaagagaccagcctcataaatgattatctgtctatacattatgctaatagatatagatg

SEQ ID NO: 518516 - DNA, 1351 bp, Homo sapiens
gctgctgctgcacctaccgaggtctgcgggcgctgccagatgtgctcccagcccaagcctgagcctgatgccctgcccctgatgtgtccgcctggctccctgtctctgcgctgctgctctcttctggcctgctggcagcgctgccagatgacttggtggtgagcagagaacaggattgtaccatgggatctcatccgcaacgacaacgacactagtggctccggtgtgaggctgctcgtgtgatcgctggtgcagctgactcgtcacagtacagctgcactgctgtgcgtagcttgacgctgtagacacctgaatgcaatgctcaccgttgcgcacacgcagcgctcttgcgccgcgccacgactatccatgcggacgatgcacctctgctcgctgcccttggggctctctgcacacacaactccgtcctaggacgccctaagcgccctcactccctcttgtgctctctgagcgctcttgtgtgcctctacgccctcgtccgtctacgctccgccttctccagccctatcaggcaatgccccccgagagcgcttgggtgttcgacactgctgctcccgacgcgcgctcccgcctcatatctctgcgcgcgcagccctctcactctctcctccctctgctctgctgctcgccgcctcctcgcgtgccgccttcacttctcctccctcggctctctccccatccgccgctccccttcacccggcggtaactccccacctcggcgtgtcggtgccccctccctccaattccgctacacaggacggctgcctcctcccttcgcgtttctgctcttccaataccatacgctcacgcccatcgtcgagctcacatcctcgactgcactctgggccactgcccctctgcgtcgcccctggacctcctcctacagccaatcggcgcctaggggcctctcccttcctccgttagcctcgaccgccgcgtaggatcgccgtgccacacctcacacgccccccccacaggctgcagcttccatctttgcagccgtgttcctcctcctccaatcggtacctccacctcggcgtgtggcccccttacctggcgcctggactgtgccgctattggtcggttcgcaaatctccaccggtgtagcacttacgcggcctggggcgcccctcggcactctcgccccacttccgatagacaacttccgcggcaccccgtagctccgactgccgggaccgcgtctgcccgggcgcccggtcgactctgcactttggcgcgacacgcccccaggcgctccctgacggttcatccgcgaccgcgcgcgcttcatctcgctcgcgaccaccgttggcccaggcgcccccacgct

SEQ ID NO: 518517 - DNA, 359 bp, Homo sapiens
  misc_feature (1)..(1): n is a, c, g, or t
ntgcagagcatacttctatgccatcttaaaaactttacttgtatctaggttcagaactactgcctttttggcagaacatccaaataaaatgccactgattagaaaacattatcactctgaacatacagaggcacaatccatgacactcttacagtgaagaccattctaggtatgtgcaatatgggctgcgaaggtgtctagacaacagcaaggtcatctgggacagcaaactcgaacacaagcatacagtgctgtggcaggtccctccaatttgcattaaaatgacttggagctgctggaatgtctggctacatatcaggtgagggcagagatatggctctggaggtagcagacaagga

SEQ ID NO: 518518 - DNA, 642 bp, Homo sapiens
ccacgcgtcggagagtcgtcgtgggtttctgcttcaagcagtgcttggacggaacccggcgctcgttccccaccccggtcggacgaccatagccagccctccgtcacctcttcaccgcaccctcggactgccccaaggcccccgacccgccggctcgcgagcgccggcgacgagaccgaccgggcacgaccagcccgccgccatcctccgttagctcggcgctgacccattggacagactcagtcgatcacaatcccctacgcccaatgggctgcagaccgatggagatccataacacaaccaagggcaccgtacacgtagggacacgggccgaattccaaaatccgggccccacgaattccaatccccactgttgaggccacaggcctatcctattaatcctgggccccccttctaccgctaaacccggtgttttatttagcgcccgtttggggagttccacctaaaatggggtttcggatttttaacttcagcccttattttgggaacccaccgggggggcgggtgaatttggcaaatttggttttggcgccttttttggaacaggcaacattttgccaaaacgtacctttcttcacgcaatctcatgaggagcagggacgatgctgagcaccctgagat

SEQ ID NO: 518519 - DNA, 185 bp, Homo sapiens
tgcaaaaacagctaaagccgtgtggaacaccttttcccaaatgacgttggagcccaaagagacgaagctttctcagtcatgtttgcccatgtgtcttgcccatcgacaacaccatacgccaaaaacatgcgtgaagccttcgatggatactataaacttgttgcagactacaggaaggatcacgg

SEQ ID NO: 518520 - DNA, 1305 bp, Homo sapiens
cctgatgcccctgggggcgggggctgggggcgggggcgtccccggaaagcctccctcgcagttcgtatatgtcttcaccacccacctggccaacacggctgcagaggcagtgctgcagggccgggccgactccatcctcgcctaccaccagcagaacgtgccccgggccaagcttgaccaggccgctaaagtggcccgccaaccgcagaacgcgctaccacgctgagcacgccgtcagcaggcacccgcgacagtcccagacaactccactgacgccgcacgccagcgaaaggacaccatgagcaaaagagcgcgaagcgcgaagcaaccacgcacagacgcggcgacaccacacccaagacggaccacgccagaccacgcacgacagcgaacacacacgcaaacccaaaccagggcacaacgcaccccggacaacgaaagaaccgagaaacagccgagacaccacacaccacaaaaacacacacaacagaccacagccaccgcgagcaacacacacacagcacggcaccacagagaccagagacgaagcacccacgagaagagaagcaccgagcgacagccaacgacacacgcacagcagacccacagcacagaaaaagccaacagacccagagagcggcgccgcagagaaacacaagcagagacggccacagggaacgtgcgagaagacgacccagaagcaagccacgaccgcctaggaaacgcgcccagaccacgaacccacacaacacacaagcaaccgaacagaccagagagcgacagagaccgccaagccgccacagcgccaagcggacgaccccacacgcgaccgacccaccgcgaaagagggaacaaacggaggcagccgccacccggcagaacgagcgcagcaccgaacccacgaaagaaccagagggcagcacaaagacaacagacggagcaaaagagcagccgagcacagacacccaacaacgcagcagagagcgcccccagcggcggacaaggacagagcgacacacgcacgcaatccgacccacgcaggcaaaacaaggcgccaacaaccacgcaacgccagagcgcaaccgcgaccacgaggagaaaggacgcccagagaaaggaaaaaggacgcggacagcagacgcggacaacgaacaggcacaacaacggcgaaaaagaccaacacgcagacaaaagcccaaccgaggaagccgaccgacagagaaagaacgaaacacgaaggcagccagccgacaagaaagaacaacagcagcgaagaacgaaaaggacgcgcgggcgagcaacaaa

SEQ ID NO: 518521 - DNA, 324 bp, Homo sapiens
  misc_feature (10)..(10): n is a, c, g, or t
  misc_feature (100)..(100): n is a, c, g, or t
  misc_feature (103)..(103): n is a, c, g, or t
  misc_feature (129)..(129): n is a, c, g, or t
  misc_feature (135)..(135): n is a, c, g, or t
  misc_feature (143)..(143): n is a, c, g, or t
  misc_feature (238)..(238): n is a, c, g, or t
  misc_feature (257)..(257): n is a, c, g, or t
  misc_feature (279)..(279): n is a, c, g, or t
tacagtgggntcacatcacttcttcgaggggtcttttaatttttaagtaaagtaaaacctgggtgtgtaaaagaatgacagagacagaaataacactagnagnctgaagtaaataatatttacatcagntccagnaaaacagncatgccttttctgttcaaacccattcgtgtgtgtgtgtgtgtgtgtgtgtgtgtgtgtgtgtgtgtgtggagtttagtatttatagttggaaccnggcctggggctgtattgcnggcttaagttaggattcaagancctcacaaatatccaaattaattgaaggtggggattataacccct

SEQ ID NO: 518522 - DNA, 644 bp, Homo sapiens
ggagatagttagattgcagaaagacctgcgaactgttgagaaaggagcatcagctgagaactggtagaatactaaacgaagagaatatgatcaagaaagggaagagaaaatcaaacaggagcaggaagatcttgaactgaagcacaattccacattaaaacagctgatgagggagtctaatacacagctggcacaagaaggaacaagagctggaaactgaccataaaatagaaactatcaataacggcccagggaggtggaggctgagacttgttagaaaggccagtcaagaagacgacaaatcaggttaggttagagaaagattggtgagaaagatgagtgatctagaaagcgaatcagacaagaagatatgaagaaatccttgatgctcgtgaagaagaagatgactgcaaaagtaacgggagctgcagactcaactggaggagcagcagaagaaatagcagcaacaagctagagcaggaggagaaccctggcgatgataatgtaacaataatggagctacagaaacagataggaacagaagacgacatttaatcaggtgattcgaaattgaaagagcaagagttcagaagaacagattcacaatatagaagaccgtttgagaaatatgaaaagaatgtata

SEQ ID NO: 518523 - DNA, 432 bp, Homo sapiens
cctcgggatcagttgtactcgtatcagtgtagaacgttaccatggtgctagttgccatcaagtactggcaatggtgtagctacactgtacaaatggatctacgcatagatggtcctactgctaagtccgaggtataccctcattacgcctgtagctagtgtccactagtgttcatgccaccattagttcaacaagtcatcctgttcacgaagtgtgcactcaggtatggatggtagaatcagcggactacatcggcgtatgcctttgaatcttttaaaaaggaggcatatggtggcattaggaggcatcatattggtcatctcgttggcaaagttcatcaaattattaaccctgtcgcagacaaggtcaagcttcatcattgaatggatattgagtgctgaaaacagtccatcgaacagggtcgtatagtag

SEQ ID NO: 518524 - DNA, 109 bp, Homo sapiens
tgcttccgggggggctttttttttgttggcgggcccaaactgggttcaaatgggctttgtgacagggttggatgttttttatccctgaataaaactttcccctttggga

SEQ ID NO: 518525 - DNA, 119 bp, Homo sapiens
ggggcacgggggggcagcgctgagcgtggtgagcacgtacatgtcacgtcgctgcccaaggccagcacggtgggtaccacgtactgcttgcgcaatggagtgcgccgacctcatgcaga

SEQ ID NO: 518526 - DNA, 772 bp, Homo sapiens
  misc_feature (45)..(45): n is a, c, g, or t
ggcgcggggggtgcaggcaggcccgagcagctcggtttcccgcgnacttggttggctgtcccaccgcagtaccgcctcctggaacggaagcattttccccttttttgatactacgggttgaacatttgttgatttttcctttaaattacacacatgggcaaacaaaaaacacaacaacaaaaactacaaacacacaaaaaaacctgtgtgtgcggcgggcgcctctgtgggccccctcttgggaagaacaacgctttttataaagagagcccaattccgcggggagtggggcgccacgcggggggggccccaaaagtgtggcgtacacagctgaggaccatgtgtggcggcaaaaaacgcgggagggaggcccccacaagagggagaaagcctcccggggggggccaaatgaaggcacacaaagggggcgcgcaggaggaagacttcccctcccacaccccaatgatataacaaaacagaaaccagcggccgcccgacgggaggagggggcaacacaacccccacgaggaaaacgcgggatggttcctcttgtggcggaacccaccaaaactactctctcccaaacgaagctgatgcaagggaggagagtcgttctcaccaaggagacgaggggccgcccatcaatacaaaccgggggggggaagcattctattatactcacaaacacacacggggaggaaggcgttgtccaccaagaagcgggggagagacttcctccgagcagtatcttctcctagatgttgttaaacgg

SEQ ID NO: 518527 - DNA, 1312 bp, Homo sapiens
ggaaaagaggaaaaaaaaaacagaggcccgcgcctaccccactcctgcccctccggtttcttggctgaagtgagtagtgtgatcctggaggccccccggcctggacccgacccctgccagaccgcccccgattagcgtcataaagtccagcattgtctccctcgatccaaaggccagtttactcgatggggatgggcacggccacgagcctggagtggagtgctagtagagatgctatgtctatgacccatggcacactccatgaggacggggggacaagagcactatgtattgcccagtgggttgaagtgccagtgcacacacagggacataccccgaaaaacaccaacagggtgagaaacgagcagcggagatggagagccccgggggccgtggacagacccgagataccccacaaacacgacaaaagtgactgaccaccaaacaaagctcgaggacgacccgaggagacaacgggacgtgcaatgcaacaacactaccgtagcagccaaaagtagagtagggccacccaatgagccaaaagtggacgacggaagccagagacgctgcaaatgcacccaagcggcggcgacatgagagtataatcagaaacacgacaacataagacatacacactagaaagagcactggaagcccacaggaagaacaccatgagtcaaacccctgaacgtgctgggcaacacgtagacacaggagatgtggagaggatccaaccaagctaataactccgcggccgcacttaaaaggaacaccttagccagggcagtagagagagaatagaagtggagacacaacacaggaaacgcgttccacaatggacacatattatagacataccacagaaaagaacccggaagaacaatggagacgagcagtgatagaaggagaaaaaacgcacatatcaaagacgcaccccagcggacacaaaaggacacaggaaacggcataaaaagtatgcgaacgggcgccaacagcggcggacgagacaccttggaaccagggaagagagcaagggaatagcccaaaaataggacggatgcccagtggaaagacatgaccagggaaactgaaggtggagccaagatgtaggaaaaggtgacacaaaggtataagtgattagtgagtatgatgattagaaataaagaaagatgatacaaaaatttgtgttaacattatatagtaacatacttttagtaactaaaactagaaggagcattttaaaaaaaatacaactaaagaattagaaaaaaaataaagccgctagcaataaagatgtggctgaatagaaatg

SEQ ID NO: 518528 - DNA, 1584 bp, Homo sapiens
  misc_feature (989)..(989): n is a, c, g, or t
tagtgccccctcgttttctccgagcacaaaggggcccgcgcgccccaacaaaaaaagggggggagcacctcacagcaaagaagaggagaaaaaaagttgtgtggtgttgtgagaagcagcccgcccagagctgtggtgtcctcgagaaggaaagaaaaagcaatattttggtggttaaagaagaagagaagtgtggggaaaagagcggcccaccccctgcggcctagtataatgaggcggtcggcacaaaaagaatgtatagaagaagaaaaataaaaatgttgggggggaaagaaagagaagacgcgcgcttttctggttgctcaacgcgcccctcagcgggtgatccccccccacaagggaggagaacccgccgccaacacagagatgtgggcgcaactatactcttcggaatatatggaggtttcctatactcaaaaaagagggggttatttccgcttcgtgttgtttttatggaaacaaaggtgggaagagtgtttcttcttggtcctgtggaagaatttgtgcgcccaccgcagaataatggtatatgtgaagaaaagttgttggccacaccatgtttttatgggagaagaaaataattgttctcccacaaccctgtggaagagttttaatcgtctcgaagaaaagaagatttgtgttttcacaacgcggcggttttatataaacacgtttgcgcccgtgtagactaatataactgttttccccacctcgggcacaccatggggaggattctctttatatcccccccgcgtggagacaccacacaaaaaatgtgtgggtgtctcccacatggggtcgcacacaagataatatggggcacacgcacacacaacattggagattttgtatatagcgtctctcacccgtgtgtgaagaatgcttctcaaggaacactcatcgcccgaacatggggtatacacattgcgtttttctgggtctctgtgtttctctgtgtgtgtttgtgngtttttatcagtattaaaaaatacacgcgctcacccaatatctcacgagatatccgtgagaagagcgccttctctaatatgggctcacagcacccacacacacagggtctcgcccacacaatctccggagaagagaagagatgagagtggagagtatcacagtgagaccccgagagagaggggcacagacgcacacaatgagacgttgtagaaaagaaaggtgggtcacacataaaagttgagatgtgccacgagccacgccacattggagaaaagagacacatatgagaaagagggcttgccacacattctatatttatatcctcttccacatagagatgttctttcgcttatagagaaaagtataaaaatgctgagaagaagcccacaagtttgaaattgggagaaagctcactggaggctttacatggtgaaaggcacgtaagtttctgggaaaagcccctcggggaacgaagacaccaggtgctaaaagttgaaacgagactgatggatatgtgaccccccggtcccagaaatctgtttaaagattccagacttccaattagtggccacaattaaaagtgctatttgtgga

SEQ ID NO: 518529 - DNA, 437 bp, Homo sapiens
ccgaggccgtgaagctcgtttagtcaaggacgaggataaggagtggatgcccgacaccaagctggtccgcttgatcaaggacatgaagatcaagtccctgtaggagatctatctcttgtccctgcccattaaggaatcagagatcattgatttgttcctgctggcctatctcaaggatgaggttttgaagattatgccagagcagaagcagacccgtgccggccagcgcaccatgttcaagggatcagttgctatcgaggactacaatggccacgacagcctgattgttaagtgctgcaaggagccggccaccgtcattcgaggagccatcaccctgagcacgctctgcatcgtcccggtgcgcagaggctacgtgcctcacgatacactacgccgacactgtcccttgcagcctgacaggcccgctgtgctctgcc

SEQ ID NO: 518530 - DNA, 604 bp, Homo sapiens
  misc_feature (212)..(212): n is a, c, g, or t
tctacaaaccacaaagacattggaacactatacctattattcggcgcatgagctggagttctaggcacagctctaagcctccttattcgaagccgagctgggcccggccaggaaacctttagaggtaacaaccaatattacaaggttatcgtcacagcccatgcatgtgtaataatcttcttcatagtaatacccatcataatcggaggctntggcaatgaactagttcccctaattaatcggtgcccccgataatgggggttttccccgcattaaaacaaacataaggctttctgatctcttaccttccctcttctccttacttcctggctcggcaatcctggctaatagatggggagcccggaagacacgaaacacggttgtaacaccgggtgtcttatcaccttccctttagtaaggggaaacatatatttccacccccggggagggagctcctgtggtaaaaacaatacaacaacttttattccgttaaaacccaaacaaaggggtgagtcccaacaaaacaaagagggggcagcaacaaataattaacaaaaaaaattaatataataaacaccgcggatttagacaaataaaacaagct

SEQ ID NO: 518531 - DNA, 546 bp, Homo sapiens
cctaccgctttcgctttcccttcgcggtgcccactccactccttgtgcggcgctaggccccccgtcccggtcatggccatgctcagggtcccgcccgaggcccaagcccaggtggatgtgtttcgtgaagacctctgtacccagacagagaacctgctcgggagctatttcccccagaagatttctgagctggatgcatttttaaaggagccagctctcacatgaagcccacttgagcacatctgaaggcccccttggacactccccgtgcctgtatcccgtccagggagaaagagaaagaggagcggaagaaacacgccggagaagggagacacaggatgtaaaagaagaagggggaggatgaagaccaaggtcctccctgttggccccgtgaactgcgatgaaaagatcgtggtccttctgcagcgcttgaagccctgagatccacgggtgtcacttgagcacgctctaacctggtcacccacctggttgcagctgcggatacctcggattgaggatggttaccattttggagtggctgtccag

SEQ ID NO: 518532 - DNA, 226 bp, Homo sapiens
cggtgcttgaatatttgggtttcggttgttccttataagactatggtgagctcagttgattgatattcctgatgcgattaatacggttgtgttaaggagtggaacttctagggaattaagcgggttgatgccggtggggggccagtgccctccttaatgggggggtaggggctaggctgggaggggtaaagggctcagaaaattccggcgaagaaaaaaacttcgg

SEQ ID NO: 518533 - DNA, 1112 bp, Homo sapiens
  misc_feature (1112)..(1112): n is a, c, g, or t
tgctctcgctagtactattggtcatcgagcgaggctagcaggagtcgagaagagtcgcggagatccgaaagcagtcctggatcatgacggggaaatcactcagtcgtacgtaactcagaacatcacgataaaattcagccgggacgtggtagcagggcgcactgtaagtcccgagcgtacttcgggaaggctagaggcaaggagaatggcgcggttgaaacccggagcgatcgcgctggcacgctattggcaggattgaaggcacagaaggaattcagcagcacaacatggcaacatacacaagacccctagggcagcacgaacgacgaaacgcgagacagaccctcgcgagctagctcacacaccacacaagaaaacaaaaacaagacaaacaaaagaaagagagaccagcgaagacgcgaacacaacagcgcgcgacgcgggaccggcccacacacagcagccgacagacacggaaaaaaacaaagcgaggaacacacaagagggaacggaagcacaagcacgaaacggtagggaaaacaacaaagaggagaaaccaacaaagagaaggcaggcacagcaccaccacacggcaggaaaaaaaccaagtgcagggcagaagacatacaaaaaaaggaagtcgacagctccaccaccgcacacacagaggacagaacacagaagcgggccgagaagacgaacgaacgatccacggacggcgccacagagcacggagtgacgacggacagagcgagagaaagaaacgtacatcaaccaccccaaaaagcacaatgagaccacacaagcagcccaaatcccacgacgccagggacggcacgacgcaacacaccacaacgaaagagaaagagcagagacgagaatgaggaagagaagaccacaaacatcacacaaaacagacaagagagaagaaaaacggataggagaagaaacaaaaaaacacaaccaggaggcacaatcacaaacgacaaacgacaaaggagaggagaaacactacaaaaagaacgagaacagacgacaaccagagaccaaaacaagctacacgcaaccataaatcacaacaccaccacgcacgaccaacgcataggagacan

SEQ ID NO: 518534 - DNA, 125 bp, Homo sapiens
tagtcactgatagtacagcatccacaaagcgtggtaatgtcccagccgttaacaaaggaggcacacactcagttcatccccttactgatgtgctagacagagtgtaccagttgtcattatcatcc

SEQ ID NO: 518535 - DNA, 207 bp, Homo sapiens
ctctactttgcgctgtgtagcacaaggcgagcttctttttgctgcatctctcatcatccacttgcccgagtccttgtctctcttgatgtagatctctacacagtcctcgttgctttgcttattatttggttcacctggagcccagttggtggcctctggggtcaaggccttcttggtccctatccatgtccatgtaccattgatctt

SEQ ID NO: 518536 - DNA, 408 bp, Homo sapiens
atgagcagctatccaagtcaagtaaggaagtctaccctaccaagcaggagaggggcgggggaccggcaggctgtgctccagcctcccttctgttctgtatcctatgccgagaggctatagtaaacgcttacgagtatttttttggttatactgccttaacccactgtggtttaggaagttgatccctataaaggtgtgacccgtagccacacattctgtatgtctctggataggtaactgccagccttcatgccctggtaatactgtctcatgggtggcccatgttgctgtgcctccatatacttctagagtgttgcttactgtaagttcataattatttaaaaaatgaaccaaatgggattgtcagtatttctcagcatcccttgagggacttggagaaaaattacc

SEQ ID NO: 518537 - DNA, 226 bp, Homo sapiens
ttatcccaccgccaactgggatttcatctgggccaccctacggtccacatcagatgtgaggaaattgttaacgcgaatgtcaacacttactttaagaaaattggctacaacccctacacagtatcatttgtgccattttctggtttgaatggtgattacatgctggagccaattgctaacatgcctttgttcaaggcatggaaagtcacccgtaaggattgcgatg

SEQ ID NO: 518538 - DNA, 183 bp, Homo sapiens
ggcacttctttacagagtagtaagaacagcacacttcattcatgtccatagaaagctcagattctatctaggctggtgatggaggtggtggtgatagtgaaaataagatagtatataagcacgtattaatggtgaaaatatacaaaaagtctcaaaattatatcagtaattgcattttgaatg

SEQ ID NO: 518539 - DNA, 280 bp, Homo sapiens
ttactttgaaaaactgggagaaactgtcagctgctgaaggaaatacaagggtgaatgggccctaaggagggagccgcaccaaggctttatcacccccttcagggtggccaaactggagccacgccttataggcccagttccaattttgaagggctcttgggggaaagcttaccgtttctaggtgtgaataatccccgaaaaaatgatagatgctgttgtgacatctcggagtgaggatgatgagacaagaaaacaagttcgagacaagaggagaaaaccc

SEQ ID NO: 518540 - DNA, 278 bp, Homo sapiens
atcagctcgaccttcatttaggcaatctccaagcaaactgtctctcccaaacgtgctatgctgacacccaagccttactcccagcccaaaaattctcaagcatgttctgaggaactttaaggttgacgggaaagtcagtgtgaatggagagacggttcatagagaggatgagaaggaaagagagtgtcccacgggtggctacctgcccgactcctgtaaccagtgtcccagaatggtttgaagtgtgtggtcccgaggtgcaccgggtctccactggt

SEQ ID NO: 518541 - DNA, 340 bp, Homo sapiens
tggatgacacaagacattagagagtgtaggtgccaggaacgatcagatgtgtcaccataatatatctagtgatgggcagatgcaagagagtcaaaggtgaccatggggacttaccgagcccctgcctattggccaggcacagtgatatgtcctcggagccatgtgccatggaagccctctcagaggtcgaggggaggcaggtggagacagagcctctgtaggcctttcaagctgtagccccagagcccagaggcagtcgaattcatgtgtgcagtcagagagctcacgcgactgaagcacacgcgactgaagcacacgcgactgatgcacacgcgactga

SEQ ID NO: 518542 - DNA, 486 bp, Homo sapiens
  misc_feature (58)..(58): n is a, c, g, or t
catttatttcattatcttgtacaattttttttgacattgcaacattgtcaaaatagcnatccagaactgggcgtggtggcatatacctgtagtcctagctactcagaaggctgaggcagaaggattgcttgagtacaggagttcaagtttagcctgggcaacatggtaagctccgtcttgtaaaaataggcatccagggctgggcgtggtcgtcacgcctgtcattccagcactttgggagactgaagtgggcagatcacctgagggcaggagttcgagaccagcctgaccaacatagtaaaactccgtctctactacaaatacaaaattagccaggcatggtggcacatgcctgtaatcccagctatcgggaggctgaggcaggagaattgcttgaacccgctggggcggaggttgcagtaagccgagattgtgccattgcattccagcctgggcaacaagagtgaaatccgtctcaaaaaaaaa

SEQ ID NO: 518543 - DNA, 1859 bp, Homo sapiens
  misc_feature (131)..(131): n is a, c, g, or t
tctctatatatgtcgtttgttcggtgtcttttaatttttgtcaattttgctccctgaactcatgtaccacaataagatggcacactcattgctataataaacaacatcacttttgtgttctacttaatatnccaccatctctcgtgtttattgttattttcgttcttcgtctctgaatcatgctcactgcttctaggtgcactatttctcatccactttccctacaggatgttcttgcttgcttcccacacaagtatggtcaaccgtcctgccatcatatatttgtctctttagaatatgacgataatatcgttccctcacgctaggcgggcgagtgtggtgtatttaggaggtagcgtggcttgtcgttggtagtgtttctcatgcaagaaggtcgtgctgggtggggagagtcgctccccaccgcgagcgtgggtggtgactattgttgtggattagcagtcgccgtcccccgtgtgataactatggtatatatatttttgattaataggggggtgtgcctccactacgtgcgacgagtcagagttgtgtctccgtttgatcatataggatatggtggggaacaccacatcggttgtcatctatctagccgttattatattgtatgaatgttcgatgaagtctgttgtatatggcgtgttgacagaatgagttgtcggataaacatggagtatagttgtcgcaagccgccccgtctctcttatagcgggggtctctacatctgtcaactgggcccgaaagatggtggcgtggtccccgtctcctaaagtggcaacatgcttttttattcccgctgtgtgatgagcgtcttttcctcaaggggagacactcgtactatgagtagattctttttgttttttttttcttctagtactgggctagtagataagagaaggagctttagtctatgtatcagcgcgggaagggataaggtgattacacaactacgatggaggctccgcctccgctatattatgatgataagatgatgatggtaagatggtattgggttgtgtccgatatgaggagaacttctcctcgcataagagattagaatattagatggtatgttttatggacgcccctcgtcggtagtatgttgcccacgcacactacacgtcttctctacacaggaggtattgctcttccacgagctgcgtctcacgcggaatgatctacgccgattagagaaagagtggaggagaaaaacacgcggcgaagagagtatgagtgttgtgtgtcgttttgttgtgcgcgcatttgtcacgttgttttgtgcgaacacaacaacacacacgacgacgagcatgcccgccccgacacacacatatatattttgtggggtgaacacacacatgtgtgtgtctgcatgcgcataggagatatatgcacagtgtccactctgagatatgttgtgtgggcacacattcttgggaacactacagctgtctgtcactctgttgtgtgggttgtggtgaagtgtgcacactgaaggcgcacactgtggtggaataacctgttttataactctcttgctctgctctgcacaccaaggagtggctcgtgtgttatagaaaactgttggggagagaaatatgaggtgtggaaccctaggccaattccggagtctccaaagtccgtctatctttactttcgtccgacaccgtatagagaatggtagactgtctgtcgttggtccctgtgtcaaagttgtctggaaccacaggggtcaaaggaaggccccggcctgtagactcctacctggggcccacattttacatttcccttttgtatttttggtcctgtgtaaatgatttaattaagggaactgacctttg

SEQ ID NO: 518544 - DNA, 1113 bp, Homo sapiens
  misc_feature (482)..(482): n is a, c, g, or t
agactgtacataaagacgatggctaataacatcttaagttataggcaatatagttatcgggtaatgttcgggtgggcagctccattaaaaaatatgtgaatgaatctgtgaagctgcaagtaggcgagaagagcgaaaggtcttcttaattgaaccgcctaccttgtagacagtaatttgtacacgtgtatagcttgtgtgttacagcaattttgtttgtagaagttcaaagattcccagtgttgtggtaacagcctagacttttgtaacaagtgtgataatggatagctatatgattgtttccaattttgtaagaagtagaacagagaatattccttgcttgtagcagactggagcttgagcttaaaagctctgcccagtctcttagagttatggtattaaaacagcaaaatctgtaccatgcttaggacgttacttgtcacatgacttcctgtgccttcgaacaaggcactacggaatanctaactacctttaaatacacagtgtacactggagaacaagttatacttttactgacaggtctatctggttgtagttcagatattcggcaaaagttggttatccgagagcattccagagatgtcgaagcaccactgtcttctgtattagtatactacggcgctttagcaaaacgtttcggtgattgttacgtgatggtattcacgggctcaagtttcacagagcattcaggatcaggccgatagcctaaaacagggctatgtctcacattaacgtgtcctccaggagcacaatcctggatcgggaactctgtccccacaaacggggccgaccacacagagactctgctccccgggcaagaccttccgcccgggtgaacccccggacaaggtcgcttctcccccacgacatcacacctcctccggtaaccgcggcgtaaacagaaaccaacgagcgcccaagaagtcacccaaaccaaggcggacgcaatacagcagttcacactgcggcgcgcaaccacgaactaacaacacagccaagaagacagaacaccacgaagcacgcaactaacgaaataagatactgaacagacccaaagacagaacacacaccagagcactgccagtaaaactc

SEQ ID NO: 518545 - DNA, 617 bp, Homo sapiens
ggggttaagccgacgggacggcgggccgtgctaaaaaaggaccggcggtgtatggggcgggggaaagccgccctgaacggggattcacgccaaaaggctcgggggtagctttaatagtggcccaggaaagaccagctcggtcaagaagaggggaaagatgtgcccaacgagcgatgttgtccctgcccccgtgtgtgtataagtggggccaaagaacccccccccccgaaaaagaggaatgggtgcggaaaacgaagccgctgcgatacgccaccctggcctatcaagtagcaaatatatgttggtgccaacattctaaaatttgctagaaaaaaggggtcgaaaaatgggctcttgtcgtggagagagagaccggcaagataccaaaaggagtctgcatgagaagagccacctctgttgacgctccggtataggggcacacagctaaaaattgacccggctgtggtctatgttcagaagccgtgaatagataggtcggcactgttcgcccccctcgaggcgaaaaaacgttgcaggtacatgtccgtacggaccaggtgcaagagtacattcaccccctcttcaattccgaagcagatttggaccccaacatgaca

SEQ ID NO: 518546 - DNA, 919 bp, Homo sapiens
tcgatgcgatcgataatcgttacggccgcgtgatacgctcgcgcgttaccaatgggcagatcagaggcttgtgagcatgcggccatgttgttcacaagggttccacgtggtgacacatggtggatggtgcgaccgaacttgtatcaagcactgtgaacgagtggcgatgcatgatatgccttccggtgtcgattgagcagttccgcgggttcgccgtgtacaaatggacaaaggaggtgccaaagtgattctcggcgggatgccgcttttaaaaaacaatgtggcccgtatgttgtgtgcccccacccgcccaggggtgtcgccattccacacgcaagcggtcataaggggcatcaggaccaacgaaaagtgccgcccggaggccggcacacatgacagttgcgccgacgaatcctcccccggggcccccccgagcagagagatgtgaccacacacgggtgtagcagcacagcgcaagggggggcaaaagcagtgctccctgcggcgtacctcctcagtggcaacaacacgcaggccccaaacaggacaaaacaatggtgtggtggggcaccacgtagaccacttatgtcaccaccatagtatcacagcttcttgtggcccgccacccaactgtgtattgcagtgtgggccgtgcctccgccactacggtctgttttggacactaagtccccccaccacaactatgtggagtcaaaccaataagggtggcccacaccaggcttttttacaatatgaagtaaccctcgtcggatagtataccttcctccgcgacagtcttaatcgtcagtctgactcttagcgcctgaaagacctcccgagcgtctattatcggcaacactaataggggggcccaccccacaaaagaaaccccagagaggaaaaaaacaacaacaaaaca

SEQ ID NO: 518547 - DNA, 1604 bp, Homo sapiens
  misc_feature (1)..(1): n is a, c, g, or t
  misc_feature (378)..(378): n is a, c, g, or t
ngttgtgtgtctctgtgttgctgttgtttgtttgtttgtgtattttattggtggagtgtcgagggtagggtgttgagatgaagagagaatggatagtgaagagcgaagaagagggcaaagagaagagagagaagagaaaacaataatagcatacgatcagatcactgcagttgtgtgggtgtgatggattcagttggtctaggtcagtgcagtggggtgtcgatgctgtgtattgagttagtgtgatgatgtatcgaatttgttatcacacctgttgcagctacatgatgttatgtgcttctgtcgtgagcatcgtcgactgttgtcaggccctgaatgagtaagttaagtagtgccagtgccggtgttgtagcttanggtagagaagaatgagactaggcgtctcgtcgtgtggtgtggggtagctccggctaccagatattaatgttggtatgtggtgtagctcagcccaccaccgtgtgttcgtccgttatagccgactggggggggggcgacatactcatctctcttgtttttgtctttccgccgagggtggggccccctcttccgccctccgcctgggtggttgtgtgatgatgcttctcccggcggcggcgtcgttcgttggtgtcgttatttaatgtcggtgggtggctgcgacagacccgcggggtgtggtttttctccggacagatgtgtgttagtggtgggccgccccccgtttgtgttgtcgctccggctgcttgcaatcacgtgggggtacgaccagttgtgtgcaccacacggggcgtctcgctcgcgcgtttttgtttattgatccagcgcccccccgtgtgtggttcgaccatatgtggcgcgcttggtgaacatagttgtgtgcgatgccccgggcccctcttttaattgctcccctccccccgcgcgtgttgttcacaatggttccacccgcgttacttgatctcccccccctctctttttttaatatagagatgttcaccctcaatatagatcgtccccactatacatacgtcaaggacttctcttggtaacatatataataagcagcgcccccgcacttctatatagttgagatactatagatgcccccagaagatatatagttctcggcgcgtccaccaccatattgttgtctcgcacacagattgcgctgttgcctcccgcgaggttttgtgtctctcacgaacgaataagatatagatgattttgatctctctctaatagacataaagagacatcgcgcgtcttctcgccccccgtgtggcctatatatctgtgtgcccccccctgcccctgtttaaaacacatacacactacgtgcccaacacgatatctttatctcctctttctcactgaggacaccaccccgcgtgtggaagcacacgctcgtgaaagtgtgtcgcgtagatggataattctctactcacacatacatgtggagtatataaaagaacttgtctcctcctttcaccccccttattaaaatttcttctgttcttttctctaattataaggttgttatctctcttttattatgggtcgacagcacaaaagcaatcaatttaaacacaacaataaacacaaaa

SEQ ID NO: 518548 - DNA, 143 bp, Homo sapiens
acagcggaccctagctgattgccattctgtagcatggcacacttatcatatttatgatttttaaaaatatgtgctttttattttcattttttatttgtctttttagggccacactcacggcatatggaggttcctatggcaat

SEQ ID NO: 518549 - DNA, 994 bp, Homo sapiens
cttaaaataacaaaaatgaagcggccgcgcggcggctcacgcctgtcatcccagcactgtgggaggctgaggcgggcggatcacgaggtcaggagttcgacaccagcctgaccaatatggtgaaatcccgtctctacttagaatacaaaattagcggggcgtggtggcgcatgcctgtaatctcagctgctctggaggctgaggcaggagaattgcttgaacctgggaggcagagggggtagcgagccaagattgcaccattgtactccagcctaggcaacaagagcgaaactctcaaaaaaaaaaaaaataaacaatggtgaccttggtttacccaattctacggttaaccttacgtttttaaaggctggatgactttggcttgtcatcctggggccaggggccatgcgtgtcatcctcgttgtattggtccccatgggggtatattgtgctgccaaaggtgagttacggccgaaattattcctggagaagaggcccttaccattgttgcctgatggcccctaaagcaggtgcacctgggcaagcaagagactgtgcgaaggccagcccaaagaattccagagcgtgttgctacaattggcaacctgacggagccacggtgcctaccattcttacctgggtgttcccacccttattgtgcccgggggtccctgggaagctaccttgagaaactactgaaggtcatataacgggcctgggcacaattagctagcggcccttaactcccagggggtattcacatccacgggtggatttcaacacagcgaattttacaagaagcgaggcttccacaagttatggacccgcccggtggtgttcacaactccgggtgaatcccccagccctttgggggaggccccaaggccgggttgtggcaacaccggagaggcgaaaaagttcggaaacacaagctgtggccaaaggttgggaaacccctggtctcatcactacaaaattcacagcaattgggccc

SEQ ID NO: 518550 - DNA, 387 bp, Homo sapiens
cagggttgaaatgaagcgtgttgatgtatagttttgctagatttacgatacctctacctcagtttgtgtgtgagaactggcccgtggggacccatgctgagccttagcttgctagcgattgtctcttcgcttgagcatgggacatgtgaggctgtccttgttttggtctctgttccctacacgctccctacgcactccctattcacatcttagtccatctgcttcaccttgggcctaatgaccactcattccatttagggatgtcttgagcttttttttttaacttgtgcaaaaacacttaacctacattgtgccatcgtaaccttttacaattctacagttctgtagagctcactaccttcactttgttgtgcaacagctcgccag

SEQ ID NO: 518551 - DNA, 189 bp, Homo sapiens
tagagaatgaaactccatctcatacaaataaagaaagaaagaaatgcttcctggtattggaatttactgtcacatttctattgatgatcaaaatgggaccttgattgcaatagcagaacatttaaaactcacaagaacaaaaaaccaaacaccgcatattctcactcataggtgggaattgaacaatga

SEQ ID NO: 518552 - DNA, 132 bp, Homo sapiens
cttgtcggtacaacctttacactacgtgtacggacacgctgacctcactttactagaccggacgacggtggtcacggagttgactatcggagacggactcctacttggattgacgggggccctttgtactga

SEQ ID NO: 518553 - DNA, 763 bp, Homo sapiens
ccttttttgtcactagcgcgccatgtgttggtaacacggaattcggccttatggccgggggggctaatttattttgtgcggagagggcggactgatcgaatgtcctgttgaccattgggctacaataccacctccaccagaggctaacgaactacaattatttcgaacttaactttgcggccaggcaactgagattagttcagacttcatcccttcaaacagctctatttgttttgaaacgaggcttgcaaaattgctccgaaaaagatttacgtgaaagggggcttttctgcccaagtcgcattaacaacttgctatgttagaaaccctgcctcaaacagtgatattgtggaagtcccgcctctagtcgagggtggcagattcaacgagggctacctgtcactcgcataacagcactggcatgactttcccttctcaaaattatgcaccggctttccctttgcacaaattgggcaaattacaaaagaccccgttggctttttattcaaccgtttacccaaatgtattggaatggaatttttcaaggttctttgttaacaaactattgttaacaaacggggaacttccacatcggtcctcagatgggtgacttttggaatctacaaaacagaattacactactcgttcgggaaccgagatttccaaatatgaaacggaggttggcccataagacagcggctctagggtaaaacgggaaaaaccgccactctggcgcctgaccaaacggcagctcaacttttcc

SEQ ID NO: 518554 - DNA, 161 bp, Homo sapiens
attaaagacctgatcactcatccacccattttctcccacggttctcttccagacaccctcccaagactaaatcaggaagaagttaaatccctgaatagaccaataacaggttccgaaattgaggcaataactaatagcctaccaaccaagacaaggtagag

SEQ ID NO: 518555 - DNA, 552 bp, Homo sapiens
  misc_feature (461)..(461): n is a, c, g, or t
gacacaggaaagaagactggccaaggcggactgcagggtgcaggcacagggaccaccacgcctctctacctgtgtgtccacagcctggaggggcagaagcccaggtcaggtcacatgtaaggcaggagcaaggatggactccaggaagaccccgttacagctggctgagatgaattcactaactgcttttgcagaagtctaatgctagaagtgacctttgttttgaaagaataaatgctctggacagacagacacgccacccagacagatgaagctgcagacctgagaaagtggatgtccaaggtcctgccatgatgccccaggacctcacacctccacctggtcagtgacagcacaagatggcctactttggggcactgtgcagctcccagggatggtgggaagtgctgcttattccagagccagctataagaaacactccttcttttttttgagacagnctcactctgttgcccaggctggagtgcagtggtgtgatctcggctcactgcaacctccgcctcctgggttcaagcgattctcatggattct

SEQ ID NO: 518556 - DNA, 194 bp, Homo sapiens
actactgagagctgaggaagtagcgtgagcttctctgtttagactgaagacagcaacaggaatacttctcctccaggcaagtcaggaccagggtgtcagtgcagctatgaaagtggctcttttctgacaaaactatgaaagtatctcgtaacatcaccacacatggcaatcccatacaaccctaagtaaggtct

SEQ ID NO: 518557 - DNA, 572 bp, Homo sapiens
cctcccattccagttcctcagcaggctggtggagcccaggagggaaggacatctaagacaacaataaaacatagcatagcactcagaagaatgccatcccatggagcacaccataattctggaaccaactctcccggatcaggcttccatagctcacgatgctcacgctgggcagccgcaactctactttgcagaccctcaccaacttgcccaaggtcatctcccacggtcttgaagaacatggctctcccacctgaaacagttgatcttctccatcacagcttccttaagcaaaagcaatcctctctttgcttcctcaaggggcagcacaaaggctgttttggctgtgtggaaacagccagccgcattagtcagtcgccactggcgagtgacgtgatagttgacgctggttggggtggtggacagaggagggtcctcttcctcctctttggtctcatctggccctctcaggcacagcatcctgcttatctccctcactgtggatatgcttccagctacgctggtcctttcctctggctcctgtctctacctgtccagctgtgtacaatatg

SEQ ID NO: 518558 - DNA, 530 bp, Homo sapiens
ttcgacggtgtctgtgcaaagagacaatgacataccacatttcacgtagctggcccagtgagtccaaaatcaatcctcatgtaaaccaacatgattaaggggaaagagctgaaatagcagggctcctaggcacctggattcctaagcatttaatttgttgcaaatttcaaacaggggtcccgtgaaaagaagaagtgtgatttttttcagaaactttgtaagttgagcacgttcccctctgctatcaggggaagggctcttaaaagacagccccaatgtcaaaaccttctctccaaaaataccaggttagaagaaaaaaaaaaaaaggcctttcccagggagatggtgagtggcaaaaacgggagaaacaccgggaaacaggaggtgacgacggggagtagtcgaggccatgaggggaccggagaaggggcatgggatggagacgggccaggacgcactgcaacacacccgtggaaccacagcaagggcagtcggatcctgatcctgattctgacaatttggccaggcat

SEQ ID NO: 518559 - DNA, 869 bp, Homo sapiens
tcacgctcgcgcattctccgtcgcagtctctagctgctgctgcaggactgagccgtgcacccggaggagacccccggaggaggcgacaagacttccgcaggtggccagcgagcccaaccccagccctgggtatgcctgcagcagtggaccgaggctgttactgctccctgctggcgaggccgctggtcgctgggccaggctcctgctatgcttgagcaggagtgttcatggaaggaggactagtctcatgatggacctgcgctatttcgctgtgcgcatctgcggtgctgatctgcaagccacatgcaggggctgtgactcggctggcagccctcaccgatccctgtgccactgtccatctacctgctggtcaccgcccgagcctgccgtgtgcttgtgcttggggcgtctccgctgtggctcaactgtggactattccttgtccctgtgggaccgggaggcagcaggtgcatggtgtgctgctggtggaggtgcgcgtacagagagtgaacgaggaccatacccggttaccagcggtgggtacgtgctgcttacccatccgtaggctcaacggagtctccctggctgctgactcgagcttggcctccaaacgattcagggtaatcttatcgacttgtgcacagtccaatgccacggtcactcgaatgactgtcagagcacgcttgtgaagggcgacggtcacacgggcgtcgtcttctcgttttaccgtaaggggcttcatgccgcatatgcattatccccctatactggagtgccgatgaggcccgatgaccggaataggagcccacaattggcacccgcgacacatcaatgcgcacacctggcggcataagccagaacgccgcagc

SEQ ID NO: 518560 - DNA, 648 bp, Homo sapiens
gagttcaggatgtgtggtcttctcttcgactacccagtggtcttggctgttcaaccgtactttctccagaaggatcagatcaattgctgctcagatatttgggttaagcaaccattggtatggagcaaactgcgagcaagcattttgaaacacactggatttccttgaacgcaggcttgaccagacaaactcagacgaactgtaactttatacagaacacgaatgcccattgaactttttctacggggaaacaaactacaaatttctaactttagctgacaggacaaactccaagcacacgatgaacaacggtacacttcttaccacttacgcgcaacacaacatcaaaatgtcattagtgaataacatgcttcatctagcatccatattaatcaaaccatgagcatctaaccccatccttatctataggctagacaccaacgatattctcagccagcctttatcattcctcttactttatccttattatccttaagtattggtggtcacatactattgagtttcttccttaacactgattaacatgctcttacctccctcagaataaaacctggacattacctgactcccagctatactttctccagaacttgcatatctaaacatacactaaaataacagagaaac

SEQ ID NO: 518561 - DNA, 370 bp, Homo sapiens
  misc_feature (48)..(48): n is a, c, g, or t
  misc_feature (88)..(88): n is a, c, g, or t
ccgatggtgacccggttcctgggcccacgctaccgggaactggtcaanaactgggtccccacggcctacacatggggccctgtgggcnccgtggggctggtgtgggccacccattggcggctgatcctggactggggaccttacatcaatggcaagtttaagaaggataattaattaccccaacccttcacagactgctttggtgcctggtggtgctagctcctcccccctcagcacctgctgcatttggagcagccccagcctcaggatggacaaaaggaaacccccagctcagcttcaggctttttatgtttttgaaaacagcttggatattttaatgcccgttgccttaaacctccctgaaacctga

SEQ ID NO: 518562 - DNA, 744 bp, Homo sapiens
gagtagtcctgaagggagacctgctgtgtggagcctcttctgggacccagcatgagtgtggagctgagcaactgaacctgaaactcttccactgtgagtcaaggaggcttttccgcacatgaaggacgctgagcgggaaggactcctctctgcctgcagtcgtagacgagtggaccagcaccaggggctctctagactgcccctcctccatcgccttaccctgactctccaggacagagcagccacgtctgcacaccatcgcccatctttacactcagtatatcagagcacgataactcctatatacatgagggttgcagacgccatacatatgaacttactcagaccacactacttactctagcagaaacatgggagtacctttacagacaagacgatggcctgtgctcaggcagatggcgctcactactctggcaagaacttacaccctgcagaagcggaaggtcctggtgacggtacctggaactcttacatgccattgctcgtaatctgggatcctacaatcaaggactccggactagaaagaatacagatcgggacaaaatgtaggcccaaagggccaacaactgtaacccgaggacccagaaccaaataccaggagcatagaccactgaaaagaaaagcaaaaaccatacgaacaggagaacacctgagagagacaagcataaataccacagaacacagaagaagaaggacaagaacgacaagaaacagagagacagg

SEQ ID NO: 518563 - DNA, 1175 bp, Homo sapiens
aaaatggctgccgggctgtggccgaactacacgccggaggagccgggtgttgcagatgcctggagccgggacgccggtagccagcgcctggccctgcatcatggcgcccacccatggcacactgccgcatcggctgcctgctggtggatggcctgcactggcctgtgctaggattaatcctcctcttctcgtgctagtcctcctgtggctggtggctcgctgctcatcatgctcaagtcagagtggtgcttatactcctacctgtgtaccgagccagagaatgtcaccaatggcacagtgggcggcacagaagagccggggcacgaggaggtgagctggatgaacggctggctcagctgccaggcccaggacgagatgctaaaataaaggcctacactgtgggctccataactagatacagatgccatacacacctgaccccatgggataatcgtcatggaacaaagtatagggcacctgaggaagctcagtgctagactgggacagagccatgcttacgagggaacatgctagcactgattgcgtaacggagcaagtaaaacaaacggctactactacgatgcaacaacttaatacgccctggctctgaactggctaaaggaggggatagaagtatagacccatacaactcaataaaacaaatgccacaaacaatgtaacgagcgaaaccaatacgggatcccacggataaatatgcccttagaaagaattagggggtccaaacgccgtaacctacgaccaaaggacacaccaataaaaccagggaaaatacgaaagatacaaacaacattgaatgcattgggaggacaaccgtagcaacagggacgagtcacatcagcggcagaccaagggcgcgacccgcgacatggagaacccgagggaacaaatgagaaaaaaatacacacacagaacaaggaacgaaacgatagaaaagcatgggagcaccacactagaggaaaaacaaccgaaagaaaccacagggaagaagaccgagaaaggagaaaagaacaggaaagaaaaaaatgaggaacagaaaagaaaacatgacaaagataacaagacagagaacaggaagaaacagagagagaaaaaacaaacaaacaagcagaggaggagaaaacaacgcgaaaaaaaacgagaacagccggaaacca

SEQ ID NO: 518564 - DNA, 905 bp, Homo sapiens
gtctttcccttcgtgtgtgccactgaagatcctggtgtctgccatgggccgccgcccgtcccgttgtaaccggtattgtaagaatcaagccgtacccaaagtctcgcttctgccgaggtgtccctgatgccaagattcgcattcttatgacctggggcggaaaaacggcaaaacgtggatagagtttccgggtttgtgcgtcacatggtgtcacgtagtgaatatgagcatgctgtcctctgaacgtccctggaggctgcccgaatttgtgccaataagtacatggtattacagtttgtggcaaagatggctagccatatccgggtgcggcatcaaccccattccatgtcatccgtatcaacaagatggttgtacctgtgcatgggtgctagacaggcctccaaatcgggctatgcgatggtgccttggcaaagccccagggcactgtggtccacgtggttcacattggtcacgttatcatgtccatccgcaccaagctgcagaacaaggagcatgtgattgaggccctgcgcatgggctagttcaagtcctcctggccgataaaattatccacgtctcaaagaaggtgggcttcaccgaacgttcaagtgctgactgaagtttgaagaatgtggggcgaaaacgcgagtcaatccagatgtttggggtgtcaggtggctcccctgtctggtgccttctggccagtgggggccggggacatgacggctccatgtgttgcgctctaaaatcacataagtcggtcctgtgcaaaagggcacgcagaaaatttggggggcggccaaagattgaacaattggggccgcgaaggaaaagggaggccagacggacggggtccccaaaccggcaaccaaccggtggggaaaaacaccgcccggggactcaat

SEQ ID NO: 518565 - DNA, 670 bp, Homo sapiens
  misc_feature (123)..(124): n is a, c, g, or t
  misc_feature (126)..(126): n is a, c, g, or t
  misc_feature (132)..(132): n is a, c, g, or t
  misc_feature (189)..(191): n is a, c, g, or t
  misc_feature (199)..(200): n is a, c, g, or t
  misc_feature (206)..(206): n is a, c, g, or t
  misc_feature (228)..(228): n is a, c, g, or t
ctgaaagctcgcgatgcctctacacaagtatcccgtgtggctctggaagcggctgcagctgcgggagggcatctgttcccgcctgcccggccactacctgcgctccctggaggaggagcgganncncactcncgtgcactataggcctcatggggccaagttcaagatcaatcccaagaacgggcagcnnnagcgtgtnnaggacntgcccattcccatctactttcnccccgaatcccagcggtggagttgtggtggcggcgagggcgtgtgcatcctgggccgaaatattatgccaactaaggagcaacgtctctccagagaggcgtgaaagaacagtgtggacagccataagctgtgtgagcgagagttctagcagtgaggatcctggagcaagaagttcacaggtgactgtgaggcagtgcggacctctggagcctcatcgatgacggcttacagtgcgctctcgaacttgttacatagctacaagagccacgaaggaggagcctcgtggctccagagttgtgtggactggacctgaaagcagacggggatgctggctcgtcagcgctttggcccggcaaggcacccccgagattgggactcccggcaggaaccccggagctgggcgggtcaggcattctacgagcaagttacaaggtacattggc

SEQ ID NO: 518566 - DNA, 430 bp, Homo sapiens
ggaatacctgtaatcccagcatttgcgaggccaaggcaggtggatcacctgaggtcaggagttcgagaccagcctggctaacatggtgaaaccccgtttctactaaaaatacaaaaaatgagccaggagtggtagtgcatgcctgtaatcctagctacttgggaggctgaggcaggagaaacgcttgaacccggaagagggaggttgcagtgagccaaggtcgcaccattgcactccagattgggcaacaagagcgaaactccatctcaaaaaaaaaaaaaaattagactctatttggtgggttggctcacttttttatgtttccgggtgtttttctttccatccggccttttttacttccatcggggattacttttcttcatcgggagaattctcttaagtatttatttaagtgcccggtcttccacag

SEQ ID NO: 518567 - DNA, 285 bp, Homo sapiens
cgagtagctgggattacaggtgcccgccaccacgcccggctaatttttgtgtttttagtggaaatggggtttcaccatgtttcatcacagcccagccacacaacccatggaggccaggctggtctcgaactcgtgacctcaggtgatctgcccgcctgggcctcccaaagtgctgggattacaggcgtgagccaccatgcctggcccaggaccagtgatttctgatgtcaagaggcagacggttccggggagagatttccagaatgcgagaaacccgtgaatggc

SEQ ID NO: 518568 - DNA, 537 bp, Homo sapiens
  misc_feature (123)..(124): n is a, c, g, or t
  misc_feature (126)..(126): n is a, c, g, or t
  misc_feature (132)..(132): n is a, c, g, or t
  misc_feature (189)..(191): n is a, c, g, or t
  misc_feature (199)..(200): n is a, c, g, or t
  misc_feature (206)..(206): n is a, c, g, or t
  misc_feature (228)..(228): n is a, c, g, or t
  misc_feature (272)..(272): n is a, c, g, or t
  misc_feature (286)..(286): n is a, c, g, or t
  misc_feature (291)..(291): n is a, c, g, or t
  misc_feature (307)..(307): n is a, c, g, or t
  misc_feature (354)..(354): n is a, c, g, or t
  misc_feature (387)..(387): n is a, c, g, or t
  misc_feature (395)..(395): n is a, c, g, or t
  misc_feature (438)..(438): n is a, c, g, or t
  misc_feature (443)..(443): n is a, c, g, or t
  misc_feature (450)..(450): n is a, c, g, or t
  misc_feature (453)..(453): n is a, c, g, or t
  misc_feature (505)..(505): n is a, c, g, or t
ctgaaagctcgcgatgcctctacacaagtatcccgtgtggctctggaagcggctgcagctgcgggagggcatctgttcccgcctgcccggccactacctgcgctccctggaggaggagcgganncncactcncgtgcactataggcctcatggggccaagttcaagatcaatcccaagaacgggcagcnnnagcgtgtnnaggacntgcccattcccatctactttcnccccgaatcccagacagggggttgtagggagacaaaggataaanactaggaaaaatanatgcnaaaaacgacaaaaacnccaagaggatgaagaaagtgtggaagacacagatgtttaagcgaaanttctacagtgagatcctgaacaagaagtacacngtaaatangaccaagcggccccatggaactcatcgatgagactaatggaancaacntttacanccncaagaccccgaagaggacactgtgctccaaatttgggatgaacctgaagcgnaggatgctgctacggcttgacaggaggacccc

SEQ ID NO: 518569 - DNA, 109 bp, Homo sapiens
tcatcggggatcgatcatctgtcatcataactggacttctgctggtcatccacacaacaccaggacttaagacaaagtgggactgatgtcatcttgagactcttcattc

SEQ ID NO: 518570 - DNA, 155 bp, Homo sapiens
  misc_feature (70)..(70): n is a, c, g, or t
acacgctctgggaaaaggtggcacaggggagtcacgtggatggaatttgcaccatcagactggctgtggnccactcatgttaaacagagggcagagaaagggcccaaggaccgcgccctgagtaactccacttgagcggccaaagaggcgaggag

SEQ ID NO: 518571 - DNA, 247 bp, Homo sapiens
gaattccggcttctgggctcgtctgccattgtcttgtggctcattcccgcggtcttgtgcgccttgcccgctgtcttgaggaactacagagacagtgagccttctgtggatgcccccatttgccctctcgtcgaccctcctccagctcagacactggtctgatcagcgtctcctcgccctcggagctgtcggatggcaccttttccgtcatgtcagcctattctagtgccccagtatagccggaatt

SEQ ID NO: 518572 - DNA, 338 bp, Homo sapiens
gaagcattctctctgaccctgttggagcatactgaagaggcttgagaccccctttaggaaagactcccacctcccctgccctggcttcccccaatactcctcagagtccatagcttggctacaaaatattagcatatggtagtggacatccatagtttactgtaagacctaggtctcagtttcccctttcattccactagaattggaagccaaggaccaaatttcctgtttgctccttcataaatccaattaaaacctattggaatgcctcagagcatattacttgagcaagccccttctcacttgtggggtccttgtgttttgtttctggtcgacgc

SEQ ID NO: 518573 - DNA, 446 bp, Homo sapiens
tggaacacattgtaagactcctgtccggacttaagactcttcgctttcactattttcgtaacaggtcaggaaaaattcaaccaccaactcgaaccactccacacaaaaattttctggaaatcaggcaagatgaaaagaacttctacctcctgacattccctatatttccaaagtgacttatgattctcggactttttgacgaaccgactaaactgattatttccgaccagacaatagtctgacatatctccacccttccgatttgactccttaatacagactgtctacccttctttactgacgccaccggaagagtctgggacatcctttccagaaatgaataagtcaactttcacagataaatctgattctccataaaatcaaaggactgagcccgtacaactcatttcgattaaacggtcaggacccacccccgtttaggagct

SEQ ID NO: 518574 - DNA, 110 bp, Homo sapiens
ggttcgcccccttggccgatgggaatggtctgtcccaatctgctccttttttttgtcccccccacgtaactgaaatgctcctttaaataaagcgtttgtgtttcaagtta

SEQ ID NO: 518575 - DNA, 336 bp, Homo sapiens
gggtttgaccccgtcaaggctaccgtcgcggtggacccggaaccggcactaaaggtgggacaaaaggcatgtcttccctttcctgggtgcattgggtttcggatgcaggcaacatctacagtgcagtctgaagagattgcagatctgcaacaggcagttggttgaggaactgggtatctctatcgaggaacttcggcatttcatcgatcaggaactcgagaagatggctctgtacagccacgcaaggagcagctagcagagttagagacatgggtaatacagagagatctcaggtggctcacgttgaccaactctttgatgatgcatccagggcag

SEQ ID NO: 518576 - DNA, 754 bp, Homo sapiens
  misc_feature (197)..(197): n is a, c, g, or t
  misc_feature (299)..(299): n is a, c, g, or t
  misc_feature (305)..(305): n is a, c, g, or t
  misc_feature (329)..(330): n is a, c, g, or t
  misc_feature (332)..(332): n is a, c, g, or t
  misc_feature (338)..(338): n is a, c, g, or t
  misc_feature (341)..(341): n is a, c, g, or t
  misc_feature (344)..(345): n is a, c, g, or t
  misc_feature (355)..(355): n is a, c, g, or t
  misc_feature (368)..(368): n is a, c, g, or t
  misc_feature (374)..(375): n is a, c, g, or t
  misc_feature (398)..(398): n is a, c, g, or t
  misc_feature (400)..(400): n is a, c, g, or t
  misc_feature (416)..(416): n is a, c, g, or t
  misc_feature (430)..(430): n is a, c, g, or t
  misc_feature (436)..(436): n is a, c, g, or t
  misc_feature (457)..(457): n is a, c, g, or t
  misc_feature (470)..(470): n is a, c, g, or t
  misc_feature (497)..(497): n is a, c, g, or t
  misc_feature (499)..(499): n is a, c, g, or t
  misc_feature (503)..(503): n is a, c, g, or t
  misc_feature (522)..(522): n is a, c, g, or t
  misc_feature (541)..(541): n is a, c, g, or t
  misc_feature (753)..(753): n is a, c, g, or t
aaaggagggaacgcagacagctggcagagagagaagttggctagcatggaatcaccagaggagcctggagcatccatggatgagaactactttgtgaactacactttcaaagatcggtcacattcaggccgtgtggctcaaggcatcatgaaactgtgtctagaggaggagctctttgctgatgtcaccatttcggnggaaggccgggagtttcagctccatcggctggtcctctcagctcagagctgcttcttccgatccatgttcacttccaacctgaaggaggcccacaaccgggngattgngctgcaggatgtcagcgagtctgnntnccagcnccnggnngaggagagcnaccaggggacggngaaacnncgagcggaggaggggcaggaaangnaggagggggcagacanggagcagcggacancgcgcngggaggaaggcgcgcgggggngggcccgcacagngcaagggggaaacggccggcaggggangnggcnggcagagcggcacagggancgctgagcgcgagacggcngccaagcactgtgccaagacccacctggcccagctgcagaatacagaggaatttctccacttgccccaccgcttactcacagatatcatctcggatggagttccgtgttctcagaacccaacagaggcaatagaagcctggatcaactttaataaagaggaaagagaggcttttgcagaggggggggggggggggggggggggggggggggng

SEQ ID NO: 518577 - DNA, 325 bp, Homo sapiens
gaccactttcagagataagagtagatagtaagttgccagggttaaggaggatgagggaaaaggagggaagcgagtgtggctataaaagagcgacatgagaaaccctgcagagatggaaatattcagtatcttgagtatattgatgtcaatatcctaattttgttactattgtgttttcaagatgttaccattgagggaaattggtaaagggtataggggatctctgtattatttcctataactgcaagtgaatctacaattatctcaaaataaaaattttaattaattttaagaaatattttccccaaatggtggaagttaagtg

SEQ ID NO: 518578 - DNA, 1372 bp, Homo sapiens
  misc_feature (1)..(1): n is a, c, g, or t
ntgtgtgtgtgtgtctgtcggttccctgcggatgagatgtggagtggagaagggcgctatcttatatcgtgttggctcttgatggggtcatacgccgaatgagctggtgttctcgctgtctgccacacctgttggtttggcttgccgcgattacgttctcacggggttgtcccggcttccggatcctttgtggggccacgataaccgggtgtttctgagatgtgccgctgtggggaagcggttgatatttctgctctcccttggagataggggcgcccctcgggtgatgttcgtgtgtccccggggttgcttgtcacatgtgcgctccgcaagggtggttccccgtgcagaaagtgtggaccctttgtgagtccgtagtttgcccacgcctcgcagctttccagggtctttggggccttgttcccctcgtcgttgtcccgcgtcgtgccggttggccaggtgtttgcccgagattcgggggtctccgcccgggcgcctctttgatcgcctcaggtcttgtccacgtgcctggcggggtcccaagacccggtctaggcactccccgtgtgtgcccgggtcccccgtgccctcgtgggcggcctgatggggttcctggagggcacctgtacccttgccccagggtttgtgtttgtgttcccgggcccttgcgaatcttttgtcgcctgcctgcccggggtctcctccccgggtccccggtccagtgccttgcagcttccacctcgaggcttccggctcggaggacttctccgatgcctttgtggacgatgccttgggccccccaggaccattcttgcgaaagaggcgccctcggcccttcccgggcgctagccccattacccccttttttgccacctccgctcctcttcacccgcctcttccccggggcctgcccccgcccccctcggtcgcggtagcccgcgggtctctctcgcggccgcgttcaccgggatccccctccctttttctgcttcggctcccgccgcacacgcgcgtagagcccaggcacgcagccctaagttggacctcgcttcccccggatgagcagcccgcagggcttgtgacttgggaggagggccacagaagggcccgggagggagcgtttcgcccacgcgcttcgcctgaagtctataaaggatgaccgaatgttgcacgcctggagaggggtggaacgttggacccacactggagaattctttctcgcttgttccaaagaaagaaaggaaggaagggagtccattagcactgtaagaaagtggatgaagcggagaatgggggctttgctccctgaaatagagcacccccctttcctaattaacaaaaatgggacactctttaacaaaaaaaaaaataa

SEQ ID NO: 518579 - DNA, 882 bp, Homo sapiens
gaagaggaggtggagaaggcttgggctcgcgccgctgaagtcggcttacccgcatggccgcactccatgacaacgcgggacgggatcctgcggttggaccccagggcaagcaggagcgagcactggacggaccaccccactcattcactcacgttcacctgatactactcagtcgcgtctcaggccatccgcacaccgaaccaggaacgcaaagtgacgctgactgggacagatcctgtattgaacacctttccacagatgacgatggcgattcatccaaccatgcgaacgatgactggcccatgcaagaggacggcagcgtgtggcatgagccgtcaacgctaagctttacacacccactcaacgctctacgagtttgagcgaactacgtggccaaccctactacaatgcaacaacatcagcatagcgacaggcactcatctgaacagctgcaagatgaagaaacctctcagcccacacagcacgacaggaggtagagcaaggttaaaccccaagtgtcaggaagttcatcagaccctgattctggacccagcacaaaggaagagactccagcagccagagtgcagcagcatgttcagctcttgacacaaatccaccttcttgccacctgcaaccccaatctcgaatccggaggccagtagcaccaggatatgtcttagagagctgggaacctttgctcagagctccatcgcccttcaccatcagtacaacccccaagttcagaccctggtcaacacttgtacttgatgggagctatgcagctgattgcagaattaggacacatgctcggatggactggaggctactaaactggtagcagatggcatgaataccctgatgcaaaacgagctggaactgggc

SEQ ID NO: 518580 - DNA, 411 bp, Homo sapiens
gcttttcagctatgagcagccaaatctgtgtctggttacagtatcctaataagttattctctacaccaagccacctgggtcgagattaaaaggaagaaactaagtcttccagtaaacctatacaactatagggctgaccctaaatttgttagtaagcaatccaatgtaggtagagcagggtcaggtttgatgtgttttggccgacacgaagggcttaggtctcattcgtttacatattagatacaacaactgatggggctgaggctccttatatagcttgcttagtagtagcttatctattggttgagcccagccaaatttaaaggtactgagactaagaaaaaaacaattttttttttttttgagatggagtgtcagtctgttgcccaggctggagcaagactgtgtctc

SEQ ID NO: 518581 - DNA, 583 bp, Homo sapiens
gctggggatgagcgcgagccggaccatgcgtccgggttcgcggcggtgagggtcgcggccggcggccgaggacgcaggtgcgggtcgagagaccggcgcctccctccccgaccgcccgtggactctgagcgcaggtgtttctactctgaccggccgctccacctgggaaagcgccttcaagagctacctctggcggcacctggccctcagctgcagggaaaccgcactcaaacctgccgccgagcccgggattattctgcaaaactcagaggacctggctcttgcccgaggtgccctgaaccattgtgtgaataagctggggaagcctgactggagtgtaatacttaaaaataaacagagtataactgaatctcaattgtaggaaagttacggtacgcgaagattcagcaatactctctagctcttcgcaatcctctcttgctcgtggagatcatttgtacgctcctcagggtataacatagtttggtacgtatcggacggagcagaccaagggatgaacgtctatgtgaattgcaagtataactgttaaaacacaggatcggcgatcagtaggtcaaagatg

SEQ ID NO: 518582 - DNA, 384 bp, Homo sapiens
gctgtggtcgatctagaggtccccccgggaatgagtaaggcctggggctgggggaagaggggagaaagagccagacggtgagtatgccacctgtggaattggggtagagaggcaggctgtaccctttgggccagtgaaccccagcccccagcacccttggaaaggagaaggaatgacggtccgtgatgagcgaagtcacatcccatgggctccatagtcacaggtaacgaaaaatagggggggttcaaagcctcagcaccaaatgcaccccattcgggggctccctcatggtccctcccagccgggacactctcagctgctgaagcagagggggcccagttcaaacccaaattttgggttcgtctggccaaagtcaggggccgc

SEQ ID NO: 518583 - DNA, 246 bp, Homo sapiens
gcgattaggaacgtcactgtattctctccactgtggtgtcacatgcccactctgccctggtgaaataaagaccagacacccaggtggaaggcagcccatggaggtcgaccatgcctctgcctctgataaccaatacgtgactagttggctgtcctctaaattccacagcagggtcacaaactcttagaaccacccatgcggcacgttccacgccatcaatgagcccaagggccagcatctcctgga

SEQ ID NO: 518584 - DNA, 313 bp, Homo sapiens
cccccccctttttttttcccccccctccccccggggacccccccccccgggttttttccccccaaaagaaccccgggggcgccccccccccccccttttttcttgggggggggggggggggtcctttttcccccggggccccccttccccccccggccccttttggggcccccttttacccggtttgggccaaaaaacgggggggggggggggggggttttcccggggtttttttccccccccccccccgggggaatttttttggggggggggtttttttcccccccccccttttttgtttttttttttttta

SEQ ID NO: 518585 - DNA, 176 bp, Homo sapiens
atagctgttctcgaggatcccagagagccagtgtcattcgtgcctacgtgctataaaaggtgtgcaaggtagactgcagaactcagacgacagatagggaagcaatgaagggggcccttttaaggctcccaccatagagactgtggtgctgtacacaggaaagacaaagggaaaca

SEQ ID NO: 518586 - DNA, 352 bp, Homo sapiens
ggtaccctgatgtggtggcacatacctgtagtcccggctgctcgggaggctgaggcgggggatcgcttgagcccaggaggtggacattgcagtgagcagagatcatgccactgtactccagcttgggtgacagagcgagactgcacctcaaaaaaaaaaaaagtatttcaggggatcctagtggccagtttccttggttcgtatacgggctacaacaagtagttttggtggtgattggtggaaacagattctggggagcattatcagagctactcagctttgatgggcacatccatggtggtacatgtaggatcacagtagggagaggggatcctctaaaagtcgcacctgc

SEQ ID NO: 518587 - DNA, 455 bp, Homo sapiens
tttcaaaaaaaaaaaaaaaaagggggcccaaggctttctgccaaaatttttttccaagggttttgggaaggaaaatttccttgttttttcaagtcaggtaactcaaagcaaaaaagtgatccaaatgttgggtttgggtttgccctcccggaatttggccttactgtaaattttttcctgggatttttgctaaaattcaggggtacggggagttcccaattttcctttttgttggcctggaatgcggacacttacttacattttaatgttaactcaacctttggggcctgggatggttgccttaatgctttaatcgttggatcgccccctttccccaaaattataaaaaaatccctaacctttttttagggaaatttttaaagttttacaaaattcaattttgcaattttcaatgtaaaggacctttggatggtttttaaaactttcccaattta

SEQ ID NO: 518588 - DNA, 394 bp, Homo sapiens
cgtatttgttcactcaagagaaagttataagcgtggattcagattatgtgagctgagatccatgtatagtcactgatgatatcatgcattggcatttcatagctattggtggtagtgacagagagtcttatgttgaaccatgggataccattgaatgtatgtgtgaattgtggtatacagctgatactatgatgatatcatgtcaggctctgtgtagtgcagcaactctgtgctaccccatatgtgaatcacagtgtcatcgttaccttagaggcactggcaagttccacgattgcgcatctcactcttatgtgctcatagcttgtgcagatagcttctgatattgtgggaagtcatgaatcattgtttagacattttatactcgggtcgtttg

SEQ ID NO: 518589 - DNA, 247 bp, Homo sapiens
ggatgatgagagtctgaaagagctattcagtcagtttggtaagaccctaagtgtcaaggtgatgagagatcccaatggaaatccaaaggctttggctttgtgagttacgaaaacacgaggatgcaataaggctgtggaagagatgaatggaaaagaaatagtggtaaatcatatttgtaggcgtgcacaaagaagtagacgcagcagagttaaacgaatttgaaccgttgaaccggagagaattagt

SEQ ID NO: 518590 - DNA, 427 bp, Homo sapiens
tcaaaaggtgaactattggacacaaagtttgcatgcagtctctataaactggctgacactggctcgaggtcttcggttgcttatcaggaaagaatttttgtaaggctggtcctttgtccaatcagagctatagtggtttggattgtaaatcaggtttggtaaggttctgacaattttcccaatagctcctatttttagcaaatttagcaagattgtgttttttcttgtagccttaggaatttgcgaagttcccatgccaaccaagccctgaaccctccacccataggtaactttggttttcttaactttagggttcttcttagttgataaaggagcatccattttggtcttccacataacagaacgcaatttgacgagggcggttagtgtgagtaaaatactcaactcttaaaatctgcattttcca

SEQ ID NO: 518591 - DNA, 115 bp, Homo sapiens
cggtccgtgatgttatgcccaacactctctatcattatacatttaatcaacaaatatttatttgagaacctaccatgagctaggcattgttttttggttgttggggataacatca

SEQ ID NO: 518592 - DNA, 869 bp, Homo sapiens
aatactgctattgtagatggactggtgtggttaagtctgtgcactgaggcatgccaggcctgaggttatgctccaggctgacagtgctgatgcccgatggagctcagtgctgccacccactgcttgcattgatcgccaggactggatgggatgctcagtgctgcccacccactgctggcaggatacgccaggactggatgggaatcccgaaactggagatgaacctaccctcggcaactttacaatgactcccttgaccagggtggcagagattaaaaaaccccacgctattaaacaaacatataattgggggtggctattgtgcaccttgaaaaacaccacaaccagcttgaccatgaatggccaaagcccttgcccaaaaccattttgctccccatctccttgggtacagtggaagtgaggaactgtgatgagaatgtgtgaaatgtgacatctaacatttgcatgcagaaggacctggtgggagatgcatctcctatgtaacggaagatctgaatgaaagggaaaagataaatgactgtaaccaaagtgaaccaacagaaaaaaaattaataacacattttcacgataatgtgatccagccgtgttcctgattccgtccgaaaatatactcaggcttgctatatgccggacaccatccctgtccaccacggaggcgatgctacgcgctgtcttgccttggaaatgtccccaatgggctccgcaacgtctcatctctcatggctcggtccaatcagccgacagaggagagtgatctttgctgccatgacatcggggtacatgaaccaactgctgtaggccagatgggttgtgagcagctctgcatagatgatcgtgccagccaaggc

SEQ ID NO: 518593 - DNA, 961 bp, Homo sapiens
ttctgtcactagtatggaatatatccctgagggagagatttggggtataagcttatggacgatctattgcttttcatagtgcagtacgttgggacccagtctaaatcctctgaagcgcctggaatcatcacattctggatctctatcgatcctgcatcaaaggaatcctctttgtagcgaggcggtgaagcattttatattgtgcattaagtgatggatgtataatgaggtggtagaaggatattcaggaatgcctacagagggggacacgtgtggtctctattccaccatggtggtgtacattaagtcctgatggtaggaactctatgccagtggattctagatgcatggtaatatgtggagactatggcgaaaggtggtggtaggaaaaggacgtatgggcttggggatatgtgtggttcgcatgaagaagatatgtggtgagctggcaatagtccaagattggtttttccagtagtaggagcagaagaggagctagaagttaaattggttggagaggaattccagagtgcatctgttccttcagcgtcctgatgttaaggctgagcgtcatcatatggtcgtagttagggatacaagtgagtaaagactatgctagtcgagaggagcatgaggcttgaagagttactgtctgctttaagggaggaacaggagtaggtagtgaggcacatgaattgttccagtggtggaacgaataagtaattggggtgctgtatgggaactccaggttcgtgaagggagggggtactcaaaaaaagaggtggcattggtatgaagtttggagtccagtgctgtgcacaggtctgtctcgtgttgattgggcaaccactggggggttgggacacaaagtgtgggcagtagaagaaagtcaaaggggtgaagacagggaaagtgtatagaaaaaaaaaggggataagggaaaaaaataacacagtgatat

SEQ ID NO: 518594 - DNA, 645 bp, Homo sapiens
  misc_feature (11)..(11): n is a, c, g, or t
  misc_feature (39)..(39): n is a, c, g, or t
  misc_feature (74)..(74): n is a, c, g, or t
  misc_feature (631)..(631): n is a, c, g, or t
  misc_feature (638)..(638): n is a, c, g, or t
accccaggttnttcgcggtatataagagatgtttcgatngctgaaattgggatttcaggctcgtgccacgtcangaggtataggaccttcgacgattttcttagcctgcagactaagggagaaaagctcaatcgttgagcttgtgctcaaattgtctgagtagaacaatcacttgaatcgagtgggagttgatcttccagatgagatagtgatgtttctccaaagtcattaccaccacggtgctagagctttgtgatgaactgtaacatatcagggatagatatgatgatccttgaggtattcacgatgtttgacaccgcaaagtagaaatcaagaaggagcatcaatcgttgatggttggtgaaaccactagtttcaagaagggcaagggcaagaagggacacttcatgaaacggcaaatcagttgctgctccagtgaagaaacccaaggttgaacccaaacccgagactaagttcttctgtaataaagggaacaaccactggagcagagtaccctagatactgtagataagaagctgccagtcgatagatatattggatatgcattatgctaatgtgtactttactagtactcctagtagcaccagggtatttatgataccgcgaaganatcctgnagagccg

SEQ ID NO: 518595 - DNA, 735 bp, Homo sapiens
gctgggtaccagtacaagaggactagaagaggtgtctacccacagtggcgtatatgagtgtaacacaggctgcaaagtgtgaccgcaaatcgatgtgcactaaaccggttggtgcagacatggactacaagttcggctacaagctattcaagactacatgaagcaaggggctgggagtatccgcatgtcgttggatgactagttgcccaaaaggctcgtttagttccgtatactactgcaggtcaaaaatcctgcatcagtatgactttgcatgacaaggagggtgctgagaaagtgggctgatgaagtagctcagcacaattctggtaccatatcgcacgagcggtggaccacatgcattcaataggtgacaccgagtatgaggacgctgactgcaccccctgtttcgcgtctgcaacagcagttggctgtaggaccttgagaaggacctaggagcaacggatggcacacaagacggagtacttagcatgtgaaccacgtggcacgtagttgccagatgagtggattaggcatccaaggaagtgcagtcagacatgtccgtgggcacaccgggacatagacgggaccacccgacgcgacccacgggaacaacgctggctggagggggaccgactgagtggcggcaaccacgagaaccggccaggaagccccagaacgggcccagacacaagaggacatccgggactgcctcgtgaagaaaccaaacaaacacac

SEQ ID NO: 518596 - DNA, 254 bp, Homo sapiens
acagtccaggatccccctgctccgcccctctctgactacctctgataaaattaccaggcacagtggctaatgcatgtaatccgagcatattttgaggtcgtggagggcggaccactagaggacaggatgtcacgatcagcatggacaacacggtgtatctctatgtctactaaaaatacactatgagccgtgggttcctacctacatgcaaaagcagagctaactgtagagcgggagccgcagactggcaagaa

SEQ ID NO: 518597 - DNA, 116 bp, Homo sapiens
gtgctggggtgactctacaggatcttgcgagttaagcgggtagcacaggcctttcgggagggagagaataccaggttgcagagcctgaggcctgtgatcagattgtacgggagctt

SEQ ID NO: 518598 - DNA, 252 bp, Homo sapiens
aacaacaacaacaacaacaaatccctaagataaacagcattagctttaaagcccataatatttggcagagaaaactgctatctgaggctggaaagatggggatgccttgacaaaacatttgtcaaattggtctcctgttatagattcaaaggcagttcatgtacctagtgaacttgcagcttcccaagcaagagattggaaagaagaatattagtagcagtagttatctgctttaggcagtatttgccaaga

SEQ ID NO: 518599 - DNA, 144 bp, Homo sapiens
aggatatataaggaacacgcgactgtctagactcttcaccctacctagccactaggggactcaggcctaggccgcaaacaccccctacactcaggtcccctagtgccgctcagaggtggctcatgggcctattgcactaggcta

SEQ ID NO: 518600 - DNA, 175 bp, Homo sapiens
ctgcccacaagtgttgtggtaaatattagagggagtatagggctgttactagtatgttgagtcctgtaagtaggagagtgatatttgatcagcgacaacgttgtttctagcacagagagttctcccagtacgtttctagtgcggggtaaggcgaggttagcgaggcttgctagaa

SEQ ID NO: 518601 - DNA, 705 bp, Homo sapiens
agcgggatcgcgcacgtccggagccatgccgaccgcaggcgccgtatcgcgctcgtctagcagccccggttacgcggttgcacgtcggccccagccctgaggagccggaccgatgtggaaactgctgcccgccgcgggcccggcaggaggagaaccatacagacttttgacctggcgttgagtacgttgttgggaaggaaaaactgtgccattctgattgaaaatgatcagtcgatcagccgaaatcatgctgtgttaactgactaaccttttctgtaaccaacctggtatagaacaaacattttggacatttctacccgaccccaagtacacaaattgttactagtcaacagcacgatgaaatccctgtcttgacatttccaacacgataattctaagtatggtacctttgttactgacggaacaacatgcagacatggctttttcccgaacctttgaagtcgggggatggtataccttttggacgtgttggaacgtacaattcacgaatagagtatggcagcctttggttgcatgctcttcttgtttagatgtctctgggaaaactgctttaacactcaagctatattgccaccttggaggatttactgtaaacccactcggaccagaccgactgcactcaccttggtccatgggtcatcaagtgaacaggttaccccattttaacacaccaaatcatgtgca

SEQ ID NO: 518602 - DNA, 497 bp, Homo sapiens
  misc_feature (14)..(14): n is a, c, g, or t
  misc_feature (269)..(269): n is a, c, g, or t
acagcattttatanaacttcatgatcaagtaacagcgattacacctataaagaagaaaaaattctacacattcatactttgcaaatgggaagagattcttcaaagcatttccacttttaacaaatgtctacttaaaacctactgtgtgctaagcatttttctaggtgctagggattcagcagagagcaaagcctgctctttcagcggttatcttccaatatgacaaaggctatctagaaattttatttttttttagcttccttcaattntccaaggtcagtggttcccaaccaagggcccacactgtcaggcgtgaaggaccataatgcgaattaattaggcaggatgagatggccaaaagttctgatcctctataaacaatgccaacctgtgtgacataaaatgcacatagggtccctgctgagagatatttgttctaatataaccaggtgctacgggttgttgttctttcttgaattatttttcattctgcgtcg

SEQ ID NO: 518603 - DNA, 945 bp, Homo sapiens
gtgaccaagcgcctgactcaatgctgggaggctctggagcaggccttggacacgcatgatatgcatgcagaatatatggactcataatgtgacatcctgatgtggctagtcgctatggacgcctatacgccgtgtaatgcagtgcttgccttagtatctcatacatgtataagcgttatcctgtgagatataggtcacgtgtcctaagttccaacccatgggagcggatgtgtagcggatcgaattcctgatgtgcccagtgaccacggccagaggtccgtgtgaaatgggcatgaactgctgcaatgctcatgtcctggagcggagaagcaatgtgaccaagcaatgaggacagctggaatcgttacggtctcaccgtcagcgaataccgtattgtgacgcactaacgagctagggcttgggaccctgggacaactgtagtagcagagtatatctttgcagtgggctccgagccatcaaaccgcatagattgaactcatagatggggccgaagggggagcggagattgaggaggcagtacacttcagtagttgctgtcccctgttgttgtctcagattctcatgtctgtctgcgtaaatgctgtgggccaaatggccctgatcgtggaatctagaagtctctgggagtaaggatggtgtggtgcttgagacaaatgactgtccaagggatatgagcttatgagtggagatatgttctgcttgacaagagtccagagaataaaggctggtttgtgatcatatgtatgggtgctagaggtataattgagaaggggataggaagcacttattgagtgtagggcttgtcaaaggtaactggcaatgaggagaagatcgtctggaaaaaaaggtctaagggttgaagaaggggccaaaaggcgcggcaagtgttggcagttacagtcgggaaggggtacgagagggggg

SEQ ID NO: 518604 - DNA, 276 bp, Homo sapiens
tttcccccccctttttttttccccccctttttccccccctttaaaaaaggggaaaaaaccagggttttgggggaaaccctaaaaggttgccttaaaattttttttgttttcccccccccaaccccttagtttaatcctgagggaaaatttttgggcctaaagggttttttttttttccaaggcccccccctgccttttttaaccctcccgggccggggtttaaaaatttttccattaaaaggcgggtaaaaaaacttccaagggggttttagttta

SEQ ID NO: 518605 - DNA, 915 bp, Homo sapiens
ccgcagggagcgaactgggtcgggaaggggggaccccggggagacgccgaggaccggagtggggtccccaccgagagtggatcccgggagggcgcctgtgccccccccttcggaatacgcgggttttagaatctggcgcccccggaatctgggacgtcaaaccggagattctgccccgccgacgtgccacaccgaggcccagacgaaggagagaatccgcttaggacgcggcagcccagaagaaggaagagggaaagccccacatgccccccgggatttgatttgatgatgaggcaactgacaccaagggctcctggttgccggggacgctcccccgggtgctcatgcccggagccagaaacgggagggcccgcctggacaaaggctgtcggacatgaagagacacacagaagctgggggaggcagaatccttcgtaccgggagggacctcttcagcctggagactcggagggaccccaagccctcgcccagccccccactgtcgatcctccgggagtaatctcttccctcggcagcgggaatactgattcccactgctcctgcctctagggtgcaagtgtccgtaacctcgctggagcctgggccctccttccccaggcccgacattgaggaacttgggaagaagagagcaacctccagcttccaaacagcacgttgcgggagaagaggaagagagagtgtgagtgtgtgtgtgtgttttttctattgacaccctgtagagtgtgtgtgtgtgtttttttttgaacacctcatagagagagggtgtgtgttttttattgaacatttatatagagagagtgggtgagtgtgtcgttttttattgaacacctattcagagacctggactgaattttttgagtctgaaataaaagatgcagagctatcattttttta

SEQ ID NO: 518606 - DNA, 300 bp, Homo sapiens
gaagacatgtgaggacctgagagctggcagacgcaacttataaatgcttatagctcttcctgctggaggaggaggtggtggtgtacttgatgtgtggaactgccgactccaacagagctaaagaacacccccaatggctctgccactgctggcactgaagccacctccaacgccaagaccactgccataggagtagctgcttcctccacccaggcctaagccactgccgacaccactggaaccgccatagccactggagacggtggactgcaccacagagatgttgcctttcggagaaga

SEQ ID NO: 518607 - DNA, 305 bp, Homo sapiens
cgtcgtatgtaacacaaactaaacatacactttgccctacctatttcatcaaccaattctaatttccttttggttaagccagtgtttttttttctcctttttccctcttttttttgttttttgggggccaaaaaacccccctttggtttttggcccctttaaaaaaaacgggtttttgggggggggaaattttttgttttttttggggggggtgtaattcgcggggaattttccctcttctcttttccccccccaaaggggggggaaaaagggggtggaccccccgccccggccccttctttttt

SEQ ID NO: 518608 - DNA, 265 bp, Homo sapiens
tataaccacatacgaggacataatcagaaaaaccacattcttcgctatccaggacaacaagcagcactaagtactcccactctactagcagacataacaaaaaacaacataccttcaacacagtgtaaaatatacagaggccagctgcccacaggatgcatgatcctatcaaacacaaccagattgctgctagccctgccaagtacttccaatccctacccaagtcctactgaaatacgggtggtcccaatcagtactcttgacc

SEQ ID NO: 518609 - DNA, 573 bp, Homo sapiens
gtacccgttggaatagcgggtttgcagcaatgtgcatatggattatataactgaagagcagggaaatactaaagtccatcatctgatccacatgcgtgtggagccaggttgtgtaggagcaagacgtggtatgggctatcagttcgggaatctggaaaactagccttagagaagagatgctgtctggtctgtggaggagctgttagttagatgtcttatataagttacctatatgtggaaataatatgtatgggtagatggtacatgcatttgaatatggttcctttctgcggtgattgtgggacgaattactagtgactagttactaactaggtcatcaaggaagtcagttaattaaacatgtcactaaatgcctgagggtgaaatgtcccttcttaaattttaagatgaattagttaaaagatacggcatcgagtctccgttgtgcgaagtaatattgatgtgctaagtcattgccagtatcaattgtctgctgttgtgacgtgctcgtaaatcgtcaaagtctgaattactgtaagctcccacattgcatattatgctgggttaacaatc

SEQ ID NO: 518610 - DNA, 338 bp, Homo sapiens
tcccaggagcttaacatagaggcaggaggattgcttgagtctaagagtttgaggttacagtaagctgtgatcgtgacatggcctccagcctgggtgaccgaatgagaggggtgtaaaaatatgaaattgaggctgagtgtggtagcttgggcctataatctcaacactttgggaagccgaggcgggagggtcacttaaggccaggagttggagaccagcctaggcaacaaagcaagaccccatctctacaaaaaaaaagggagaaaaaaaaaaagagaaggggttaaaataaccaaatatcgggggggcccgcccttttttttcggttggggggtacc

SEQ ID NO: 518611 - DNA, 80 bp, Homo sapiens
aaggctgattacgttcgggaaatgctgaccacgcaggcggagaggttttccaaggaggaggttgaccagatgttcgccgc

SEQ ID NO: 518612 - DNA, 313 bp, Homo sapiens
ggtagcacacctaggtcagttttgcatgtgtaaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctcccctacctggagacccttcctta

SEQ ID NO: 518613 - DNA, 220 bp, Homo sapiens
ggaaaacctttaaaaaaagggaaaacttccgtggggccctttaaatgtttttctccccgagggggaaataaaaaaaaaccccccccttttgttaaaggtggagaagctggccacaaggagagccagatccacaggctttttaaaaaaatgaaataaggggtctcccctgattatttttttaaagggggtgggtaataaacagggcctgctttccaattta

SEQ ID NO: 518614 - DNA, 524 bp, Homo sapiens
tagtccgtgcgagaataccaaaaaaaaaaaaaaaaaaaaaaaaaaaaaatattttggggggccccggccctgaaaaatttttaaaacatttcggttgggggcgcgggcgcccagtatgggtaggtgacccggcgggccaataggcgggcttccctaagaaagacccggggcaaagagacataggggcgtggggttctctcacaaattaaaaaagcgccgggggggaaaccgaacgccggtgcggagaagcaactctcaaagagtgggggtccggcgaggcgcccctaaccgggcgattcatatccaaaggggagaggtccaagaggagaggcccagaatattaaaattaaacgcgccccggccccgtgattacagcagagcacagaagaccaggtaaagaaagacacacagcacagtacatcgcacaccagataagcaaacagcacaaaccacacgacaagaaacaaaggagagacaacagcgagaggcacaaacaagaacacagcgcgcaacatcagtacaaa

SEQ ID NO: 518615 - DNA, 430 bp, Homo sapiens
ggcctggtactggtccccggacattttggatatgtcgacccacgctgtcagccgggctgcctggccgcgtgacggcaatggtggtgctgcccccgcggtctccgcgctgcactgacaccgcctccgccagtggccggaggcaggagctgcgtctgagcccatggcgaggggacccgccgacagcgaatctaactcaatgacaaccagctaatacggacagcccaagatatccacagcaaaaaacaagtgagaacacgaacctaaaaacatcaggatattaatagagatcagtgactgcatagccaagcgtagcagcgacatacttgagaaacatagggtatcagacagagatatacaatgcaaacgatcactaaattatgaagacatcataacaaagaatagataaagtatgaatagaaaacagcaagat

SEQ ID NO: 518616 - DNA, 181 bp, Homo sapiens
ggggaacagggagttacgattttgagtagtgatagcccctgggttcttatcacatgagtaataagcagctctttcgttagtggaaatgatcgttacacagctctgtcaatatactacaagccattgaactgtacttgaaatgggtgaatatgaattttatctcaataaagcagtgcaaaag

SEQ ID NO: 518617 - DNA, 429 bp, Homo sapiens
attcgcggccgcgtcgacgcacgaatcacatgtctgcaggctatcctatgatcatgtaatggtgcagactcctactctcaatggtcatgaagctccctggccacaagctgagcagtgctgcctgggtcaaaagcaacccccaagaaaggttctactgtgattacccagtaatctgcagaagtacagctggcactggatgctcgggcccagcaatcagatgtcacacctaaatctaggacagatggcaaagctggtagacacacttccacattttcagtctctgtgggaaattaaagctacctgatcacacacacagggagcaccactatgatgatcatagtacctgccacatggagaatgcctttgctgcttggggaccacggaagcaggtaatgcaaaaggacaaaagaggtataatctaggtcgagc

SEQ ID NO: 518618 - DNA, 199 bp, Homo sapiens
gtggatcggccttctgacgacggcaacttctcgctgctcatccgcgcggtggaggagacggacgcgggggctgtacacctgcaacctgcaccatcactaactgccacctctacgagatgcctggcctgtccgcctggaggtcacctgacggcctgtgagtgcttcccctccgtgactaagtaccgaataactcttcata

SEQ ID NO: 518619 - DNA, 169 bp, Homo sapiens
ctcctccgtatattgcctgatgctgaggttgggtatgattgatcacatcacccagtactacacatagtacctaatagtttttcagcccgccctgctctttgtgtgtgtgtgtgtgtgtgtgtgtgtgtgtgtgtgtgtgtgtgtgtgtgtgtgtgtgtgtgtgtgtgtg

SEQ ID NO: 518620 - DNA, 974 bp, Homo sapiens
gcatggtagaaactgaagatttaacagagaactgtgttttacccgagtgccaaaaatgctgtgagcctccttgcacaaaatttataccactttcgcatttttatctatcagtccagatagttgtctcccctccttctcccaggacctctccaccattaaaatgcacaaaccacatggccgatttcaccatttacatttattttcaaaagttactacaaccaaattaacttctacttagaacgaacactgtagacaacattctactaacacgagctactagactcgtgacctaagaaagaaactgaggcaacagaaccaaaccacttgacacttcacctgctacactgggctgactacacgatctgttctcaagctcagctgactaatatagccacttctgggtacttcagctatcagagatcagttctcgctggatttagacagtctcctatctatagcctgactatccttgtccttgaatatggtgtaactgactatcggctctaccagctcttactcgggccacctctaagaaatatctccttggaactacacctatcccgagaaacacagtctcacacgcgctaataccacaactaacttgttacaaccacactgtcactcccggccactgactgtcaggccacaattatgctcccacttttctaccaataattcttcagctaattcacccacccatctattcctcgaagccatccacacgaacttacctggtccatccggaaatcctgttactccttatagtggggaaccacgggcccaaacctacccacgacaggacggttcccctacatcggcgactgccaacaccgaacgcacggacgactcgcggcaggccacgccgagacatgagaaccgctacagacatgcacgccgccccccaacggcccccggtaccactcgaggccaccgcacatcccactgaccaccaccccagctatccgcctcccagg

SEQ ID NO: 518621 - DNA, 272 bp, Homo sapiens
gggggggccctggcccccaggctctcccacgataggccctggggggccctggcccccagtggttatcgtgtgagagcctgggcaggatcgcatcagaaaggtgctgactacactgggttgcccgagacacgtcaacgagcactccaccatccgcattatctagcccgtcacaagcatctctgtgagtgccgctgtcacgtgcgcatcttttgttggcccaacgagaacaaacagttcgaactttcgcaatatagctaacaactataaatcca

SEQ ID NO: 518622 - DNA, 239 bp, Homo sapiens
  misc_feature (172)..(172): n is a, c, g, or t
gaattgggactacaggcgccgccaccatgcccggtaattttttgtatttttagtagagatggggttcactgtgttagccaggatggtctcgatctcctgacctcatgatcctgcctgccttgtgccttcccaaatgtctgggattacagtgtgtgagccaccactgcctggncccgaatattcttggtctatgtatacgaagggtctttacttatataacttcagtttctcactccttg

SEQ ID NO: 518623 - DNA, 212 bp, Homo sapiens
taaacacacaagcacagatgggtgcctgtaatacccgtgagacctgtggactgtaccaacctcaatttcctggtttggagagtgtactatgcttctatgcaggatgtcaccatggggggaagtgggtgaagggtgtatagggactcccggtactttttttttttttgcaacttcctgtagttacttcgaaataaaaacttttaaacgtgaaa

SEQ ID NO: 518624 - DNA, 209 bp, Homo sapiens
acggatggagtcctgggcacagtggtccacacctgtagtccacactttgaggagccaggcaagcagatcacttaagctcagaagtttgagacaagcctgggctggatgacccaacccaatctctacaaaaaatacaaaaattagccgggcatggtggtgcatgcctatagccccagctacctgggaggctggatcactggagcctgaag

SEQ ID NO: 518625 - DNA, 339 bp, Homo sapiens
ttttttttttaccccccccccaataagggcccaggggggggggggtggcccaaggaccggggaaatttaaggcccccgggtttgggttggccttccttcccccttcggggaaacccccctggggggccccccccccccccccgggggcccgccccattgggggaggggtttcgggcccttttttccccggggggggggcgggccccccaggcccttttggaaaaaaagggttccctttttggggttttttttttttaagggcttattttgggtttttttggtttttaacccctttttttttttttcccccccttggggggccccgggttttttaaggga

SEQ ID NO: 518626 - DNA, 357 bp, Homo sapiens
tttcccgccagcctttttttttaggtccccaagggcctccctccctcctcctttttagtgaaactgaaaccaaagggttcacagttagattttccccttgggccacttttttttggggtttggcttgagcatttatgggcagccccaaggtccagtttaagtcccagacagcacaggtcaagcagggggggattgtggagcccctggcaggttggctggggggtgcccccttagcccaaaagcccggccaggtccaggggccgggggtccccctgttaagggccccggccaggcctcactcccccctgaagggactcgagccatgtattcattcagtaaactgacattattttccca

SEQ ID NO: 518627 - DNA, 106 bp, Homo sapiens
  misc_feature (50)..(50): n is a, c, g, or t
  misc_feature (81)..(81): n is a, c, g, or t
  misc_feature (103)..(103): n is a, c, g, or t
gatcgttccttcatgggggtaaagaaaagctggtctggagttcctgaatnttgcattaattgtcctgtttccttgtagttnaataaaaatagaaacctgaatnaaa

SEQ ID NO: 518628 - DNA, 118 bp, Homo sapiens
tggtgaagagaattaattcaaaatacatgtctcatcctcttagtaaaggcagtttagcattcataagaagatgttatttgtaagtaaccatataacaaggcaaaaggctataggtatc

SEQ ID NO: 518629 - DNA, 1197 bp, Homo sapiens
ggagagagagaactagtctcgagttttttgtgtttttttttggcccatctggttaattggtttgccccgcccccgaaaacggagtcttactctggtcggcccagggcgggagttgtagtgggcatatgactcatcgggcctcacttcgcaatctcttgccttcccggggttcaagctttgctccagggttgagatcttagaactccttagaccttcgtgtgatctataccacaccttcgtgactcccagaaaatcgctggagattacaccaggggttgacgccaccgtgtgcccagaccttcaattgtgcatcattatatctcgctttacagcttccccccaagcccccgagagaacaagtgtgccaactattaacacccatcaagaaatccaaagcattcccgcccaaatgtgaccttatagccccacattgtgctatcaaatatacacttccgcgagagtgtgaaaaaatctctcgacgcgacaaaaagcgctccacacaaacggggattccacgagcgcacgggccgctcacaaatcgaggccattcgtggatactattcccccccgtttaattttttcacccccctttcgagtgtctcccttaaagacggagaggacacatgtttcgccctcctttagaaagagagattctgtccaacatttgaaaagcgtcgatcatttttttttctccaaaaaactacacagcaatcttggcgtcgatttaaaacttgtggcctcctccacatactcttttctcaccactgctgcgcgtgtagaaaggaacacccccacaagggtatatgtggaccccctctttatgaggcggctcacttacgaacgagctgtctgagtacgtggctatcccaccacagcattattctttagcttattgggcaataaggcggcccactaagtatccaccaaaaatactctttggggcagcaacaaccgcgcgagggctcaacaccgtgggtaactcccatgtggaaagagggctccttggccaccaacgtacgcacagcacctcctttatagaaccaacctcggagccaagtaaatataccatgaacgcgaataccagctacaatgctggctgtgcagtaccaacattaatgtatcgctatcctatgcacaatcatccggacccatgaaaactcgtgcatgctctcatcagaagacttcgcggtcccagca

SEQ ID NO: 518630 - DNA, 953 bp, Homo sapiens
gctgcgagcggaggagcgcgggacctgcgtgacacgctgacgccttcgagcgcggccggggcccggagcggctgttagcagcccgggtcctgaccccggcccggctcccgtccgggctctgccggcgggcgggcgagctgcgggagacggaccgtggacctggtggaggatgtctcggcaagacagcgcatgcgagggatctggatgagctgcactacacaggacacaagattcagattgtgccgaagaccagagggatagcaagtgcaagtggtcaaatggacccatgaggaagactgagcagactgaatggacctggatgaggacaagttttggaaaagacagggactggaagtacctggcacagacgcagagttccctaacacggaacttgacacagcaatgcccagtacaagagtggctgagagttatatgaaatccaagacctatgtcaaggaggccatgggaaccaaaagaggaagaccaaaaagaaggtcatcagaagcatgcgtatacacgacagtattggcacaaagagcagagagaaaacatgagttgcaccaagacagccttgaaaggggcccgagatggggagaacagaaagatgcacagaaggacacctgctagggcaacagaacaaacctcaaacaccgtgaaggctggaagaaggaactaggcgtgagaacccagaagcgaacgagaagaacaacgaaatacatacattgagaagagaaacaaacaaatggttcattggaggaaaatgagatgagacccgaagaaaatagagaaaaagtggattagcaaagggaaaggacaaagagaaatgagtgtggaacagagataaaaatggaaagtcttaacacaaatagaaagaagggacaaagagaagaaaagagagagggaatacaattgaagaaaaagataaaagaaaaaatgagaaaaagaacacaaaa

SEQ ID NO: 518631 - DNA, 1076 bp, Homo sapiens
aacacagctaaccatataccaatgatggcgcgatgtaacacgagaaatgcacataccataggccacctacagcacctacctgttccagaaaacggccttcgatacgggataatcctatttattaccatcagtaagtttttgttctacttcgcaggatttttctgagccgttttacgcactccgagcctagcccctaccaccccaattagtgagggcacgtggaccgccgaacagtgcaatcacaccgtctagaatcccctagcacagtcccagcgtcctaagagcacatccggtattgacgtcgcactcatggagttagtcaactctagccttgtagcgtcagcacatttaggtcgtcaagtaggatacacatcatacacgaacaaacccgagaagtacattgtccacaggcacttggcgttactttactaattttctactgtgtggtctcgtatgttgtacaccatccttagcatagcccattcaatgcacggtgagcttccggacgttcttaccccctttctacgcaatgtttcctgcacgggctaattcatacagagacttgctaagctactttatggttgtcgtgagagcgcatcgaagcgacgtgttctctaccagagaaacatgtgcaactgatacgaatatgatgtgcgtcttcaaaacatttatcccgtcgagcgtactccatggctgtgtcacgatcgcgtcgacacaacagtaaagtagtcttgtcagcttatctaccatgtctcacagatcatgtcaccctatatggccgtctcgaaaagcacggcacggcacctgagtacgtgggcagcttccttggataacgaagtaggtagggaaatttggaccattagtttttaccttcggtgtagtacgttccttccccaagttcgtcactttctggccttggactgcgggttcctttaaaaagatgaaaagaatcgacacaaccaacaacatctcacacaatgacagtcagaaatcgcacacatcagaacaacaccacttggctctgcgcacctcactcacacacaacgcttacaacacccccacacaagaggtcgccc

SEQ ID NO: 518632 - DNA, 156 bp, Homo sapiens
accagatgcagcaagtcagtctattctcagcttctgtgagttttttttttactttttttaaaagattccacttgtaagtaagatctttggtcgctcggtgccgggcctatttactaaggtcaggccctcagggccctcctatgctgctcaaaagga

SEQ ID NO: 518633 - DNA, 479 bp, Homo sapiens
  misc_feature (101)..(101): n is a, c, g, or t
  misc_feature (103)..(103): n is a, c, g, or t
  misc_feature (109)..(109): n is a, c, g, or t
  misc_feature (129)..(129): n is a, c, g, or t
  misc_feature (213)..(213): n is a, c, g, or t
  misc_feature (231)..(231): n is a, c, g, or t
  misc_feature (233)..(233): n is a, c, g, or t
  misc_feature (249)..(249): n is a, c, g, or t
  misc_feature (358)..(358): n is a, c, g, or t
  misc_feature (428)..(428): n is a, c, g, or t
atgattggataaattgggtcatcttcctttttatgtgaccatattcctaataatgtaggtaagttattgaaaacgtagcagagagcatgcaaaattttgantntgcaancacatggatggggaaaaggntatgtgggaagtgctttgacattagacagacctttgctgatttgccttctagctgtatgattttggagaaattacctaataatntcaaaatagcagaggtantnttaggattaaatgagnttaatctttgtgaaagtgcttctcttgtgacaatttaaaaaatcttttaatttacagtggcaagtaaatatgcttaactgttaaatagataaataatctttctgaatantagggaattgactgaattttggttttgtgttcatgctgattttctttctttctttctttttttgagaccnagttttgttcttgctgcccaggctggagtgcaatggcacaacttggtctca

SEQ ID NO: 518634 - DNA, 408 bp, Homo sapiens
cgtcacaggcaaaggaagggatctcttttgcgcgacctcgtgattgtaattagcagagcgcgaacgagctgaactacacttcggcatactacttaaaagatgcatgtatcatacgtgctttaagcaagtcatgtggccaagcctagcatcatggagccagaaagtatagccttgccgtctgtctccatccatgcatgtatcacacattgatatatctccatgaattcatcagcaacttagcacgtgcatctttcattccagtcttcatcatttctcaccatgacgccatctctcaggcctcaggcagcgaaactgcatttcctttctattacctcaactagcatcggggcatcatttctgataaagcaccacctctagtgagcatcatcttttttgtttgtgtgcact

SEQ ID NO: 518635 - DNA, 342 bp, Homo sapiens
aatacgaaggacttatcaatatcatgaagaattattaatattactgctgttagagaacatgaatgagcctactggtcatagcttgttcctgggttaaaatgcatcggggtagtccgagtaacgtcggggcattccggataggccgagaaagtgttgtgggaagaaagttagatttacgccgatgaatatgatagtgaaatggattttggggtaggtttggtctagggtgtagcctgagaataggggaaatcagtgaatgaagcctcctatgatggcaaatacagctcctattgataggacatagtggaagtgagctacaacgtagtacgtgtcgtgtagtac

SEQ ID NO: 518636 - DNA, 694 bp, Homo sapiens
  misc_feature (355)..(355): n is a, c, g, or t
  misc_feature (694)..(694): n is a, c, g, or t
gatacatgtcattgtacattgctcacagcccatgtgatgaatacgacctagagtgcaccctagcgtatactgtagacagtaggctgaaatgacttgccaatggagattgaacagcgtgatcagatgcactattgtggtgcagcatgacgatagcctgataggatgggcagacgtgttgcaatgcaatctattggaatgctgagtatgctctgagcaatcgttctgcgaacctagaactggtctaaaggatatagttatactataagtgcaaggaatagttcactcatgaagttcattgtgaactgtgactacgaggctgaggttatgactacaactaacatctcacaatagctgngatcactgacgaactcacaggccaaccgtcgtactatcctctggtaatgaaagcctgacatacctgtgtgtcagtgacactgatagcccatgtcacactgtttatttctgacgtgcagctacagttatgttatgacatctacaaagtccgatgcagtttcttcactgctacgatatacacatgatgcaatgtaactagttattgtcataggctagtatggcatggagctgatccagcgataatgtttagaccgtgtagaatgccttagagagattgcgctcagatgactagaagtgcactgctgtcaggcgatatcagtgcacatcatggttggcccgn

SEQ ID NO: 518637 - DNA, 170 bp, Homo sapiens
gaaactacctaaagcaaatgggaaggaagctatatcacatttcgtcattgacacggagattcgggcaagtcaccactacttgccatcttatctataaatgcggtggcatcgacaaaagaaccattgaaaaatttgagaagggggctgtcttagatatggagagggctcca

SEQ ID NO: 518638 - DNA, 219 bp, Homo sapiens
  misc_feature (211)..(211): n is a, c, g, or t
cccctacactaaggctctaaataagaggggaagataaaatcttaagcttcttttttcacctggatctgctgctcctatctaatcctagttttcttctagaccaagagtagaataggttttctataaaaatccaggtagtagatactttaggctttatgggccacagtgtattctatactcaatatatctcagctactaatacactagtagncctgggaa

SEQ ID NO: 518639 - DNA, 88 bp, Homo sapiens
ggatttgctggtgcagtacaactaggcttaatagggacatgaccagttcttatgctaaaatagatgtattttaaaagctaaaggaaaa

SEQ ID NO: 518640 - DNA, 179 bp, Homo sapiens
aggctccagcttaacgatatctggaggtcagcacggtgctcacgtgtcgacggcactctgtccagggaggcatgcaccggagtggtgaatacacgtcgaccaggatccatctatgcgatctcgggccctccgcgcggagctcccgtatccacggagctagaccagggaggcatgcaccg

SEQ ID NO: 518641 - DNA, 1893 bp, Homo sapiens
tccataaaatttttagtttaaaaggggaaataggtaggatgtaccgtggtaagggcgataagtgtggggagaaatggggggggtttggttattgtccaacactggtccatttaatatttacacggtaggtaacaatataggggagtagggtgattagaggtggagtagataagcgcgtaggtagaagtaaagtgtaaagagagggtgagataggcgggctaataaatggggtgagggagcatagatcagagcgctcatagagtgaataagggtgagaatactctacacagataaatgggccccaatattgggggcggcaaaaacacgccggtgtaaaacgcgggaggcggcaagcgcccctccctaaaaggggggaacaaacgcgcacgggtgttcgagtaatcgagcacatcacaacacgggggtgtgttacagactctatgatgtttacacgactttgatgttatcccccccaagatgttgcgcgagcatgacaatacacgtacaatgtaaaagagagcactggtgaggatgcgccttgagagacaatatttctacaactgttagagagtgtctaatgttacagaggagcatattgacgccaggagaccacaactaacacgtaaacagcggagaatacaacactatacttacacacattccagtgttctcaaactacttctacaacagacgactattgcgggtttatactgttgtccaccacgcggtgtcagtagacaccccggtgctacaccacacatcttgggcgctatattcaaatatatcaccaatcgccccctataatgaggcgaggggggatcacaacttaccacggcaacgcaggactagagcaaataccgcactacaaacaagaggaaatactatgcacgcagcagcgagataacaacctataggaggagctatcaagggggagtaatgaacaaaaagcacccacaaaacccttcaccaaaaaagtgagggcccacgaagaacataaataaagcgagcgaggaggaatacaacacaggcgaattatgcggcacaccaagaaaatagtcagcagcagagaaacaaaaaatcgagcggccttataccacccggatacatcaaaaaaggatcagaccagagcggagacaaagacacaagaactccatgcgggggacagtacatcaatgcactgacactagcgaacgaacaaactagcgaggggggcgaaacagaagagagtcgcagtgtaggcgacacaactggttggacgagaacaaaaaacgcaaaacgacccacgaggccccccgcagaaataagttaccaacgaagaaaggaggcgactgccaccacatacgggaggagacaaccccccccccagtgtgaggacgcacccatcacaagcagacggttagtaaacaaagagggggggggaggccataataacccacccaacaaaagaactaatataacatatcgcggcgagataaaacgcccccgaataatcgagcaagccaaccaccacagagccgaaagagaaaggcaacacgtagcaggagtggcggaagcaaaactccatgaggagcaccaaagagcacaacaactcaaagagctcgcccgggggggcgcaacacaacaacactagtgccgcgcaacgaagcacagaagtcgagcccatcaaacagacaaacaacacaataaacacccaagcgcagcagcagcacgcgacgtaagagagaaaaaaacaaacgtagaagagacgaagacacaattaagtagaacatacgaagaagagacacgaacccatacaggcgggaaccaagcagaccaaaataccaaagagacgaagcaaatacatagacaccgaggccagcaccaaaaactaacaaaagcacagcaagcaccacc

SEQ ID NO: 518642 - DNA, 132 bp, Homo sapiens
  misc_feature (78)..(78): n is a, c, g, or t
ccccagcaatgctgggctcagcatgcagcagggcagccaggccgtgttctaggcgcaacacacacaggcacccagttntgctttcacacacacacacacacacaacctcccgggggggcccaggggctcccc

SEQ ID NO: 518643 - DNA, 1126 bp, Homo sapiens
  misc_feature (891)..(891): n is a, c, g, or t
ggcagtctgtctgagggctggccgaagtggctggctcatttaagatgaggcttctgctgacttctcctagtggacggcgtctgcagatggtccggagacgaaggcctcggccaatctggtgctggcgtgtcccaggcgagatgattaaagatgcaggtccagccgacggggcccgctggatcaaagttccagagttggtgtcatcctgaaggttcatgggccgagggtgttccgatggtaggtactatggcgggctttatataggcactagactgggtatccgctagtaactagactctgccactttgaaagggtatgacggaatttagccctccccattcgatagtcaaagtgagttacttacgaacaacacttatgcagtacgtatatacccttgtttcaagttctttcgaaatcggtagtatatgaacttaagggctcttaattaactttgtctgtgcatagggatccctctatgtgcttttcctatttgtgcgattgcatagcctccttagtcgatcgtggcacgtgtgggggccataggaataagtagaatgtgtattgcagtgtgtggatgggttggcttcctttgaaggcaacccctgattgaggaaccagatgtaatgtcgaaccggtgtcattgtgagaattaagcttgccatgttgtatgtacctggtgatgggtcctaacgactgggaaactctggttcaccattttctcaatccatggccaatcaaacttgtgttttcgaaaatttgcgttgaaccacatggtcactcgtggaaagcttcgagctggtggccattttttgggacttccagatcccccattaggcagttcaggatcctatttagggccacccggaacgttgatttcaagacaattggganaaaaccttccttttttgggcgcttttacaggcggaagtcaccttgtgcgcgacggaaggaccacggcggtggaaactagacagccactttacctctgaaggggcgcctgtgggcccttggaacagaaacacgggccaaggcgttgggtgcaagtcaccagagaccaagaaatggcggtttctatggggcgagagagtccgactgtaaccccctcgtggtggaaagagacctctca

SEQ ID NO: 518644 - DNA, 1169 bp, Homo sapiens
attaaacacaatgctaccaccgtacctccctcaccaaagcccataacacagtaacacatacattataacaaaccctggagacaccaataagtgatagcgagatagattcgtgttgcgctgcacttcagttgtccccgcaacaagtccgtaggacctagccgcgccggcaggtacgtgactcagtgctagtgtccccctctattgagtccccatcctccagaagtatcgtcagtcagagcaaccgactaatcaccacctcaagcaatggactaagtcaaagctagaccgtcagataacgaagagtgatagaccgatacacaacactaagaggagcgaacctggatctctgatactagtatccttaatgcagttttgtattagccacgaacgtaagctcctcggactcttgcctcactcatgtacgaccaagcacccaagtatctatagaacctagccatggccgatccccttatgagcgggcgcagggattataggcttgcgctctaagattaacaaatgccctagcccacttcttagcacaaggcagacctacaccccttatccccatactagttattatcgaaaccatcagcctactcattcaaccagatagccctggccgtacgcctaagcgctaacattactggcaggcgcacctagtcatgcacctaatgggaagcgccaccctagcaatatcacgcattaagcttccctctagacttatcatcttcacaattgctaattctactggactatcctagagatcgctgtcgccttaatccaagcctagttgcacactgctagtaaggctctactggacggaaaacactcaaaaaacaagagcgcaaaagtctacacaaagaggcgcgccacaaaaaaacaccacagaaacgacagaacagcggcaccaccctctgataaagaagccacacaaggaggacgacaacaaacagccacgcccgcgccaaaccaaacgcgcgagcgccacagaccacacgcgaactcgagaagaaacaccaatcgggggcgaaatggacacacacgacaaagagcatctgtaaacaaagcagagaaaaaacacgacgccaagccatgaaaaaagacacaaaacagaggggcagttcggaagtccaacacgacacgcgcacaccaatccgcccccgcccgca

SEQ ID NO: 518645 - DNA, 907 bp, Homo sapiens
  misc_feature (887)..(887): n is a, c, g, or t
tcggtttgtgaggtttcttataatcacacgtcaggagtcctccgctgtgtaagatgcaacacacgtgtcaagcacttgggctccttggaaagcaatcgccccattgcccaacggacacgctcgggtgaacccccttcccactaagggacatgacgcaatacacgggggaagcccgcaaattgcgcacgccactgcgcaggagtcttacataagacacatagggaccacgccgtgggaacaggaattaatcatagtcctcaacaagcaagggatatatcatggcgtagtgacacacaatttagtgacacataaagtctataagtgatcgaaacaaacatagctagggaaaactatagtttctcggttatcatcgagagatatgtctacggccgtgggttatcccggggtccccgcgattttttcctccggagacgtttggtgcgcttccctttcagttcttcccaagcggaagtcccccttcccgccggcacactacccaagccgccacagactggggctggagcccctacgcgcacaccacggccgtacctcgccagggccctcacacggtccgcgcaaaccgcgccccacatgaccgtgagggccccctgcgtgcccagcctctcgggaccccagtctgaggctctgcgcagccactacctggtgtacagatgtccccgggacacacgctgaggatgaggccggatagaggcccttgaggatggtagcatggaaggagtgagagggcgacaaaagcgccacctctgtgtggagcctgcaggctggtggctgggactgagccagtgccaggggcatgtattggcctggaggtcggaacactgggattgggggcttggctgccaaccttcctctccagctgacctctntagcctcccgctgcgtcgta

SEQ ID NO: 518646 - DNA, 511 bp, Homo sapiens
  misc_feature (146)..(146): n is a, c, g, or t
gtgaagcaatcctcctccatcagccttcagagtggctgggactgcctgcgcggccaccacacccggctaatcttgtggttttttgtttgttttccgttctgggtttccgtcgggcgcagtggctcaggcctgcaatcccagcactntggaaggcagaggtgggcggatcacccgaggtcggagaccagcctgaccaacatgaagaaatccccgtctctacaagagaaaaagacaaacaaagaaacaaacacaaaaacaagagcgtggtgcgcggggcgccgcgcggggccccacgcaggaaacaaccctctttgaagagaacccatctcgcgtgagaggggggcacgcgggggccccccacgacgagcgaaaagagccacaaccgcgtggcgcaccaacaaggagaggccgcccacaagagggagaaacacccgcggggaacaagagacacaaagagcgacggggggacttctctcaccaccaagtcagagaaaaaagcgcccgcgggagt

SEQ ID NO: 518647 - DNA, 789 bp, Homo sapiens
tcattattaccctcactgtcaacccaacacaggcatgctcataagggaagaatcaatactgtgaaaatgaccatgctgccccaaagtaatctatacattcagcgcaattcccatcaaaatactatcatcattcttcacagaaccagaaaaacaattctaaaatttatatggaaccccaaaagagcccgcataaccaaagcaataccaagcaaaaagaacaaatctggaggcatcacattacccaacttcaaattatgctacaagttaccaaaacagcctggtactggcatgaaaataggcatgtagaccaatggaacagaatagtgaacccagaaataaagccatatatgtacagccaactgatcttcaacaaagcataaaaaaacataaattggggaaaggacatcctattcaataaatggtgctggaaaaaccggcaagccacacgtagaagaatgaaactgtatccccatccctcaccttatacaaaaatcaactcaaaatggatcaaagactaaaatctaagtactgaaaccataaaaattctagaggaagacattgaaaaaactcttctagacattggcttaggcaaagaattcatgactaagatcccaaaagaaaatgcaacaaaaacaaaaataaataaatggaatctaattaactaaaaaaattctgcacagcaaaagaaataatcagcagagtaaaaagaaaactacagagtgggaagtatatattcacaaactatgcagtgacaaaggactaatatccagaatctacaaggactcaagg

SEQ ID NO: 518648 - DNA, 140 bp, Homo sapiens
caaatgatgtcacgcccacgctacttttgtactttttacgtacgacgactaggtttcaccatttggccgggctggtgtcaactcctgacatcaagtgatccacccgccttggcctcccaaagtgcggggattacaggcgt

SEQ ID NO: 518649 - DNA, 525 bp, Homo sapiens
aggagaatggcgtgaacccgggaggtggaggttgcagtgagccgagatagcgccactgcactccagcctgggcgacagagcgagactgtctcaaaaaaaaaaaagaagggaatgtccgggagatgtattggatacccagggtttaaggtaaatttccaccagtataagtcctattggcaactggaaaaatgtggtaggctaaaggtaaaataaccactattagtggaccattatatctcttaagaaaaagggccatatttggctccggcttctggtaaaaatattattggttcggagggggaaatatgggtcgtgtgacctttcacttaattcctactcccttaaggtgagagagacaaaatggacggaagagggaaaaggcgggagtcaactccacaactttgaacatacggagggacttctcggtttggacaacgatttctccaggccacccatgctctaatgcctgggggatcagggacaaccctcttggcacaagctacagcatcagccggtccaggggac

SEQ ID NO: 518650 - DNA, 265 bp, Homo sapiens
tactgccggtgcctctactactggtgatgctagaggtaatgtttttggtaacaggcgcgggtaagatttgccgagttccttttacttttttcaacctttctttatcagcatgcctatcttgggttgacagtgtgggtaatcatcacttgtctggttgattctagatctagcgctgttacttgtcagtacagtgttttaatctgacgcaagcatatacggaggagaatgttatcatataacttatactaacattagttcttctata

SEQ ID NO: 518651 - DNA, 857 bp, Homo sapiens
  misc_feature (36)..(36): n is a, c, g, or t
  misc_feature (61)..(61): n is a, c, g, or t
  misc_feature (72)..(72): n is a, c, g, or t
  misc_feature (90)..(91): n is a, c, g, or t
  misc_feature (96)..(96): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (112)..(114): n is a, c, g, or t
  misc_feature (124)..(124): n is a, c, g, or t
  misc_feature (132)..(132): n is a, c, g, or t
  misc_feature (163)..(163): n is a, c, g, or t
  misc_feature (172)..(172): n is a, c, g, or t
  misc_feature (176)..(177): n is a, c, g, or t
  misc_feature (181)..(181): n is a, c, g, or t
  misc_feature (187)..(187): n is a, c, g, or t
  misc_feature (216)..(216): n is a, c, g, or t
  misc_feature (220)..(220): n is a, c, g, or t
  misc_feature (278)..(279): n is a, c, g, or t
  misc_feature (303)..(303): n is a, c, g, or t
  misc_feature (312)..(312): n is a, c, g, or t
  misc_feature (317)..(317): n is a, c, g, or t
  misc_feature (321)..(321): n is a, c, g, or t
  misc_feature (492)..(492): n is a, c, g, or t
  misc_feature (852)..(852): n is a, c, g, or t
ggaaatctaccacccagcacatggcaagacccaggncctggccaggcagcgcacacaatangctgggcctgnccaggccgcaggcggggnnttggnggananangatgaaannnaaggttactncaacattnagatatccggttttttcctcttttatctcanctaggttgnaggnnagancaaggnacagagtcttaaaaaagagatcctctccngggntcccatcccaaagggctggggcctaggggagtgtagacagagcaagggaagggaaaannaaaagggacctagtatgtgagtgnatggggggnggggnggcnggtgtgggaagctcccaccttcaaccccgggccttggctactgggacagtgcgggctccagcagcttcaggacaccacccaccaggtgcagggtgccagtgactagcacatggatggcagcagcctcacggagtatgctggccccactgtgagccacagggtgggtgaggngggcctttgggggactaggtagaataaaagataaagaacttggccttggctgatccattgcgaggcatgtgaaatgcagctgaagacgagggagctggcactgcaggtgtggggtgggtggggcgccagaagcagggatgcggacccaccgggctctgggctggggacactccagaggtccgggctggcctgctcttcgtccaggtggttccagtgctgctggtgttccaggcagcggagagggacctggtccagtgtcactgtgaagttctgttggtctgcgttgcctgtggatgacacctctgtcaggttagggcagaagacggcatagtcaaactggcagggctgcagcagcttcancaggg

SEQ ID NO: 518652 - DNA, 439 bp, Homo sapiens
  misc_feature (53)..(53): n is a, c, g, or t
  misc_feature (304)..(304): n is a, c, g, or t
  misc_feature (328)..(328): n is a, c, g, or t
gtgcagtggcgggatctcggctcactgcaagctccacctcccgggctcacgcnattctcctgcctcagcctcccaagtagctgggactacaggcgcccgcacatacgcccggctaattttttgtatttttagtagagacggggtttcaccgttttagccgggatggtctcgatctcctgaccttaagttatccgcctgcctcggcctcccaaagtgctgggattacaggtctgagccacacctggtcccatctgggaattttagatccaagcccagggagccagtgcatgcagcccacactggntgggctgcgttgaatgagtgaatnggccaggccagggtctctgcacaagacgccgaggcagctcccttggctggtctgttctcctgagcgggccttcagcttggaaagcccaggatgggaggaagggggggcagt

SEQ ID NO: 518653 - DNA, 430 bp, Homo sapiens
  misc_feature (1)..(1): n is a, c, g, or t
  misc_feature (64)..(64): n is a, c, g, or t
  misc_feature (75)..(75): n is a, c, g, or t
  misc_feature (79)..(79): n is a, c, g, or t
  misc_feature (101)..(101): n is a, c, g, or t
  misc_feature (143)..(143): n is a, c, g, or t
  misc_feature (162)..(162): n is a, c, g, or t
  misc_feature (165)..(165): n is a, c, g, or t
  misc_feature (182)..(182): n is a, c, g, or t
  misc_feature (193)..(193): n is a, c, g, or t
  misc_feature (200)..(200): n is a, c, g, or t
  misc_feature (204)..(204): n is a, c, g, or t
  misc_feature (210)..(210): n is a, c, g, or t
  misc_feature (223)..(223): n is a, c, g, or t
  misc_feature (229)..(229): n is a, c, g, or t
  misc_feature (233)..(233): n is a, c, g, or t
  misc_feature (251)..(251): n is a, c, g, or t
  misc_feature (264)..(264): n is a, c, g, or t
  misc_feature (279)..(279): n is a, c, g, or t
  misc_feature (285)..(285): n is a, c, g, or t
  misc_feature (288)..(288): n is a, c, g, or t
  misc_feature (298)..(298): n is a, c, g, or t
  misc_feature (324)..(324): n is a, c, g, or t
  misc_feature (356)..(356): n is a, c, g, or t
  misc_feature (358)..(358): n is a, c, g, or t
  misc_feature (373)..(373): n is a, c, g, or t
  misc_feature (397)..(397): n is a, c, g, or t
ngggggttgtgggagtagcagcattggtccccgggttgaaaggtgccctccttaaacctcttgnaaggaaatgtnttgngcagggtagcccgctgggccanatcttcgggggggtccttccgcttgttctgaagcagcttgtntttttttttcatagttttnttngttgctttgttccctgnttgggtacgangtcgggnattntagttngtttttgggttantttggnagtncttgttttctcgttgttnggagttggggttngtattttcttggatngtgaanttngtttgttgcntgggctccacactgagaatgcggaangtgggctagtttttgatagttgctcccgtttnancggacattttttttnccagcaacgcatgatgttccaganggcagaggtaggcggcatccgtttttatagcgt

SEQ ID NO: 518654 - DNA, 305 bp, Homo sapiens
  misc_feature (50)..(51): n is a, c, g, or t
  misc_feature (55)..(55): n is a, c, g, or t
  misc_feature (152)..(153): n is a, c, g, or t
  misc_feature (229)..(229): n is a, c, g, or t
  misc_feature (238)..(238): n is a, c, g, or t
  misc_feature (284)..(284): n is a, c, g, or t
  misc_feature (301)..(301): n is a, c, g, or t
gtcaaaatggcgaaaccccatctctactaaatatacaaaaattagctggnntggnggcgggcgctgtagtcccggctgcctgggaggctgaggcaggagaatcgctggaacccaggaagtggaggctgcagtgagccgagattgtgccactnncttgaggctgggtcacagcgagactgtgtctaaaaaataataataataaaaactggcccacaaacttcctggaganttgaccgtnggctctcctgagtgaataggagctacttccctgctttcgttgcctnaggtttagaggtgggangccc

SEQ ID NO: 518655 - DNA, 339 bp, Homo sapiens
ttcccctagggccccccccccggtttttttttttacacccccccgccccccccccccccatttttacttggttttttgggccaaaaggcccccccggccatttttttttaaaaaaaaaaagcttttatggggcagccaaaccgccccagctttttgtggccccaaagactgggggttccaattttggccccttggaccaatggcccaacccttttttcccccttttccccaaggggggtccccctggaggacttttggggaaaacttgttttcccccttccccccccccttttttttttttttttggaaaaaaaaaaagcctgggtttttcctaaggga

SEQ ID NO: 518656 - DNA, 1067 bp, Homo sapiens
agaaacaaagggaatgatctattgagaggccctctcatcccattcgttgtgatgaagttacgagcaagacgaccattacgcgagctagttcacctgggggactcacgaggattttcccctgaacttgcgtagctgttgatgatatatttccctcaagcttgcctctcaaggcgacaataaatattagttcgtactcactgcatcaaacaacacacaacataaccataaaaaagtcacaaaacgtgttatggacgtggacacttcgcgtccacacgcacaaagttggtaccctaaatcctagtcgagcccgtgagtgagcaaggagagcgtcaactgttgtgaggtaatgagaggtaaacgtgtggacacaacgagtgtcgtctcttcccggagagataaaagccctgcgggtcaagacattcaagagagcgagcgtggagatcttcgaccaaattataaataaagacagcgagcgctcattcgtagcgagaatccaaaaggcaagtgctaattgttcgattaattttacccccagtcgagcctgtggtctaaaagaacacagagaagctaacaatagggctgagtggctttcaattaaacagggcacagagtgggtttctcaccacaagcggagaaggtcactacacaaggtggaataccctacagtggtcaaaaaactccctctgaggaccccccggggggagcagcttggttatttaaccccagatgagacaaggctcaattgcaaactcgttccttagcggcacagttcgaacaccgaggtgcactttgtagcgcaaggggaccagctccctggcagccttgtgaaacacccaaaggttgaggaaagccgaaccaatgtggttttgtaaaaatccgtgggagagtctcggtccggggttaaacgaccacctgaaaaacacacctggtatggaccaacacacacggggttcaaggacaattaacattcgcaaacttcttggttgtcgccccttctgtggaagatctacagaggtggaacagccttatggtgtattatcgactaattcgggtgttttaccacaagc

SEQ ID NO: 518657 - DNA, 300 bp, Homo sapiens
  misc_feature (32)..(32): n is a, c, g, or t
  misc_feature (112)..(112): n is a, c, g, or t
  misc_feature (117)..(117): n is a, c, g, or t
  misc_feature (119)..(119): n is a, c, g, or t
  misc_feature (136)..(138): n is a, c, g, or t
  misc_feature (144)..(144): n is a, c, g, or t
  misc_feature (149)..(149): n is a, c, g, or t
  misc_feature (153)..(153): n is a, c, g, or t
  misc_feature (156)..(156): n is a, c, g, or t
  misc_feature (158)..(159): n is a, c, g, or t
  misc_feature (161)..(161): n is a, c, g, or t
  misc_feature (188)..(188): n is a, c, g, or t
  misc_feature (191)..(192): n is a, c, g, or t
  misc_feature (196)..(196): n is a, c, g, or t
  misc_feature (206)..(206): n is a, c, g, or t
  misc_feature (209)..(209): n is a, c, g, or t
  misc_feature (239)..(239): n is a, c, g, or t
atacttaaagataaatgattagtaaaaaaaanaaaactaacttgtaaaaatcttaaagacattgaatgggttaatgtactgagcagctacggaatgcaaggcactgtaggantaggntnagtatactccccacaannnctcagngtcangcanggnanntnagaaaaaaacccacagccatacactanctnncctntactgagggntgngaggcacaaaatgctaggagactagagaantaagaaatgtcttgacatgaggagaaatcaaggaaagcatggttttagaacatgtgtggga

SEQ ID NO: 518658 - DNA, 1124 bp, Homo sapiens
cggcatgaaaaagtttctggtgaacgatggcacttcttagcatagtccacgcccttatatgaaaagatgcattgtccactttgacagtgatttccccacccgagagcctggttgggcagtccctgagcgccttagccagtagtcgtttcgcgcatcagctagcattagctgccaccagatcctcccgttcgtcctcccatcacgcgtcttcaggagtgtacctggaggcagctatgaaagacgtctttaacgccctaaaaaaagataaagaagaatcaatgaaagaaagggggggccagtccaaaatgtcactccagcaaggcgccacacacacgaccggagacagcactccccgcaggaataatgtgggcaagacggagcagccacacaatgggcgaggacgacaattaaacacgaaatgccgttgcgcacggcgctgttatacaacaccatcaagagccgggaaaagcagggaaaaacaaagggaagcatcagagctcacggcgcaccccccctaaccagtcacctggcgaggagtgcgagccacaataccagctgcactgcaactgctgccgccatcacaccaatgcacaaagcgcaccaacagggctccacatgaaagaccacagtgacaagacgggatacacgccaggacgaacaacaagacgtgcccaccaacccaagaccgcgcatctttgacacgccaagcaccgacacccactgtgaatagactctagcccacgtaagacaacacttgttcattttacatgcaccctatggcatgatcgtgtggaaacaaccaaacttgacctagccatgaacataatacataccgtattcgcccgtctacatacggctagccaacaagatgaaatgactagaccacacagagctccccatccaacacccatgtgaaaagcgcgaaaaaaaaaggaacaacagaaaacacaagcagcggtggagacagcacaaaagggcagagaaacaccggcaggaagacacacagacgcaagcgaaacagcagagcaggacaaggaaccagaacagatgcagagcgacaggacagcgacacgaaaaaccggagcgagaacaaagcaaaaacaagagacaacgcaacaccagac

SEQ ID NO: 518659 - DNA, 446 bp, Homo sapiens
ttagaggacccgtcaaggtggttgtgggtagactggagtgcaatggcacgatctcagctcactgcaacctctgcctcacaggttcaagcgattctcatacctcagcctccctagtagccgggattacaggcatgcaccaccaccacgtccagccaaatttttgtattttcagtagagatggggtttctccatgttggtcaggctggtcttgaactcctgacttcaggtgatccgcccacagcctcccaaagtgctgggattacaggcgtgagccactgcgcccagctggtgtatttactttttagagacggggtctccatatgttgcccaggttggtctcaaactcgagctcccaaagtgctaggattacaggcttgaagtgtatttaatagtgcctgtgtttactgttctctgtcccaatttggcaaattatgcggtcgttctac

SEQ ID NO: 518660 - DNA, 448 bp, Homo sapiens
tagtagccaccatgttggccaggctggtctgaacctcttgacctcaagtgattggcccgcttcagtctcccaaagtgctgggattacaggcgtgagtcgccgcacctggcttaatttgttgattaaaaaatcatttgtgctttttgtgtcctattaagaaatctttgagccaggtatagtggctcatgcctgtaattccagcattttgggagggtgaggcaggaggctcagttgagtccaggagttggagaccagcctaggcaacatagcaagaccctgtctctacgaaaatttaaaaaattagccaggcatggtggctcgagcctgtagttccagctactccagaggctgaggcaggaggatcctttgggtctgggaggttaaggctgcagtttgctgtgattatgccactgcactctagcctgagtgacagtgagaccctgtttcc

SEQ ID NO: 518661 - DNA, 140 bp, Homo sapiens
aaattccaaaaatttgcccggggggggggggcgggccttttgttcccccttgtttggggggtgtgggcgggggattgctttttcctggggggggggggtttccgtggggccaggttgggcccctgcccccccgttcttga

SEQ ID NO: 518662 - DNA, 484 bp, Homo sapiens
  misc_feature (196)..(196): n is a, c, g, or t
gaggagagacgagacgtggggcgcgacgcaccaggacgtccgagagtcagcggggtcgtcacggcggaacgggaggctctggagaacgagcccggcctcaaggacgctgtctggggccgggagccgcaggggggcgccgggtgcagagcacgaaccttccctgtgctcccggcacaagaaaaccccgtgtcgcctngcctgaagggctatagccctacctccggtgagggactcgcgtcgagggggaccaggcggcgggatggatgttgagcagcaggaggaggaagacaacgacgaggaggcggcgcgggcagcagagccgtgcgctcgttctcccagcctgtcttcaggacagccagcagctggacgggctggagcgggcgtgcgtgtggcgcctgggtcctcaatgcgagtgccgaagtccgggcgcgtggcgggcgggaaagccggggcccaaaccaatttctttcccaaagggttcccc

SEQ ID NO: 518663 - DNA, 195 bp, Homo sapiens
acagcctggtcacatggcgaaaccccatttctaataccagtaacaaatataagctgggcgtgtgacaggcgctattatgccagatactcgggaggctgaggcgggagaattgcttgaacctaggaggcggaggttgcagtgagctgagatcgcgccattgcactccagcctgggcaacaagagtgacactctgtc

SEQ ID NO: 518664 - DNA, 669 bp, Homo sapiens
  misc_feature (345)..(345): n is a, c, g, or t
  misc_feature (401)..(401): n is a, c, g, or t
aagggattcctgctggtgctatttgggttgttctagtccacactaccgccagactagattggttgattcaaagctcaccaggggacctcaagggggggaaggaccattaccccgtttaaccactgaagtcatcagtgtgattccagaagaaattaaggggacccccttctccccttccctccccattcccgtctctttcactgcctcatctctgagccccggctaaggattttttccacatcctccctcaaccggatcatcagggtttggttttaaattacctttgttttttttttgtttttttttttgttttgtttttaatttctatttttctggttaactcanaaaccttaaaaatttcttcatttgccactgtcttctctggacactctgctcccttnccctgggctggcaactctatgagcacccacactcctccacgatcatgttctgaatgtcctttttgatgatgttttgaccatcatcatagtacaacatggacttggtcttagcttggtggcacacaacacgatttgaggtttgcaaagggcttttggccccacatgcggtattggtttttaactgttaattgaaaggacattagaacccggccttcttctttttggttcggcactcacccttccatagtttgcatgttacccaaaagga

SEQ ID NO: 518665 - DNA, 1172 bp, Homo sapiens
ggacgaaaccgacggtcttgctttccggtcgccgctgtcgggaatgggctgcagtgctgtctgtgagacccgaggcccggcgagctgaccccggctcgcctttcctgcctagccctcattccacggagcgcggtcgcgcccggtccttgcgcgactgcttcccggcccatggcctgcctggtctggcgctggaggccggagtcccgcggcctgtgctggatccgcagcacacccagtggcggctggatgggctggcctggtggctggcggggcgtgcggtcctagagcgcggcccgggctagtcagggctggctgctaggcggagatggacaaacctggaggaggtgactgggaccaaatgggagcaacagcgcataccacacacaaccccatggcaaccgaagaaattagtaagatgccatcgatacagacaagccatgactgcgtagctactcacgaccgaaaaatatggacgacacgtccaagaggatgcacgagaaacatgggagaccatcatatagacctggaatacaatacgcacacaaaggtagctcagttacaccgtacagtaccatgtgcatgtacgatacattgagagagagagaagtatcccaatgcattggacatacagtggagaccagaactaacgaaatacccgaacgaaattccaccccatacacaatgcacaacacgagcgagaagacaaataacaacgacgatatgcataaccaaatgcacatgtgatggttgaaacggacagacgacatggagacagaccaaagaggagatacgaggaacacgaactactgaacccccgggagacgcaaccacgagatcgaagaataactacaccaaactggaaagccggcggcgcaggcaccagcactacaagccccatgcaccaaaaaaaaaacaaggacgcaatgcgacaatgaacagcagaggacaacagaggagcagaaaggcaagtaaagaacacgaacatcgaccacataagaccagagggagagagaagcgaacatagcacaccacacgagccgacaaaacgagagctacacctagtggagaagcagagatcgaaaagaaccagtaagtggacaagagcgaacggcagcgggcacggcagcgataagcagaataacaccataagggaggacgacaaccacaacgag

SEQ ID NO: 518666 - DNA, 275 bp, Homo sapiens
ccggcggagttcagcgagctgagattgtgctactgcactccagcctgggtgacagcctgggtgacagtgcgagactctgtactaaaaaaaaaaagaaagaagccatgtccatgctgactgaggaaaattacgggcaaggtccaggtgcacatggggaaggtgaggaaggttggtattaggtatttcggtcctatgggtaatattggtaatcatgtatatcttaatatctgcgtaaacttatctttaaatttattaatccaaagccctatagatag

SEQ ID NO: 518667 - DNA, 350 bp, Homo sapiens
gttatgtgttattctacagagtagtgtgctgtgtgcatctcaaagaccgatgacgttatagatcagtctgaacgacgcaatattcatataatttccattccattacatgcctgttgttgaaagattctccaacaatacacagagtctaacacaaaactgcagaatggatgtgctcctcagtaactgtcaccataagagaaccgagatcatatctcatcaatatcccagagactccatggatggctgcagcatggttaatgatacgttccctttctgtcacagaaaactgatgggtgtctgctgctactttatatgtatgtagttgtgtaggcacaactgtaatacaatat

SEQ ID NO: 518668 - DNA, 344 bp, Homo sapiens
ggcacgagcaaggctcgaactgccttggcgtggactcctcagcccccaaggcctgtgccagctggttgatctattgcccagacttcccagtgaccacgctgtgctcggcccgctccattccagactgtccatcgggcttgatcggctggcacacacacacagcctgggtaacgactctgcccactcccaagacgaattcctagcaatgaacaatccccctctagcaacagtccaagtcccagcatagggcatgaatttgctttgggagtgactgaccctgtccccaagggtatttctgaccccagtgcgtgccaagggcagggaggtggtgcctgctgccggcc

SEQ ID NO: 518669 - DNA, 165 bp, Homo sapiens
ctcctcttgttctttcctcttcttcctttcttctcttcttcttctttccttctgctcttctttcttcttccttcttattcttctttcttttctttcttcttccatcttctatcttctttttcttcttctttccccttctgtcagtattctcccagccgtatagta

SEQ ID NO: 518670 - DNA, 337 bp, Homo sapiens
ggtcagcattcagcagcggttcaacccgtgcgctgacagacagccctggtaacccagcagcaccaatagctctggcctgtaaaaatcagactcggaaccgatgtgtgcttttgggaattttaagttgcctggatttcagagactttaagtcagttggttttgattagctgcttggtatgcaataacttgggtggaggccaaacgggtgatcaaagggcttaaaagggaaaatgaatgcttttcattctaaaatccttactcctggtacaatcaaggcagttgccttggttggtttggaagaagttctaaccccgcggctggctgggaaatggctgga

SEQ ID NO: 518671 - DNA, 350 bp, Homo sapiens
ctgtggagcatgcgttactcatgtaaaacaaatctggacagttaaccaatagccaagtgggggaaaatatctgtaaaatcagcactctgtagacagacgtatgcagtacggtaaagcacacagacttgaagtacaaacatctgtgagttcaaatcctgactgctatttactggctgtgtgatcttgggtcatttattgaaacctctctgagccagtttcctcatttgaaaactgtggataataatgtctgtcacctcataggtctgttacagagattaagaagaagatatatatgcagagcacgtagcacagagcctgaaactcagcctcaacaagtcatattcacaccc

SEQ ID NO: 518672 - DNA, 733 bp, Homo sapiens
  misc_feature (672)..(672): n is a, c, g, or t
ctacccaatgtgcttggccgtgtcagatctgtgtagaggacatgtgtgtatttttacctcttcgcttttgctcacacatgagtgggtatttttcttgttcgtttgtttcgttcgttgcgtgtcttttgagagcgcgtctcaccctgtcgcccaggctggggtgcacactggtgcgtcctctgctcactacaggctcccgcttcccacggttgagacgtgagttctcttgcctcgagtcactcccgagatagcttggcattacaggtgccctaccaccgggcccagctaatgttgtaatttttacgtagagacagggttccaccattgttggcctaggctggtcttcaactcctgaccctcaagttgatctgcctcaccttggactccctaagtgctggtattataggcgtgatccaccatgctcaggctctattcaaggtatttcgttaagcaactttaagtttagaggtaagagagaatgaaaatgatcctgaacaactgcaagcaactccacatggcagattcggcaggacactggttaaagaatttatttcttcgtatagtatcactatgttcatggtgcagatactacatacattgtggcactgttagactcgttgagtttctcggggcactccccaatgcgcgtcgggggtcatacaagggactatnactctaccagaattggtgaacttttcttttattcttccccgttcgggcggacttgcactcg

SEQ ID NO: 518673 - DNA, 902 bp, Homo sapiens
agtttcttcaccatggggatgtggtccattggctgcagggagccctgggggctgctgccttggattgctggttgccaacacagacgtgtttctgtccaagccccagaaagcggccctggagtacctggaggatatagagcctgaaaacactggagaagagaatgcaaggactatcaaagcaaaggagctatggaaaaaaaatggagctgtgattatggccagtgtcggaggtcgaggctggtttccgtcgtgtctgagaggaagctgcggatctgtcctcccttgtaaaagcatgttggtaccagcatggtgcagtcctcccatctatgcagatggtaggggagcacatcaggactgaagtgatggatttccagctcttatttcgagacggagtaaatcttcctggtagtgaaaagaaagacacgttctatggtccacaaagcgcggaatgatgatgtttatggcgcattctatccgctcttgggcaagtgtggtacacacgttcttccgagcctggaacggagagcttctctggaaacctggaaggagaaggcttcgatccttgggggagttttcgtggtagggatcaggagagcagggcattcttcttgagcgacgagaaaaagaattcggagacaaagtaaacctactttcatgtctctggaaggtgctaggatgatcaaatcacagacttgggactcagagaacagatgattgtggtgaaactggccaggtcaggataacagggacattcacctggtgttcatgggatgtattggttccactcgtgtccctaaggggtgagaaccattataatctagtcgcagatggtattagtgttaaatctggtcgccactaaggaaatacccaaaaagatgcactgaaatatgggtattaggtaa

SEQ ID NO: 518674 - DNA, 195 bp, Homo sapiens
cagggtttggaaacaaaggtcacattaccagggaccggaggctaggacttgaagataccctttgggaggagacacctgcaacgtttggattggagaagactcagtgaccttctgggatgtcgtttaccctccctgggctgcagcttccttgtttgtagaggaagaggttaaattaaacaatctcttccaggtcaa

SEQ ID NO: 518675 - DNA, 217 bp, Homo sapiens
  misc_feature (48)..(48): n is a, c, g, or t
  misc_feature (118)..(118): n is a, c, g, or t
  misc_feature (181)..(181): n is a, c, g, or t
caggactgggtctgacctggtgggagcacctgcccagaggatgctctntcccaggacggatgggtccctgtgtcctcaggagtggggttgggggacagccttcagcagcagtctcacnccctacctttccccagaacttgcactggggtgggatttggagtgatgggaaggtttttagggnccggggatggatgcttttctaaatgttattacttgt

SEQ ID NO: 518676 - DNA, 360 bp, Homo sapiens
  misc_feature (2)..(2): n is a, c, g, or t
  misc_feature (34)..(34): n is a, c, g, or t
  misc_feature (48)..(48): n is a, c, g, or t
  misc_feature (58)..(58): n is a, c, g, or t
  misc_feature (70)..(70): n is a, c, g, or t
  misc_feature (80)..(81): n is a, c, g, or t
  misc_feature (100)..(100): n is a, c, g, or t
  misc_feature (122)..(122): n is a, c, g, or t
  misc_feature (142)..(142): n is a, c, g, or t
  misc_feature (153)..(153): n is a, c, g, or t
  misc_feature (186)..(186): n is a, c, g, or t
  misc_feature (217)..(219): n is a, c, g, or t
  misc_feature (265)..(265): n is a, c, g, or t
  misc_feature (327)..(327): n is a, c, g, or t
cngacattcagactgagcgtgcctaccaaaagcngccgaccatctttnaaaacaagangagggtcctgcngggagaaacnngcaaggagaagctcccgcngtactacaagaacatcggtctnggcttcacgacacccacggnggctattgacnggcacctacattgacaagaaatgcccttcactngtaatgtgtccattcgacggcggatcctctnnngcgtggtgaccaagatgaagatgcagaggaccattgtcatccgcgngactatctgcactacatccgaagtacaaccgcttcgagaagcgccacaagacatgtctgtanacctgtccccttgcttccgggcgtcagatccgt

SEQ ID NO: 518677 - DNA, 721 bp, Homo sapiens
tggaaaaagtctgggaggccagggggtgggcttgaaaccagcttgggggggttcgatcccttcctttttggtctagattttatgtatacgggttcttcgaatgtgtggtaggggggggggcttccatttagttcacctccagggttaagtggaggggttctctcatacttattataggaaactttctgcgctctcggaaagccgaagggctttcctcaagatctcagttgaaaatttatttaaatatttacgtggcgtgttagagaaaatgtgaatgtgagcccttacgagattagatgaggagttgttccagtggtggggtgtagtgcatgcggcggatagctcgcgagttaagcgtgcggggcttcccgggatgaggccgagaaaagttgttggtgggacagaaaagtttagattttagccccgattgacattattgaatagctgacacagtgggatttgggggcgataaggattggggctcataaggggtgtacgccgtggagaattagggggcaaactccggtgaatgtgagagcctcccttaatgatggcgcaatatacgagcttcctttatggatgaggactatagtggcgaatggtgagtctacaagcgttattaacgtggtccgtggtagtcacagatggctctagagtggactgacgtttgtgcttatataccaatgtgcgcatgtcgaggcgccacctctagcgcgtgcaa

SEQ ID NO: 518678 - DNA, 150 bp, Homo sapiens
attccaaaccagcccccggagaacacatttgactagaatcagagtagaggacatggctgtcgttctagaaaagccagcgatatgaagaatgacaatcccatttcgtctccttcctccgctgcttccaccattacgcaggcctccgtgcct

SEQ ID NO: 518679 - DNA, 359 bp, Homo sapiens
ggggggggtgtatgtctggactcccagaaccctctgttcccactgacccactccagagctgcaacgggcttgcttggtccaggccagcgggagcagggaatgatcgaatgatcgttctaacaaacaggaggaagcacccacccacctcagccagtcctccctccttccctccaaaggggccccggctcaccttctggccctcccatcttgtctataactttaattgccacttttcttaggtgttttttggaaaatgcttctttgacttttgagtaggtccctttccccaatggtcttgcccagctggtacccattggagagcagaaagtcctccatgctgtctagcgccgccttcctat

SEQ ID NO: 518680 - DNA, 281 bp, Homo sapiens
ccgaatgggtctgctgtctgcggcaggtagtcgaagagggtggaggtttcgtcgaagaacaacggcaggtagtactcgataccggcaggtgtaatcccgctgctcaagtcctggaagatcgggcagcgacggaagtcgacatcgaagcgttcacgaacagcgcgccttagaagcgtgttaccgcgttctttttgcaagcgggaattcccagcgccggcagcagcttgatcagagtcgaccttgtcgatggacacgctggttctccgcgatcgaagtgtgcg

SEQ ID NO: 518681 - DNA, 799 bp, Homo sapiens
ccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacttacacttggtcagagcaagcacaccaaattggccttaactttataaaaggcgggagcaattgggcaaacttttcactcaagggggatgctgtggaaacctgtggcttatgcttctaaagccaccagcaattggtgcctaagcgaaatatttttttcagggaaaataaaaactttagttacagagatttgttatgcttaaggtagatgaaatttagcagggatgctgccttgggtctcgggttaataaaagcttttagggcatatgtttggtaagcaacaaattttgttggtataaaggtcccgggtctctcgcaatactggctgctgatcctagactgagcatggcatttctggatcaaccagatgattaacggtttattacaaaagac

SEQ ID NO: 518682 - DNA, 1015 bp, Homo sapiens
gggagttgatggagctgttgggtggggctcccagggtcgttgcctcccaactagacccatcccctgctggagcattgctgggaccccagtggacctggcccatacttgatggagctgtgtgtgtggcggctcccatgggtggcatgactctggatactaaggacagatgcacgccgtggctgcggcgatatctgtaggggtcgtccgaattactgcattatatgcctagagatatctctggcgcacatgttccatgcatgttgtgtgagaatccgtagtagagagcactctcacgcgtcatcatcagttggcctgttagaaatcactcctactaacgaggtgcatctcgtgttgccatcggcaagcaattgattgggtcgctcgtagctagaagccgcgcgcatggccctagatgagagcatggcgctacacttctaccctgttgggggcttaacgtagttgcgtgccgctggggggtctcgaaactgtgcgcacttggacaccgtcaccaagttcgaaggtgaggctcacgagatgctagctcccattagcgaggtagcgtggaaccccaagatagttatcgcctaaaatggcctgagcgtttgttggctagagagagagggtgccatttatcccccccattagcattaggtagttcacacttgaacaatttgtccgagaggctgtgtgatggcacaatggcctaggaccatcttaacagctaggcgcccggtcaaacggcagttgatccggagttgcagacggcgtatcaagtcaggtgccgagggtagggaaacccaggcccggctcaccgtgttgcagcgttgtcgtgtgcagtgggcggccacgttcgtcagcggggggcacccaggtcgacaaggaatgccgcgagtgctttggcccacgccctgggaagagggaggcgatggcactcacggggatggggctaaccaacggagggggccgaacaggggtctcttgggggagcaggagcgacctgtgaaacactggcacc

SEQ ID NO: 518683 - DNA, 1743 bp, Homo sapiens
  misc_feature (532)..(532): n is a, c, g, or t
  misc_feature (605)..(605): n is a, c, g, or t
  misc_feature (614)..(614): n is a, c, g, or t
  misc_feature (637)..(637): n is a, c, g, or t
  misc_feature (921)..(921): n is a, c, g, or t
  misc_feature (932)..(932): n is a, c, g, or t
  misc_feature (934)..(934): n is a, c, g, or t
  misc_feature (1549)..(1549): n is a, c, g, or t
  misc_feature (1587)..(1587): n is a, c, g, or t
  misc_feature (1689)..(1689): n is a, c, g, or t
  misc_feature (1709)..(1709): n is a, c, g, or t
  misc_feature (1737)..(1737): n is a, c, g, or t
ccccgggctggggccggttcggcctcccgggtggcgcgcgggccgaagaactaggaggaccgccgggccgggccgcttgtcctttggaaaaaccttggcggttcctcctctggtgtccgtggaccccgccgtggcgttctccagggccgcggacctttgcccaccggtcgcgccagctgtcctggagcagaaaggacccccctcctcccggaccgagccccgagccccgagccccatggagcaggcaagcgccggagtcccgaggctaaggcccggccggcgggcgctctggcaccttttcccgcccccgagggtgcctgtccggcccggccgggactggctgggaaaccgaggccggaagaggtcgcagtccagcaaggaatcggggcagctcttccgtggttccttgcagaccccaggtcaggccagaaaacacctctatggcccttccctgtgtccaccacagataggacctcaaaggcctggggtccccaggatggccctcaaaccgactggtgcccttgcaggctgncacctccaagtcctgcttctctctagagatgggcaggagcaccagccctcacctggcaccagcactttactgntggaacatnatatggtctaagaagagattttnccagcaagaggccatctctgcaaatcacctgtgaggcagacctgtggcaattttatgactcagctggcaccgggattgtagctgggttctgccgcttgttgaaacctatcagtgttctccttccctaagtaggacaagaccgtatcctgcctttaaggttaatagaattaacaactgataaactctttggggaagaaaatcttcctgaacagatagcccagggcatctcgacaatcccttaggaagttctctgtttcacttgggtacctttgtccttggacttnggtgatgtggntngaccccagctagagagtgaggggaacaacagcaaaaggcaggacaaagactgactcgtgagaggaggcccaggaacaggggggcatcgtgaatgaggaggacgtgggggcccaagaaagtgagctcttgcgcactcagtcaccagcccccttctggggtccaagctgtgtccccttctctaaagaggtaagccctgagtcatgggaagatggaaaccggggctgatgagacaggatgttttttaagcaccgtggtgtcttgttgacttgcacatgcacgggggtcttgggtaaccacagggctcagggtatttgcaggaacagttcaagtgctcacttgtcttggggctgtttatggggaagtggtttccacagtgagaggacgtgagatattgttgtcaccccggaccacacttagctacttccttctcactaaagctctgtagtcatattttccctggcagagcagaaacttctatgttatcccacagctgttctaacggtgtagacttgacttatgcaatgatgccaggagtcctgagcagcacagcccaacttcaatcacacacagatggacagagctgtattagcaaagcctgagctactgagcgatganagttcagccaggctttcagacatctggtcattcaaganagatatgcgctaaccaaggacctaaagatgtgttaatatgggtgctatatcataaggaccttgaaataaatgttcttagcctttggccaaaaggtccatgtntaggaatctatttttccatngaaattaattcaaatttgggaaaaatgnccatgc

SEQ ID NO: 518684 - DNA, 145 bp, Homo sapiens
tcatcagctcggtaccattcagtagggtgtgtattctgcactccactctaacatgtgcatgtgttaatgttgtggttcctggctggttggccaagaattgaactggcgaaattaacggtattaattgtgggcctccggtctccat

SEQ ID NO: 518685 - DNA, 151 bp, Homo sapiens
  misc_feature (83)..(83): n is a, c, g, or t
  misc_feature (125)..(125): n is a, c, g, or t
atgcagtaaccagattacccccaggccctgatgcagttagtgctggctcccgggctggtgtccttccacccccgcctggcctnacttcccatctcggcattcctgccccctcccatggagtaggnatgaacactggtctgagcactgctgt

SEQ ID NO: 518686 - DNA, 954 bp, Homo sapiens
aaaacacaaaaatcagccggacatggtgggcgggtgcctgtagtcttagctactttggaggctgaggcaggagaatcgtttcaaccctggaggcggaggttgcagtgagccaagattgtattactgtactccagcctgggtgacagagcaagactgtctcaaaaaaaaaaaaaaagaaaaaaaaaaaagtttgaccgtggaggataattgggaaagtactggtacaaaaaaacatagagaaacagaaaaaaattctgggatatccaagagacaacccctcttaagggtgggcaattttccttcttctttttttttaaaagggattgtatttttggtaaatgggttgaagaacatactggtatgtgcagttatgtctctggccttctgggttaaccttcccatatatacatttcggggttaacactggcattaaagctggtatcctttcattcgtcacccatgtcaagcttggttcgggcgtctccaggggttgtggtggggccccggggatctggatcattccagtgagggcctataaaatttcaggagcctccaatggctctgcctttcccaccatggcctcaggtgttcagcaataacccgtgggttcttagaaagtctacaggtactgacagtacaaggggggaggagaaagaggcctgcaatatggccttgaagtcccaggtcgtgccttgtgacctttcaaaatttaatttaataacccaagtcttcaacgtcggcattatgttaaatggagcactccaggggtcccattaatgacttgtttcaccaatttttgagttgccccttaaaacgacaagacataagaaaacgtagttttagaaagtccatagtcaagaggagcggggtacagaaattgacgaagcggccaactgggggggtcccagatgggagcggaaggctctgtagcactgagcaaccattagatttgag

SEQ ID NO: 518687 - DNA, 123 bp, Homo sapiens
ttcttgctatgtcactcagtccacactttctataaattagttgtatatttaaaaaaaaaaaccccccccccccccccccccccccccccctccccccccccccccccccccctccacaaattt

SEQ ID NO: 518688 - DNA, 283 bp, Homo sapiens
cgtcgcttatcttgtgtgagggaggcgaagcttcgaagatcatggagactcactggccctgtgagcgggacaccagccggtgtgctgctggcttgaaaaggagctgggagatggcctgagatgctgggcaaggatgcagaagtagctggacgagtaccaggagcttctggacatcaagctggccctggacatggagatccatgcctaccgcaagctcttggaggtgcgaggaggagaggctacgcctgtcccccagccctacctcgcagcacaacctggtgac

SEQ ID NO: 518689 - DNA, 707 bp, Homo sapiens
gttggattaataagaaagagagtatgccacatagcatatcatacctcttcagtgatgaatgacacaacctactgaataatgggatctagtagaccagcgatgctttgtatattcaaaagtgaagaagacgggagcaggtctatgaaactttgcatagcacagatacaggcgtctacgtagaattccatactatgttatatatgggagcactctgatgactgatgtgatatatacatgcgtacaagtgatgatgcaatctcgctggatatagattgtctagctatcgccggaaaggttggaggtgagaaactctctatattgtgtttttctttatatatagaaagtcgcatttcttattcttgacacatgcactctactgcagattatatcatactttctgccagtatctatctctgatatcatatatgcaccatactatagagaataaatattacagatacgccctgcatatgaaatacgcgctgactgttgatttcgcgaatgtacatgtgtttacgaatgcctgtggtgagcatatagatagtttgactgtgaggagtgacagatggctgaagcgtgtagtataatgaagctactgcgtcagacacagggactatatgagagcccttgttgatgcactgtgacatgagctgtgtattgcagcaacagattcctagctctggtgttattggctcgagagatgtcag

SEQ ID NO: 518690 - DNA, 157 bp, Homo sapiens
aaagaggaggtattgaagactgtgtgttctccaagtggaggcactgtggtctgtgatagagtgggagtcccaatcctttctccggagatgtgctagcttgtgcactctgggcaagtgtctccctctgtctcaggggtctctgtctccctctgcctct

SEQ ID NO: 518691 - DNA, 212 bp, Homo sapiens
cagtctcagacatttatggaggctgaagtgataagattgcttgaagccctagaagttcgagaccaccctgggcgatattacatagacccatctctacgatcgatgaaaactttatccaggctttatggtacatgcctgtggtccctaatactatgatgggaggatcccttcagcatggtgggttgaggctgcaatgagctataattgtgcca

SEQ ID NO: 518692 - DNA, 416 bp, Homo sapiens
gttagtataattaaaaggaaaagcttttatatttttatgcaaggtaaatgtttcctaaatgtcacaaaagtgatagaaaacatagcttttgggatctggtcctgcattagagtttctaattctgagacccaccagcttgtgtttcatcttctttatatcctgtcagaatacatacttaatcatgtgggtatgagaaagatgttgtttaacttgtaccaggtttaaaaaaagaggtttaaaaaatgtctgtgcgtatatatatatatatatatatatatacatatatatatacatatatatatatatatacatatatatatatatatacgtatatatatatatatatatatagcaacttgatgtatagtgtccttgttaccatgtatttttttcattaaaaatcctgcttttttttt

SEQ ID NO: 518693 - DNA, 1479 bp, Homo sapiens
  misc_feature (354)..(354): n is a, c, g, or t
  misc_feature (357)..(357): n is a, c, g, or t
  misc_feature (374)..(374): n is a, c, g, or t
  misc_feature (1401)..(1401): n is a, c, g, or t
gaaccaacgtttgcggaatcatgtagcacgatatatcccgtatacgagcgctggagattagatagaacctaggaggcgtactcagaatagataagctgccgttgaggcgcagagatgttgaatcactttctcacatctcacatgcatgaacgatgagtcccaggaacatgaaggccctcatatggttcgtgcaatgaagtgatcattcaacctagacacactcacactgtctgtcacagggaggcagcccacacagactacagatgccccactaacattcatgacccgagctagtctagagagacactcaggctataagaggacagcacgaaaccctggtgctcactggtatgncanagatactaccgcatggngaagggacttctcagtatgcgatatgacggtggtaccaagagacctatcggcgagggcgcgtcgagataggagtaaagtgcgtagtggtgtcgtgccgcgagaggtcagtacaaggagagttctctaaggtatggcgataacttttttccacaaagtgtctcgcacccaaaggagcaaacacccctttcgtacagtttgcgcgcactttggttaaaaattgtattaaacctagttctcacgatccaataggcaaggccacacaacgtcgggtcattttgggtggcacgacacctaagtggcacacaccacaacgcagtttgtgtccagccagacacgacacgtgtcacaccagtcacaagtttttaaaaaccacagctgctaactcaaggagtcaatgtgcccattgcacaataggcggggggacgctatacccaaaggtgtccacagcagaaaatggcgggttttcccaagaggttcttccccattaccttacccacaaaacttacacgtcgttgcccaccataacagagctccccgcgaggaggaaccattttatgttgaagccgtaggaacattgttgcgcttttccacacaggaggccccaaccaaatataggtggtggcgcccataagtgccttcaatttctaggccgcctttcagttgaggcgaccaagacacaagcgggttcacacctgggtgtacaagggtcatgttgaaccgcgattgaaaaacttatatgggaaattccaacacccgatatcttttcttgcaccggtctcggaacacacttaaaacggtcggcgatgtgtgtcctccaaggagttcttcaaaggagacccaacgtgggaaaccctaggcaccccatggtgttgaacacctagtggccgcgcaaatgagtgcttatggcaaatttcccacattccaagagcaaagggaagtggcagttcgaggtgtgaccctgcccttacaatcgtgggtggtggacacatgctcccatggctagcaagtgggcgacaatgggcctgncgatctaaaaagggacgacaacagggggggtaccacaagcaaaccaacaggttaggatacacgccggacaaagggcga

SEQ ID NO: 518694 - DNA, 132 bp, Homo sapiens
gtcagtatcttacgaggttccccacttgatgccccctgatcttgaattgtggcagcgtgatcagcaaacacagtgtgatgagacgggattgagtgtgggcagctgctgagtgtggaccacactctgtcgtcc

SEQ ID NO: 518695 - DNA, 90 bp, Homo sapiens
ccaccacaccacccctcccccccctcacccccccccccacccccacccatcccactcccaaaccttacggctaggtacgaggcctgggtt

SEQ ID NO: 518696 - DNA, 86 bp, Homo sapiens
ggcttggaaaatgtatgttctttattatagcagattaaaagcttaaaaaatagatggttgtactaactcccttctgtcgtcttctc

SEQ ID NO: 518697 - DNA, 377 bp, Homo sapiens
cgggagtgtagaggacgctcgatcttataagtacggcgacatgttacaaagatcggagaaggaaattatgacaacaataccatctacaatagcatcaagaacaataaaatacttaggaattaaccaaggacgtgagagacttatacaataaaaactataaaacattgctgagagaaaagaaattaaagaaaatataaatggaaacacatcccatgttcatggattggaagacttaatattgttgtactaagattcatgcatgttatgtgtatcaatagttcatccctttttattgctaagtattaccccattgattggatataccacaattttttaatccgttcatcttgttgatggacatttaggttgttttttag

SEQ ID NO: 518698 - DNA, 130 bp, Homo sapiens
tccaaatgggagaattaccttcattcctaaaaagacaatatgtccaatagaagctgtgaaggtatcagagtacacaaggtgtccagtttcagtaccaaagccttctcttttagtgcacgtgagactcaca

SEQ ID NO: 518699 - DNA, 1134 bp, Homo sapiens
tcacggggtgtggagtaggatcaatgaaggagattataccccctttgtcggtggaagacggaggagattcgtgaccgtctgtgtcgaaaccccatcttcgagtgtttttccgcggttagtgtataggaccccctctgtttgttggaatggtgacgtttcccaggctggggcccaacagattgttgccgacggaattgatatgggcgagatgaggtgataaaaaccactgggggggagatggtttgccagtgtgggaacagaaagttagtggtgtgttgagactgtgttggttggtaaggaaattagatcgagaggtcgttgtggtagatgatcgaagtgtggtgtgtgcacagtggtgactggagttttctcacggaagagtgcgcatgggttgtgccgatctgatagggacgaccccgtcttttttgtgcgttgaacaaaattagagcccattgtgcgaatgaccatctattagtgggcaacaaccaggtaatggtgggctaataggtgggcctcaccaccacttggttgttgtaaataaatgtcttgtgcggttttgacatgtatatgtaaagacgtgtgtggtcacacaatgctttttagtgtcgaatcctgccactatatatgccacgtggtgtggccttgtgtttgagaatgtgagaaattgttgtgccgcacttcgaatggcacattgagacaataaaggacaaagttatctcttaatctcctgaggcccacgtataaaccttagtttgttgcacatatattttctgtacaatatttgtcacggtccccacgagtgccacgagaacactgggaagttaagggagaaaatgtgtgatgtttgtgttttgaaattagctcgtcacgaattatcactacacccatgtagccacacaactttttttagaaagagcatttcacttgtgagctgcacaaaattctgagatatttatatttcttgtttttttctttatatgttttgcacgtttaaatatgttgaggccacctggaaaatttgttacacgagttaagtttgttatatggaggtttataaatgtgttgtcattgtctccacttgtctttgtccagagcctattattatggaaaccataaaatttattgtgtccacca

SEQ ID NO: 518700 - DNA, 162 bp, Homo sapiens
  misc_feature (125)..(125): n is a, c, g, or t
cactggcataccctgtatgaaatttcttaaaacggttatattaatgctacatttatggttttcaaaaatatttataagttgaacatctggctgagcatggtggtgcatgcctgttaatgccaacnactttgtagaggccaaggcacggaggatccctatgag

SEQ ID NO: 518701 - DNA, 247 bp, Homo sapiens
gggggggggggggggcccccccccctttcccccaaaaaagggggtttttttgggggggggggtttgggtcccgaaaaaaacccccccctgggtgggggggttccctccccccggggggcccttttttgggggttttttcccaaaaaaaagggggagtgtgcggggccctttttttttaaaaccccccggggggggcccccggccctttttttggggccctttttttttttttttttccccgtttgga

SEQ ID NO: 518702 - DNA, 635 bp, Homo sapiens
  misc_feature (79)..(79): n is a, c, g, or t
  misc_feature (256)..(256): n is a, c, g, or t
  misc_feature (273)..(273): n is a, c, g, or t
  misc_feature (300)..(300): n is a, c, g, or t
  misc_feature (318)..(318): n is a, c, g, or t
  misc_feature (363)..(363): n is a, c, g, or t
  misc_feature (394)..(394): n is a, c, g, or t
  misc_feature (431)..(432): n is a, c, g, or t
  misc_feature (436)..(436): n is a, c, g, or t
  misc_feature (448)..(448): n is a, c, g, or t
  misc_feature (461)..(461): n is a, c, g, or t
  misc_feature (464)..(464): n is a, c, g, or t
  misc_feature (488)..(488): n is a, c, g, or t
  misc_feature (492)..(492): n is a, c, g, or t
  misc_feature (497)..(497): n is a, c, g, or t
gtcctgcaatttaggactgcagatttctgcctgaaatacctgtttcttggggacattccgtcctgatgatttttatttngtgggtttaattttggggggaatgacatgttgggtcttttatacatgaaaattgtgttggacaataatctcacaaaacatattttacatctgaacaaaatgccttttgtttaccgtagcgtatacattggttcgggattggtgtgtcgtgggaattcgttttagccaggtcagtatngatgaggctgatcattnggctctttttttccttccagaagagtngcatcaacaaagttaatngtatttatgtatgtaaatagattttaagcttcattataaaatatngttaatgcctataactttttttcaatttttngtgtgtgttctaaggactttttcttaggtttgtaaannctgnagggaaaaaaangttctttctactngtntattttagactttaaaatgagctncttnttatncactttgtgtaaacagtaatagcatggtccaatttttttaagtcactttttgtcctaggggaaatgatgtggaaaaaagaaaagactgggtaatgggtaatcggtgttaacttcatggaaaattacttcaattgatgc

SEQ ID NO: 518703 - DNA, 678 bp, Homo sapiens
  misc_feature (79)..(79): n is a, c, g, or t
  misc_feature (256)..(256): n is a, c, g, or t
  misc_feature (273)..(273): n is a, c, g, or t
  misc_feature (300)..(300): n is a, c, g, or t
  misc_feature (318)..(318): n is a, c, g, or t
  misc_feature (363)..(363): n is a, c, g, or t
  misc_feature (394)..(394): n is a, c, g, or t
  misc_feature (431)..(432): n is a, c, g, or t
  misc_feature (436)..(436): n is a, c, g, or t
  misc_feature (448)..(448): n is a, c, g, or t
  misc_feature (461)..(461): n is a, c, g, or t
  misc_feature (464)..(464): n is a, c, g, or t
  misc_feature (488)..(488): n is a, c, g, or t
  misc_feature (492)..(492): n is a, c, g, or t
  misc_feature (497)..(497): n is a, c, g, or t
gtcctgcaatttaggactgcagatttctgcctgaaatacctgtttcttggggacattccgtcctgatgatttttatttngtgggtttaattttggggggaatgacatgttgggtcttttatacatgaaaattgtgttggacaataatctcacaaaacatattttacatctgaacaaaatgccttttgtttaccgtagcgtatacattggttcgggattggtgtgtcgtgggaattcgttttagccaggtcagtatngatgaggctgatcattnggctctttttttccttccagaagagtngcatcaacaaagttaatngtatttatgtatgtaaatagattttaagcttcattataaaatatngttaatgcctataactttttttcaatttttngtgtgtgttctaaggactttttcttaggtttgtaaannctgnagggaaaaaaangttctttctactngtntattttagactttaaaatgagctncttnttatncactttgtgtaaacagtaatagcatggtccaatttttttataagttccactttcttcttgttcttagtggggaaatagaaatgtcgcaaataaagagaaaaagaaaatgttgcgttatttgttgtgtattcttggcatgtatcccaaatctaatggaaaaaacataaaactttcaaatgtg

SEQ ID NO: 518704 - DNA, 133 bp, Homo sapiens
  misc_feature (2)..(2): n is a, c, g, or t
cnagaggatccctgacagcacagaggaggggctggcggatatggtggtgttcgctcctcttgcatgtacacctcctctgtgcagtccagctgtccacctcctctgtgctgtccacctcctctgtgctagtcca

SEQ ID NO: 518705 - DNA, 172 bp, Homo sapiens
gggatattgctgcatattgtgcagggaaaagtgagcaggaagaatggcctgcaggcaacaggtcaaagaagaagaacgaaccagaagattaggaggaggaggaggaagaagaagatgaagattaggaggaagaggatgaagatgaagaataaatgggtatcctttaatgatg

SEQ ID NO: 518706 - DNA, 227 bp, Homo sapiens
  misc_feature (134)..(134): n is a, c, g, or t
agcccagcctagtcagggcacagctgccctgctgccacagcaaggaaatgtcctgcatggggcagaggcttccgtgtcctctcccgcaaccccctgcaagaagcgccgactccctgagtctggacctccatccntgttttggtcccctcttttggtcgtgatccccccacccaattgggaagccctaggtgtttcatatgggccaaggccccccttccccttccaag

SEQ ID NO: 518707 - DNA, 724 bp, Homo sapiens
  misc_feature (93)..(93): n is a, c, g, or t
  misc_feature (435)..(435): n is a, c, g, or t
tttcataggcttggtttataagacccgcacctgacttaggtaccatgtattgtgcatatataaatacgctatatgtgcgatatactccgcgcnttaataaccaaagaatattatgtagaagtagggccaacccattccggcttggttctccatatttaaggagggcatgaggcgtcattcaaatacattgaagaagtgtagggggtgggggttctagcttatagggtagtctcaaatatttcgtggtagccaatgagttaagttagtctgaagacctggattttatcatgcagatgacacatcaaggtagcaagttcagagagaatagcttgtaaatgttaatgcaacataggtataatgaagcatgtcccacctcccacttgccatcatggcctgaaccctggaggaagaggaagtccattcagatagtgtggngggccttcgagtgttcattttcatttgcgttcttccccttctggccgagattggccaaaggcaccatcaaaatccagcatattttaattttgtcccacagcgttgctagggtggcatggctccccatctcgggtccatcctatacttccgtggcactccctatggctgaagcccttatgagtcaaaggacttatagccaattgattgttctaggccaggtaaaactggatatggacatgcatttatagcctcttaaaattattattttaagtaaaagccaataagcaaa

SEQ ID NO: 518708 - DNA, 984 bp, Homo sapiens
taatgcaggctgtacgcccggaattttgggatcggactggtgtgctggtctgcagtgattgacctgcgcaatgcatgatgtgctgcagtgtagtgctgggccacctgagtgggtcctggcctgattcctggctggatgcctgcagtgcctgctgccttgcctgagcggtgccccgcaggcctcggccgctggacgtggtggtggtgcacgtggcgtgctgcacggccatctgccagggctggtgccgcaggggattcaaggacaccacccccctgacgagcttctctcggcagatcatgaccgtggttctcaatgtgactgtgaatctgaatgccggaacagctgggggacatctgtgtcggaaatgttgcttgcagccttggtggcctgtgggcaatcattggcaccggaatctggcccaggtttcgtgaggttgagcatccctggaagactgttgcctatttgtcacacattgttcaagtagacaaggtgttactgaacggggggctaacatggcagttgacacatacaataggcaggtggatggaagtcccattgtacccatggcttgacaagcagggaaacccattggaagactattagcttcgcggcctttattgcgagcaagcgagaatggtcccacaacaattgcctgaattccctaatgggcgataaagcctctgacgaactgtgcacatagagaccggataaatgcacagattatccaagccgggcgaaacgaaagagtcgatgagaaaaatagcccttattaaggccccagtgggacattatcccgcaagccagcagacaatgaggcgcggcaatagtaaaggccacaaaaaggaatcgtggagcattgtttacaaaaaagctatgacgagaatatgttgggcctggatagaaacaagccacaagagttcacatctagaatagtaaaagattggtcaacacaacagagggtaatcgattcaagcatgtggacag

SEQ ID NO: 518709 - DNA, 1478 bp, Homo sapiens
  misc_feature (321)..(321): n is a, c, g, or t
  misc_feature (569)..(569): n is a, c, g, or t
  misc_feature (571)..(571): n is a, c, g, or t
gccgactgttacagaatattctcctacctcagactgtagcgattcccgatgaacctgtcagagccttacctactgacggctcaccgatgttctagtaaacgcgcccaccaggaacgcctgcgcaagggatttcatagtcacctaacactgttgaactcactattgcttgccctgagagcagcccatgctccgaggcttgacatagatggtgacgtagagcgcgagaactgaagctgagctagcgcgttgcgttacttcatatgctcagctcactgctagcttagatagccgactgaggtcgaacgggtgttggtttcccancctagtgcgccgtattcaccgtatgaccagaggaccttgacgcgctttctcgccttggtactcggctcccagcatatccacgctcaactcacatggcttaagctgtgattcgccaaggtagggataccttggtgtccttactttcggtccgtagacactgcaccgcagacatgttttctctgagcctttgaaaaacaagtttgtattccctgacacgggctctcgagacataaaaaccacaactgtgntntcgtctctggtcccaggctcactcggtcacacgtttcccaaagcatagacggagttgacactataaccttcgtgtcgatcgtggacagaatggaccgattgtggcaaggcctgttggtactccgacacaatgtccaaggcagcgtgtctcaggagtaaccgaggcaaacggccactgccagacccattggtgtggattgccaccatcggagacgcggattcagttcgacggcgcacagaatagatgtggtgcgcattcgagctgagtaccgtgactggctttctacttgggagacaaagacgcgtgaagcgttggttgttcgaggccccatggccctttggcattgggataactaatacggactgcctttgagggggaggttgcaccccttttccaaaagccattcataaagttacacaccattggccgcacacaagtcgaagcgacattttacccgggaggccccccatcttccggaatgaactccctatgtaattgccaggcgagctgcccttgtgtgcaagaggcgcttagcccgtatttcggctgtccgtggcgcaggtgatagaggccaccccccccgcaattcccttatgtggttccagggcttcagatttggggcccccagtggggtgccttcaaggttttgcccgcccccggctgtgcacaggtgacactttttgtcccctttgtgtgcttaaccaggttgtgtctgtttccccacgtgggcccttcctgtgtcggcctgcgcagaacaatattcttttgcgtgccaccgaacgtccacggtgtgtccgtcgacaagtacccagggatagtgcgtatccgcggcatacggcccgttccccgggcccggagggtgtccccttacccccggccgcggccgtcgcattcggggccagcctct

SEQ ID NO: 518710 - DNA, 245 bp, Homo sapiens
cagatgggtatcgcaaatatgatgtaagaagagagcgtacaagtttaggggctaattttgattttaaaattaatgataaaaatatcatcaaagctggtgctgtttataactggcgagacgattgggacaataggtatagactgagatttaataaagttacacctatctacgacaaaacagatgaaagtcttattactggttacaaagctgatcttagagcacaaaccaaaggtggtatagatact

SEQ ID NO: 518711 - DNA, 426 bp, Homo sapiens
accgaaataagtgcctgagaagccatggaccctccatggtcgagctccctccaccccattatcctgccttcaccgtgctggaagcatcccttggcatctccgaaacaactgcctgggtgcaaacagtgctgcagctattttgttaacttgtgaccccagccaggtggctgcacttctccaggcctcacacttctcatctgcaagactaagacaatgacagctgatctcccgcttaggcaaacatctgtaccttaagggtcacagtcttggccaaacactccccgtgcactgatgctcttacccatgggggcaccaacatcccctcctctggttgcgcttggccaaagctccttgcactgtttggtgtttctctgttgacgggtttgtctccctaccaaaccacgacttcctggaacataaggattg

SEQ ID NO: 518712 - DNA, 236 bp, Homo sapiens
tacctgatagctcaggtgggtcagccccgaggctgtgaagagcccagggccagtagatgccacttttgctccaggaagaatcttcaagtgtgtcctttttattcaaggggctctctgttcagcgaatctctagatgtactagtcacaaatactcgcatttattaaaatgtatccatggtcccacaatccttttacatatttctctccaggagtatcacatttctgagggctctgag

SEQ ID NO: 518713 - DNA, 214 bp, Homo sapiens
  misc_feature (196)..(196): n is a, c, g, or t
ttgccctgacctgtgagaggataagtagtaaggtggtggccagagtggcaccacaatgatgacaataccatctatgagtctgaggagagcagcgaaggcagcaaaacccacaccccgctgctggattttagcttttactcaaggacagagacctttgaagatgagggagcagaaaacagtgtttcgatagccccanacacagattttactggac

SEQ ID NO: 518714 - DNA, 602 bp, Homo sapiens
cgcgtatgtccagcgtggcctccacattcccgcgaggccagcatgagcatcatcgatttctattattacaacgaaggcaagcgagttcgcgaaatcgcgggcgatgagcacgtcaagttgggcgagagtcgctcgggcttctgctggatcgcgcttagcgaacccacccccgaggaactactcgcgatccaaaggacatataatcttcatccgttggcgatcgacaacgcgatgcacccgctgtgcccgcccaagctcgaggtctacaacgatgagttgtacgtcgtcgcgcagaccgccgagctggtcggcggaccggatcagctacggcaagatggcgatcttcaccggtcacaaccaccttatcaccgtgcggcacggcaatgccggagcgctgggcaaacttcgggagcaaactcgaggcaatcgcccgacgcagttcggcaagggtgtcgactatgtgctgcacgcgatcttgcatcggttggtcgaccagtatctgcccatcttcgaaatgatcgaggacgacgtcctggcgatggagcgacgggcgctgcacgatttcctcgggccagaagaggtggcgcgaatctttgaactaa

SEQ ID NO: 518715 - DNA, 168 bp, Homo sapiens
  misc_feature (137)..(137): n is a, c, g, or t
cctgagccagcacccggacagtccaccattgtgacgtggacctccctcccgagccagcacccggacagtccaccattgtgacgtggacctcccccctgagccagtacccggacagtccaccattgtgacgtggaccnccctcccgagccagcacctggacagtccacc

SEQ ID NO: 518716 - DNA, 1247 bp, Homo sapiens
gaagggttcggaatatctccgctcttcatccctcgcgaagatctggaatgacttattctatgtgagctatgaacaccacatgtgttgtacacatccgttgcctctgcgttatggttctagagatagagagactaaatacaatttttcggaagaaccattgtaatatcaaggcacagtatgcgagcctggaatgtactgaatggtaggcgcctttattatgtaccgaattaatagtgcagcattatattgggtgacgatttaatcggcagaacgtggtaagtatgcggaatcccacttatgcctgtgtaagctgaaataatatatgactgtatatctagtcggtgcctatgaagattctagcaacttttcattcatgtaggctctacctgtcatttagttacttctggcatgcatgtccgtgccttagcaggtgcagtccgcgatgcttattccgttgattacttcctgtacgtatatgctttaacttgctgaggaccatatgagggtaggatatatgatgcttttaagaattaccaaagatttgtatagggcaaaaccattgtcttaaagtcgatggtcaaattttttaggacggtgatatcgtcatatccattgcatcaatctttgtgcacaatgccacgttaaaggaagcttggtgatattcgcgtgggacaattttccttccaggacggagaggttcccattacgggggctagggggggaacttttactaccaaggaagcaagtcagggggccagaagttcacacggcggaattggaaggggtgggcagccacggtggtcacactctcgaagcttttctgttgcaatcgcctctaccacagtagtgtgtgattcgcgccatattggagctgcgcgataaaaccggggggagatatccagagacagcgcgttcttgtgcacgaggctgcacacacgcacacacaggtatatacaaccacgtggccccagaggaacatggcgtcggaaaaaaacaccgggaggacgaggtaggcggcagcacatacgaaccacggggtctgagcaacttaggagagaggaagtatgatacagagcacctagagaaaatagccgacacgtaagtaaaacacgacggcagcagaaggaagacatcaccgtgccgaatcagtagtacgtacgcactctgtgtcgcacgcacgatagactcgctgttgtccaccacacactcagcgagagaagaagaaaaggaagaagggagaagaagaa

SEQ ID NO: 518717 - DNA, 100 bp, Homo sapiens
  misc_feature (10)..(10): n is a, c, g, or t
  misc_feature (12)..(12): n is a, c, g, or t
  misc_feature (26)..(26): n is a, c, g, or t
  misc_feature (29)..(29): n is a, c, g, or t
  misc_feature (33)..(33): n is a, c, g, or t
gtttctccantntattataatactcntcnaacnatttccagtttaaagtggttgttttaaacaattttttttccagttaaattgtttttgttggggagaa

SEQ ID NO: 518718 - DNA, 822 bp, Homo sapiens
  misc_feature (163)..(163): n is a, c, g, or t
  misc_feature (470)..(470): n is a, c, g, or t
  misc_feature (487)..(487): n is a, c, g, or t
ttggtttcattttttcggctcctaaaatccattcattcaaaagtcaatatcatctttttaaaaaatgagcctatgtgcctcccctgttaaaaacccttcacacgcttcccactgcatggaacaaaatccaaattcctcactctgcccagaaccccctgcatcncatggctcctattcatctgcccaacctcatctcatactattcttcccctcacacactacactctaatcccaaaggcatccactctgttcctcaagtccaacaaatccttaccacagccaggcctgtgcacttggcagtccctcttcctggaatgctcttctcccagtttttttttttaagcctgctccttctcatccaccagtctcagtgaaatgataccgcctcaaaaaaatattttcttttaacaacctatctaaagtggcctcacttagtatctctttcatcagtctgttgatatacttggatnttgtctatgttcccccnacaaaatataaaagctcaatgagaagcttatctgtcttcttcctcttcttcttcttctttgtttctttctttttctttctttctttttctttctttctttttctttctttcttttttcttttctttgtttgtttttgagatgcagtttcactctcatggcccaggctggagtgcactggtatgatctcagctcaccacaacctctgcctcccaggttcaagcattctcctgctgaatctcagcctcctgagtagctgggattacaagcatgtgccaccatcccggctatttgtatttttagtagagtgggggaccagaactggatcctctagatc

SEQ ID NO: 518719 - DNA, 727 bp, Homo sapiens
cgccaagatgccggcttaccactcttctctcatggatcctgataccaaactcatcggaaacatggcactgttgcctatcagaagctcaattcaaaggacctgcccccagagcagaggcaatgagctggcgatgaacgcacaactgacattgcagcagtatgaaagcttcaagattactttgcactttctgctgtgcgcagaacgcttaacagctcatagacacacgaagctatacacgctaactgctcatcagcactgcctgaaacaccaactgccacgcatatcaagaccctgggacttttgacctctctctcaccccataccgcacacgacacgaacacaccaaacaacatcgcccaaacacacatggctgtcactgacgactctgctctctgggtcacacgaccagtaattccctgggcctcttcgctccgccctagcagccctaccctaccaaccagcctcggctacaaagctattatctcaacgctcattagctcccccactaccaacccgaacagcactgcggtactcctgaaacccctcaacccatgaacccctacacctaacctcgcagctccccctcccctggccccctaatccacaatggtacaactccacccctaccccactcacactcggacactacataacccaatccccccccccccccccaacaacccccaccccccccaacacccacgtccccccccacccgcccccccac

SEQ ID NO: 518720 - DNA, 457 bp, Homo sapiens
  misc_feature (263)..(263): n is a, c, g, or t
  misc_feature (352)..(352): n is a, c, g, or t
  misc_feature (363)..(363): n is a, c, g, or t
  misc_feature (387)..(387): n is a, c, g, or t
  misc_feature (403)..(403): n is a, c, g, or t
  misc_feature (443)..(443): n is a, c, g, or t
  misc_feature (449)..(449): n is a, c, g, or t
gacggagcccgctctatcacccaggctggagtgcagtggcacaatttcggctcactgcaagctccgccccccgggttcatgctgttctcctgcctcagcctcccgagtagctgggactacaggcgcccgccactacacccagctgattttttgtatttttagtagagacggggtttcactgtgttagccaggatggtcttgatctcctgacctcgtgatctgcccgccttggcttcccaaagtgctgggattacaggcgtganatccatgcccggcccagtttcttttaataggatggaaaacttgatggaaacagttgactagtagggtcaaaacagagttttgcaagganttattacaatntggggttacggggacaatttaccngggggcattttccttnaggtttatggatggcttttaggcttaggggtaaaacaggntttaantaggattc

SEQ ID NO: 518721 - DNA, 93 bp, Homo sapiens
tcctccccagcgcacctcaatttatattgctctgaaaagagctttcccaagtatttaaaaaaaaaaccaatttttttaccccccaaaaaaaaa

SEQ ID NO: 518722 - DNA, 233 bp, Homo sapiens
accttctaactgctggccctccagcagctgagccctcgtgtgccatttcaggaagctactttgcccgagatgctgcactattcccaccactacagcaaatccgacacgcacgacccacacgatgtccctggcccgggtgctggtgtgcgatgtcgtcaggggcaatgcctcctttgtccgtccaccggccacggagggctgcgagcacgccttctatgatagctgcgtgaaca

SEQ ID NO: 518723 - DNA, 251 bp, Homo sapiens
cacggggtagtgtgaaatactccagatgcactggagacagtagtgtagagaccaaatggatctctccctctctgacatcagaatcagaatctctggtctaccacttgggttgtgacctacaagttgggggcaaagctctttagctctcataatcagcaggactgatggcggatgctgggcaggcctccctggaggccaagtgttgggctggcatgtccagcaccagataggtgcctatctcacaatatccc

SEQ ID NO: 518724 - DNA, 395 bp, Homo sapiens
atggtactggtacaaaaatagggatatagaccaatggaacagaatagagaacccagaaataaacccaaatacttacagccaactgatctttgataaagcaaacaaaaatataaaagtggggaaaggacacccttttcaacaactagtactgggatagtgggcaagccacatacaggagaatgaaactggatcctcatctctcaccttatacaaaaatcaactcaatgtggagtaaggactttaaacctaagacctgaaactagaaaaatgctgggagataacattggaaaaacccttctagacagtggctcaggcaaggattccataaccaagaaccaaagcaaatactacaaaaacgaagataaatagcggggacctaattaaactgaaatgag

SEQ ID NO: 518725 - DNA, 277 bp, Homo sapiens
  misc_feature (163)..(163): n is a, c, g, or t
  misc_feature (248)..(248): n is a, c, g, or t
ctgcactcacggtgtgtagcagtcagtgtaggcctcgcggaaggggctggcaggcccgtgagttacaggcttcccaggcgtcgagttggtcaggcctgtgtaccacagctggccggctgcgtcccgtcccatggtgcgtgtacttccacgcgtgtggcctgcnctgatggctgtgtggccagcggtgaaccctccagggcacaggtagtcatcgctgacgggtgggcatggtggcagatgactgagcnccatgtctacagctgagtgcttttgaccc

SEQ ID NO: 518726 - DNA, 953 bp, Homo sapiens
aattttattatcgccgcatattatatacccattgaggttataaaattaataactcagtgtaaatataatataaaaaccacttctgggaaaatctttgagacgaggtgacttctaattcgcttcccccgtgaattgtacaccagtcctttaaagctatttatttgttctaggaaaccactctccgtagcccatcctatctatgggagcaccatattgtcgcattcttaatatcgatattttcttattgacctcacccgttggaacttcctgtggtagtaccaacagacaatttgtctcacccaccagtggtgtgatcgttctttataaatgtataaccccgctgtgttccaaccctccccccccccgccctcttcttcaaacctttgtaaactaactaatggaaaggattataaaaaggattactacaatctatcaacgaatagtataaaaacctatcattctctcttgaacaaattattagacgtgatataatcactctacaataactattcaatcttctaaacaactatggagatgtttatttctctatctaagattaacccccaccacccccaaaatggatttcctctgtaataagaattatactcgctgacgcaccaacacccactggatgtctaccctctgtaaagggagacttaaccccacctgactttttaattaaatatgaaaactcaaatgttcctaaaacatcactaattttctcaaacataacatatcgcgcgcgtctttctgatggacccccctattacccgcctcaccgcgattttaacacatctaccgcccagtacgatactctaatccctgactcagctatatttgacagactactacccccctccttaagcggaaccgttccgagctcccccaaatttcagaaggggtgtcaacccttgcatagctatatataacaaacaaaaaaccacccatccatc

SEQ ID NO: 518727 - DNA, 364 bp, Homo sapiens
cacccagattatcgattgcaacgattcgcggcagattcgcgaatttggcgcaaatatagaccatctataaccaggtcgcgcgcgcgaatgataacaccaccaatcaagctggcatcctccgcaacttgcacgcgcacttcccggtcgactccttacttggaaaacccttgcggtttgtctagctgtacattggtacaatgcaaaagcactggtcactacaacgtctaccgatatctctagtacggccttgtacaggtcaaacagagcggcgatctccggcagaagcgggagacggtcgtattcggcaacaacgtatacccgcttatgttccgataaaactaccatccccaccgcaagccgatct

SEQ ID NO: 518728 - DNA, 427 bp, Homo sapiens
gagtgtgcactgcactcatctgatgacagagcgagatctctccagaaaaaaatgcccatgctcatacgagattctggcagtgaactgctccgtatcactggtcccccatgagctctggtctttctttgtagagtcacttatacctactggtcactgaccagggctttctaacaggaggagcaagtcgtatgggagagcctgcacaatgtggatggagacagctgcttttgtgactctgactttcacctgagtcattccctgggcaaggggcctggagcagaaggtgggagtggctccccagaaaagcagctgcaggtagaccaggtgtgtagggcacttaggaaaagtgcagagagcacatgtgcctcagagagctttttactgcatacattttaactgctagaggccatgtgaacccatgcctctc

SEQ ID NO: 518729 - DNA, 201 bp, Homo sapiens
ggtaagagcggtctgactgcacggtggccctgctgctcaggaattcccaccttccatctcaggggacctcagggaaccccaaaggctgctggagaatcagactctggtcccgtcctctccacccacctagaggctacttcacactctctccgctgtcctcacgcctctgccacctccgctccgctcactccctgcaccgat

SEQ ID NO: 518730 - DNA, 259 bp, Homo sapiens
gtcactttctacgcagtattaggattataacaatataaaaaatacatatatggaaaagaaaagaacagatgaaaacgaaacaaattaatgttccagatagaactggagtcacccgttttatttacgttatatatttatacatattcgtatatagtgatacaacacatggtaacgtgtaaaacaacagacacaagaggtaaacaatcttgtattgtcgtagacaattgaagcgttcaactttctcacacaaagatgtgag

SEQ ID NO: 518731 - DNA, 288 bp, Homo sapiens
  misc_feature (22)..(22): n is a, c, g, or t
  misc_feature (118)..(118): n is a, c, g, or t
ttgtggccaagaagttcagggntaatccttcatcttgctgggcactgggccacgggaccagcaggcatcaatatggaaggtaaagaggacccgttttcgggcgttaccgaatacggcngcattaaaacggggcattcacgcaagcggcagcaccgggcattaaacggcaccagatggcgtgccttgatcggttatattcctcgacattcaatcggatgtccgtctttatcgagaaaactgcgcagtgtcatcacgctgccgtcttccgcactctccccttccagacga

SEQ ID NO: 518732 - DNA, 668 bp, Homo sapiens
gcccttatacgaatgtggtatcctggatgcgagcggaacgcggcttaccgtacacgattcccggcgaatctggatgccgatagctttcagttagtctaaggctcttagattgttcccacgctctgcgtgggaacgcctcttgggacgctctgcgtaccgcttctaagggcggacgcagagcgtccagggctgcattcccacgcagagcgtgggaacgatcaggcccctggattctcacccaggggccttttgcattacggcaatgcttacgccgctttggcttccaactggctcaacgaacggttcagcgcactgaacagcgccttgaagctggcggtagtgatgttttcatcgatccccacaccatgcaccgggcgttcgccgttcacgcgcagttcaatataggccgccgccttggcattggtacccgcaccaatcgcgtgctcgttgtagtccatgatctccacgccaatcggcaggccggccaccaaggcttccagcgcaccgttgcctttgcctttccagtgcaggttggtttcgccctgaccccttgccggaaacttcgacctcgacaaagctgttgccgttttcttcctgcaagcgatggctgaccaacgcatacggcgtgttggcttgcaggtattccgctgcggcaggcgtagatctgt

SEQ ID NO: 518733 - DNA, 173 bp, Homo sapiens
aggcagtgctatgacacgtgaaggtgtcataccgggatcacggtctatcgcctcctccacccggtgcaactgctagcaccctcaaagtgctgaccagcacggccaccgacacccacagtcatcagctccagagccactccctcctccagtccagggactgcaaccgcccttcc

SEQ ID NO: 518734 - DNA, 230 bp, Homo sapiens
aggggaattgcaaagtcatgggaaatttaaaaatggggttttaaaaaaacttcccaatggcccccccgggctattttacccgggatttttttggggggtgattgggggtctaccatggtttccctaaatctttttccccccaaggggggaaatttgggaaatcccgggtttgaggggggctaattaggtttttttttaaaccatattaaaagccatacctttccaaccca

SEQ ID NO: 518735 - DNA, 358 bp, Homo sapiens
acagatggtcattattattacttaaagtttgaaatatcttagtgagagcggaggagaccttaaaagaaaaagaagagggaaaatcgtaacttgagaatgtagccccctgacaagcagcataatcacaaaacgagcattcagagttcaagcgttaaacacaggatcacaaaggcctcgcaccccacaccccagacacacggcgcagccttggccctgaatgtggtgctccctctgtcgcccggcctggccgccctcagccctcccccctgctaatgactcctgtccctgcctttcttcagtgtcttcgagagaactctgacgtgaagacgcacgggccttttgaggccgtgatgcgcac

SEQ ID NO: 518736 - DNA, 291 bp, Homo sapiens
atccaaagaattcggcacgagggtgacacgcagcccacggtctgtactgacgcggcctcgcttcttcctctttctcgactccatcttcggcggtagcttggaccgcccgttcaattggcaatatgcagctctttgttccgggcccaggagctctcaacacctcgcagggtaaccgccacagagaacgcgtgtgtgccagagtatacaaggtcaagtgtgagccctaatttgtgggggcaaatatccccgcgcagagatacatgtgtcgtttttcccgtgacgcgggacccc

SEQ ID NO: 518737 - DNA, 686 bp, Homo sapiens
ggctcttgttgcccaggctggtgtgcaatggcgtgatctcggacaccacaacttcacctccccggttcaagcaattctcctgcctcagcctgaagtcgtgatctgcccgcctcggctcccaaagtgcgtgggattacaggcgtcagttaccgtgcctggctctataccagtattttctagttataaaggaggactacattaactcttatggtcagttgttctgaaacgtgaacatttaaaaagcagcctgaaaaataaaaatttataattggcccttgacctcggcaaggaatggcagcatcacgggaaggaaaactactctagaaggccatttaacaagtatgtatttattagaacatgcaaattcatggtgtgtctccatcagtggtcaccttgagggattagcacattctaagtggagagtgtccgtggctccaaccctccagcagtgttctcacccaacaagtgacagtctgacgtggacgtgggacagggaagtcattctaacggagtccaaagtcagtagccgccacaatctggtttataaagtaacgagatccagtgggacaagctattttggtatgccaacctagataggattataacagcaagaagtgatttcttctgggtttatgaatggatcttaggtaattacaaaagggaaatccaagagtggataacacatg

SEQ ID NO: 518738 - DNA, 236 bp, Homo sapiens
  misc_feature (65)..(65): n is a, c, g, or t
taggtcgtctgtggccatccaccatgatcgtttcgccacgatacggtgttctcatcgtgaaccanatgccgtattgtgttctcttcacgaacacgatatagtggggcgcatcggatagtcaaactcggttatccttccgggaccaagatccatgattgtcgtgacccattcgacgtttactcgatcgaggttcagttactgcgtcaactccgcgcgtttttgcctaattggggtac

SEQ ID NO: 518739 - DNA, 399 bp, Homo sapiens
tgcagtgtgttgtcagagtgcagcctattcatttcctagtgcgtagagtggttgggagtccaggattcaaaggctcaggcgtgaactgggtagcagcatttcttacatgtagtgggttctgggagcccagagggcagccatagtgtgccgactccgtggaggaactaactaagcagacccggttcttgccgaagacgctaacagcctaaggtgtacagtgacagggcggatgcgcgctcctctgtcctcgccgttcgaagcggaccatgatcatgtgctgcttgtcaggtccagcggacctggcgtatagtgccttcggcagctggtgggcatgtgcatcccagatggagacctggactcgtgtccagcccgacacaggtacaaccccgaacacgcata

SEQ ID NO: 518740 - DNA, 170 bp, Homo sapiens
  misc_feature (64)..(64): n is a, c, g, or t
  misc_feature (67)..(67): n is a, c, g, or t
  misc_feature (76)..(76): n is a, c, g, or t
  misc_feature (124)..(124): n is a, c, g, or t
  misc_feature (159)..(159): n is a, c, g, or t
  misc_feature (168)..(168): n is a, c, g, or t
ctattagctgggctgaacaatccaacgcctctggctgaattcctttcttcacaatgataggganganccgacatcnaacgcactcaaaaagcgacgctcgcctactgaacgccttggccgctancaacgcagctctattctccttttgttgtgtcttanatcttctcntc

SEQ ID NO: 518741 - DNA, 544 bp, Homo sapiens
  misc_feature (14)..(14): n is a, c, g, or t
  misc_feature (427)..(427): n is a, c, g, or t
cgatggtcctcagncttcaagatatcagggtctcagtgacggaggatagtgtggtggggctcagaagctcatcgaggggaggctgtgtgtgatgaggggatgccttcgggatgccctcatcctcctcggggctgggtgtctccctcaaggccagccagctcctatcgttggtagggtgttgctactcctgccgccggatgcctgggcccggatgctcttctgcttggacttcgttccctcccagggcagtggtgtctccctcctagccggaccacggctctgccaggcaacgggtgtcttttcccttcagcacgtggttggcgcagaggaattcagtcaggtctacctccggggggttccggtaccagtcctcgatcagctcctcaaactcttccaccagcacatcagacggcttctggaggtcagncacctcggcagaagtctcgttccacagctcataggggatgtccatcaccaccttgaccccttggtgtaccaggtggtgtaatgtctcaaaggtctctgacatggcctatgagctgag

SEQ ID NO: 518742 - DNA, 109 bp, Homo sapiens
aggaagctaacctcaccatagagcaggatatcttttccccatgtcctcctctaacatcttacctcctgtactcctgaattctccattatcattctctgatatattctcc

SEQ ID NO: 518743 - DNA, 328 bp, Homo sapiens
ctttccaatccttggggggagaaaaaggatgtctttccggattattttaattaatttttttcataattgagccagacctgtttgttatggcccctaatgctaaataaaactgtggcccttttccccataatttaatttagtggaaaaagaagccaatgctttccctattgtgataagggaacatggggtttttttgggcccccctttagaaccctgttaggggccataccctcccttgatgaaagggcccttcgggcccctgtggtctttttaaaggcttttcctcccctgggctttttaatgggtaattaaagtggggggaaattta

SEQ ID NO: 518744 - DNA, 529 bp, Homo sapiens
gtcggtaccttactctcctcccacctccaagtgcacggattacaggtatgagccaccatgcctggcccctaccctgcctactgagaaccaaaggaaggatccaaattctccttagctcaactcgagccatttcctgattgcttcatcagcgaggagctggttattgggctgtccaggcctcccaagcagcacagaaatgagaaacaggaccttgccctgtcactcaggatggagttcagtggtcctatcatggctcattatagcctcaaactcccaggctcaagcaatcctaccatgtcagccttcccagtagttggaactacagctggatctaccatgaaagacttgtgaatccaggaagagagactgactgggcaacatgttattcaggtacaaaaagatttggactgtaacttaaaaatgatcaaattatgtttcccatgcatcaggtgcaatgggaagctcttctggagagtgagagaagcttccagttaaggtgacattgaagccaagtcctgaaagatgagga

SEQ ID NO: 518745 - DNA, 406 bp, Homo sapiens
tcaggataaaacaaagatgattcttcgcgtactggattggcggtgattaaaagagtcacggaaggcagactgatgaagaagtagagagtaagttgctctccctgcactgtgggtaggagtgcaaatcagtggagcatttctggagaggagtttggcaatatgtaggaatttttacaagttatataccctttggcccagcaatcccccttcatgaatctacctgagggagacaaccatccaaaagtgaaaatatgtgtgcccgaggatgcccactgctgacttgccgccaaaaatccagaacactaaaaacaaccccaaaatcatcactaggagacgctattgctcccaataatcaatacaatttattataatgctctgtactttattagatgtctgtaacataatg

SEQ ID NO: 518746 - DNA, 776 bp, Homo sapiens
  misc_feature (349)..(349): n is a, c, g, or t
agcgggactccaggaagaagccgcaagcagccggtgagtcgactgcacggctgtggtggcggcggcggagactgccggcccggaggtgcgcgctctgctacgtgtgcagaagacaggcgctttcgaggatgatagcggctgtatcgcatgagtcagtctcatacctccgatagtgcgtcaatagagattgatgtacaaggagtccgtcactagcaaaactacttaaggaatcaacgctgaactgtattaagaagtctataaggttggttagtaatatgacctgtaactgtaaggcatcgattcctcgctgtcgaaacataacgttgctgggctgacttgcattatcctngagacgtggtggccagtgtcaagcactttccggagacggagaccacttgacacagagctgtgtccacagaacaaacctgatacttagacatgcgaagcgactgctacacgagacaatcactttctccagctcggtactggtatgactaactcacttcatacataggtaatagagtttagatggacacaagacaaccccagtaggtgacttgaccgactctcctggagaggacgcgagtggacgacatgggagcacccaaaagtcttattcccacagggagtcgcgccccgggggcccccggcaatggttacgggaccgcaccttttaatcgcgaggggaggtcacttcttgcaagagactgtagactcaaatccacaagtgggcaatcccccggatcgcacaggaggggccatgaggcaaaagccgg

SEQ ID NO: 518747 - DNA, 866 bp, Homo sapiens
  misc_feature (541)..(541): n is a, c, g, or t
gattgcttgtcaggcgtggtgttgtagatggtgttgtcgagcgttgggagacatctgtacgtgtgcgagaaagtgatggatgttgccgagaggaagtgtagaaattgaaacttgagtattgatatatctaactactcataatcactatggtaaaggatggcttgttagggacatcccgatgacaagtgttgtgagatcagctgacatgaacaattaagtgctttgattttccatgtaagtgagtattttggatgcctgtattgtaagaggaataggtgctcgaagtccgtgagatggctgtcgaacgttctggtgcaggctagtcgcgatggcttcatcatttaatagggcagtggtcgttggtgctgtattgggaggggtatcgtgtcgcagaatgtgatggagagaacaggaggttttgaggtattagcacaaaggaacttaactgaaggctaaacatcttcgatcctactgaatagatatcttgatggcgacttttacgtaggggttatcttactggtgatatttagcgttgtgtgancatgtgaaactctaatcaaatggcgtaagatgatgggagttaccaagaaattaaaccatagtttgtaaagaattagattatggtttaaaaaccagtagaatttagtatatgttgactcattatagtcgtctcatgttaccaaacaccagtcaacgcgtcgtgaactaagtgctggtccgtatggactaaggggatgataggcctgtcataagaatttctagagaggactgaggttgggcaaaatttcgcttggaaaattatttattcagagcctgtcttgcctttgcatggtgaccattgtccaatgtgatgtccccgcccagca

SEQ ID NO: 518748 - DNA, 214 bp, Homo sapiens
agcgggctatacgggtgttctgctgcagtttagatgcagggcttatgttactaatgtggggtgtttcattgtaatcagagaattctgtctataccctttaacttctgggaatacattcaggtttccttcgtgggctaatgtaagatattagttcagggatatttaaaatgaagctatgttccccacttattagagaaaacttgatacactctta

SEQ ID NO: 518749 - DNA, 895 bp, Homo sapiens
  misc_feature (413)..(413): n is a, c, g, or t
aagctccgtattgacgatactctggggacacagggctgagtctcaagtgatgatagagatgcgaataagggtcggctaggagatgctgggcaagagtagtgtgtgaatagtcaacaatagcgaaatgtgggtgcggcattcggagacgttggagagccccatgtcctggaggaacgttctgaaagttgttggtgggtttctactgaaccacgagaagatgtagtcagaaggctggtataggatttacgaggtcgctggtagttgttaattcaccggacgatggggaactttcaaggaactacatgaacattggcactttaatcagggacaaaattcatccatgacaatgcaaacgttttaagaacaagaagtagcagaagacgagacagctgatattccagcagctacaaaanacagctaaaggaagcagaacaaatactggtaacagctgtttaccaagcgaaggagaaactcaagtcaatagaaaaagcaagaaaaggtgctatctcctctgaagaaataattaagtatgcacataggatcagtgcagtaatgctgtatgtgctccactgacctgggttccagtgggaccccggaggaacctacccaattgatatagaggatgagaaggtgggttaactgcgtcagatgaacaatccgttcaattaatggggtgaatgggcatttaccaggagattgcactttgcgcaggaagatttgcaatgtcttggtccacagtatcccatggcagtcaaatggcctggcggtgattttgtaccccaatcatatggggacttttgtgggcgctctgggttaaaggaaataggtgtgttgattttaagggcctcaccaggaggtggtgttgactcaacattaaatgttggaattgtttacg

SEQ ID NO: 518750 - DNA, 5280 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaataccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttgtcatatactctgaaagaaatttatatatcaacctgaaataattggttgaaaccctttgctcaggtactttttaaacttcgtaattatggaaatttgttttaagaaatgttcagtgctgatacatcatctttctgaaaggatgtaagttctgtctgtgatcaatgtgaagtaaaagagttacagccttttttgtaccattttatccctgaatacttacctgtattttaatctgaagtatgatcatttgtgccttctaaagcagattatttaactgattaaagagtcccttgaaattgatttttcaagcgttagaaggttagccatgtaaaggtatttatacttacctcaaaaaaggatcaataaatgtttatgaaatccatacatatgaatggtttggcttttggtaaaaaaaaaaa

SEQ ID NO: 518751 - DNA, 813 bp, Homo sapiens
  misc_feature (5)..(5): n is a, c, g, or t
  misc_feature (67)..(67): n is a, c, g, or t
  misc_feature (141)..(141): n is a, c, g, or t
  misc_feature (162)..(162): n is a, c, g, or t
  misc_feature (169)..(169): n is a, c, g, or t
  misc_feature (207)..(207): n is a, c, g, or t
  misc_feature (210)..(210): n is a, c, g, or t
  misc_feature (213)..(213): n is a, c, g, or t
  misc_feature (221)..(221): n is a, c, g, or t
  misc_feature (230)..(230): n is a, c, g, or t
  misc_feature (242)..(242): n is a, c, g, or t
  misc_feature (312)..(312): n is a, c, g, or t
  misc_feature (352)..(352): n is a, c, g, or t
  misc_feature (372)..(372): n is a, c, g, or t
  misc_feature (415)..(415): n is a, c, g, or t
  misc_feature (419)..(419): n is a, c, g, or t
  misc_feature (457)..(457): n is a, c, g, or t
  misc_feature (465)..(465): n is a, c, g, or t
  misc_feature (487)..(487): n is a, c, g, or t
  misc_feature (525)..(525): n is a, c, g, or t
  misc_feature (650)..(650): n is a, c, g, or t
  misc_feature (711)..(711): n is a, c, g, or t
  misc_feature (718)..(718): n is a, c, g, or t
  misc_feature (809)..(809): n is a, c, g, or t
aacanagcagattaggcaatttgttaggtaaattacaaatacattagaaatcatacaaaagtggccnggcagggtggctcacagctgtaatcccagcactttaggaggctgaggtgggcggatcacgaggtcaggagttgngaacagcctggccaatatggngaaaccncatctctactaaaaatacaaaaattagccaggtgtggngcnacncgcctgtngtcgcagcnacttggggggcnggggcaggggaatcgcctgaacctgggaggcggaagttgcagtgagcaagatcatgaaaagcaaaatacncaaggacttttaatataaccaccaacacagtgtgccttcnggccaagcagagtcacttcnggggttcttaaagtatgaatggggtgaaagaatgtgcattccnagcnaaatgccaaattccaaagcctttagtacaaaaacagcngactttcngccaaacaggtcgacttttaanaggggtatgggggcggggcgggggggcgtaggtttggnatcccggcgacttgggaggcggaggggcggccagggttgcgccactgcactacggccggggcgacagagcaagactctcaaaaggaggcatgaaatgcacctcaatcttttgctccaagtctgcnaaagattgtcaaaccctccctgttaaaaaaaaaaatcagtttacctactctcccttctatntaaaggnccctaaaattaaatgtcaatgccaaaatgcgaagtgcagatcgtcttctctccaaataagagttacttggaatccttaacaaatccaaggngaaa

SEQ ID NO: 518752 - DNA, 118 bp, Homo sapiens
tgcatcagtcgtcgtgtatctgaaggcatggtaaatgtagagcaacgtgatgatgaagtgcgaagaacgatggctgcctgaattaatagtagtaaatactatgggtccatgcagtttc

SEQ ID NO: 518753 - DNA, 2811 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatagtaagtcagttactttgttttatctcaggtaaaatgggctgaatgttttagctatactagtgtgctgctttaaagatcagtgagcttaaaggcatcctttgtcttcatttgcgtgccttagctttatgtatatgctcattgatctcatttctacatttcacaagtaagtac

SEQ ID NO: 518754 - DNA, 284 bp, Homo sapiens
attggatatgcggataggggttcagaaaagtaataagtagtacgcccaacgctgacctggaacaaggattccaagaaggggtcctaatgctagtgtgataatgcagttccggagaggattgtggtagcaggaaataatgaagatgttccttttcaagagcagcagatcttgagcttattcagtcaactccctttaaaacgctgggagtgaaaacaccacctcgtgtacttacacttgagtgaaagaccactatattttctggatctagaaagaactcctacaat

SEQ ID NO: 518755 - DNA, 205 bp, Homo sapiens
  misc_feature (21)..(21): n is a, c, g, or t
gtaccccctgccccccctggntgccgttgggggggaaccccaacagggccccgggagggaaccctgcccccaaccccccccagcaagggtgtacagtttcgcccttggaagattgagctggggcccccccagccatccgctttggccagcagaaccagccccaagccagcccctttggtaaataaagcagcatttgggattttta

SEQ ID NO: 518756 - DNA, 2563 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctatttcaccttttctcttttgcaaattgttttgcttctttttgtaagttggctgtcgatc

SEQ ID NO: 518757 - DNA, 504 bp, Homo sapiens
ccagatagatggaaacttcatagtggaaggaggtggtgagaaggaagtagtaaactgttaagagcatttcagcattgctgtattgttttaatattctttggctttccaaattattgcagaatgttattttttaactgaagaagctcattcagttgttccattgattctgagaagaaaagatttgttattacaaataaaattgaaatttaactgaacaggatttaccatttccttacttaaattggagtgtctattttaattcatatttcagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggtatatacaaacttatttctaacatattttttactgactgaaagaactagttttga

SEQ ID NO: 518758 - DNA, 5697 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttgtcatatactctgaaagaaatttatatatcaacctgaaataattggttgaaaccctttgctcaggtactttttaaacttcgtaattatggaaatttgttttaagaaatgttcagtgctgatacatcatctttctgaaaggatgtaagttctgtctgtgatcaatgtgaagtaaaagagttacagccttttttgtaccattttatccctgaatacttacctgtattttaatctgaagtatgatcatttgtgccttctaaagcagattatttaactgattaaagagtcccttgaaattgatttttcaagcgttagaaggttagccatgtaaaggtatttatacttacctcaaaaaaggatcaataaatgtttatgaaatccatacatatgaatggtttggcttttggtaaaaaaaaaaa

SEQ ID NO: 518759 - DNA, 359 bp, Homo sapiens
  misc_feature (310)..(310): n is a, c, g, or t
attttgggtgccgaagtgaagtggcgactatagcaaaccctgtgatctctggctgctgcctcagaagaaacaagagggagggatgaataatgtaaaactctggatcaatattctaattctgagcctctattggaatcagctagcaaccacatatcagcttggtttcaacagtttcccagttcatggtttgtggcaagctggattgagcaagtctgttggcgccattttttcaacagcatgtagtcactttgtgtcttcgtgtcacattttgctaattcttacaatctgtctcgtgattttttggggggcnccatgggggggcaccatgaaccacacctgtacaagatggcaaacttaat

SEQ ID NO: 518760 - DNA, 5591 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttgtcatatactctgaaagaaatttatatatcaacctgaaataattggttgaaaccctttgctcaggtactttttaaacttcgtaattatggaaatttgttttaagaaatgttcagtgctgatacatcatctttctgaaaggatgtaagttctgtctgtgatcaatgtgaagtaaaagagtcccttgaaattgatttttcaagcgttagaaggttagccatgtaaaggtatttatacttacctcaaaaaaggatcaataaatgtttatgaaatccatacatatgaatggtttggcttttggtaaaaaaaaaaa

SEQ ID NO: 518761 - DNA, 171 bp, Homo sapiens
  misc_feature (72)..(72): n is a, c, g, or t
  misc_feature (87)..(87): n is a, c, g, or t
agatatctactcgccagtggggcatatcaaaacttggagtccctcacctctctaaggttgggcaggtgaccntgaagtgagcacagnctaggctgagctgggactggtacctcctggtcttgatacccccctctgtcttgtgaaggcaggggaaaggtggggtccttggag

SEQ ID NO: 518762 - DNA, 153 bp, Homo sapiens
cgatcataacactgggcctggggtacaggagtgttgcatattccatgaggctggtgtcagggaagcagagactcacagttgccaggttgtccatctctgagccaatttccctccacaacccagtgcttcagtcctccccagtgcttcagcagt

SEQ ID NO: 518763 - DNA, 5029 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacaccgtcg

SEQ ID NO: 518764 - DNA, 4876 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtaggtatatattcacatttctcccatgtaggaattatattggatttttttaaatttttgctcaggccgggcatagtggctcacgcctgcaatcccagcactctttgggaggctaaggcgggtgaatcacgaggtcaggagattgagaccatcctggtcaacatggtgaaaccctgtctctactaaaaaatacaaaaattagccaggtgtggtggcgtgcgcatatagtcccagctactcaggaggctgaggcaggagaattacttgaacccaggaggcgtggaggttgcagtgagctgagattgcactactgcactccagcctgggcaacagagcaagactccgtctc

SEQ ID NO: 518765 - DNA, 2484 bp, Homo sapiens
tacaatgaatggtgtatctcaagtgagtaaaaatctctggttattcaaataaaatctgtggttaaattagtcaactttgatatttatttgaaatttggtttaggacttatgtatgaattaggtttgctgtgtttctgtgtaaattttttgtatctatactactaattgaattattgaagaaagtgtttaaaaatgtaattgttctacctttgtaggttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttgtcatatactctgaaagaaatttatatatcaacctgaaataattggttgaaaccctttgctcaggtactttttaaacttcgtaattatggaaatttgttttaagaaatgttcagtgctgatacatcatctttctgaaaggatgtaagttctgtctgtgatcaatgtgaagtaaaagagttacagccttttttgtaccattttatccctgaatacttacctgtattttaatctgaagtatgatcatttgtgccttctaaagcagattatttaactgattaaagagtcccttgaaattgatttttcaagcgttagaaggttagccatgtaaaggtatttatacttacctcaaaaaaggatcaataaatgtttatgaaatccatacatatgaatggtttggcttttggtaaaaaaaaaaa

SEQ ID NO: 518766 - DNA, 205 bp, Homo sapiens
tggcaagcaactcagtattgcgcttttcccgcgccagtcaatgcattctgatgcatctccagccctctagaaatccagacatttactatctcaggtcagtccagccccgtcgtgcagtgattccggagcccggtgtcgcgccgcgcctggcccgcctcactcccccgattttagccaagaaaaccaaacggccacagcctccaga

SEQ ID NO: 518767 - DNA, 2581 bp, Homo sapiens
ggcacgaggttgaataatcaaaactgtaatagatggaagagaatggagaaaaatggaagaaatttaaagggcacaagaaaacctccgttattcccaattataatataaaatattgtaagaaaaaaattttacagcattaacaactagtggtaatctttttattaactaccattttattttgtagttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagattggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaaggtataagttagtttgcaaataatatctcttcccctcaagcaaggacttattcattgttgccgtaccttcacttggcattcaacaatataagaccattacataatttttacttcaaagtagatgggagtttttgttgaaagtcaaaaccctgtttctcttgctcctctttgaaagtctgttaacattttgagggttttgaatggtgatttgttcccagttggtagtgtgcctccattccctgttaataaaagactgatctgttcttgagccagatattagttgggtggcgaaaagtagctatctggagtcgcgggatgtaaaaacaaatatttcatggaaacgtctaaagaaggtaggatctttattttctttgaatctgatagatatttttggctgctgacctagggaatgattctactctatcacatctgatactatgatacttactgagtagactcagattttgagtaatcataccttgactgtagttgtcatatactctgaaagaaatttatatatcaacctgaaataattggttgaaaccctttgctcaggtactttttaaacttcgtaattatggaaatttgttttaagaaatgttcagtgctgatacatcatctttctgaaaggatgtaagttctgtctgtgatcaatgtgaagtaaaagagttacagccttttttgtaccattttatccctgaatacttacctgtattttaatctgaagtatgatcatttgtgccttctaaagcagattatttaactgattaaagagtcccttgaaattgatttttcaagcgttagaaggttagccatgtaaaggtatttatacttacctcaaaaaaggatcaataaatgtttatgaaatccatacatatgaatggtttggcttttggtaaaaaaaaaaa

SEQ ID NO: 518768 - DNA, 119 bp, Homo sapiens
gaggtgcagtgaggcaagaacggaccactgtactccagcctggtgctcaatcacagttcactaaagccttgagctcctgggctcctgggctcaagcaatcctcccacctcagttttccg

SEQ ID NO: 518769 - DNA, 214 bp, Homo sapiens
atgatccacccgcctctgcctctcaaagtgctgggaatacaggcataagacactgcacccggcctgtttttgttttttagagacaaggtctctgttgccttggctggggtgcagtggtacaatcagctctctgttgcctcctgggctcaagcaattctcctgcctcagccccacaagtagctgggattacagaagtgcactcccacgcccagct

SEQ ID NO: 518770 - DNA, 395 bp, Homo sapiens
tcacccgaggtggcgggtgttggctcccagccgtggtgcccactggcttggcacaggccccggtgcctgctgcccaccgaggcggcgggggccgcgacggccatgctgagcagcatcagccgcgggatgagctcctctttggtctccacgtttggcatggacgagagtgcggtctatagcactgcaagccgctaccttgtcccggtcgttataaaggtcggtctgtccctgcgcacgtactaggatccgatggaagacgcctctatcggctgctgtggggaccatgtgcgccaggttcacccttgctctccctcgcgcacgcttctgtccggccctcccttaattctggggcctccgccgtctcactcacctcttcacagatcctaaccgtcctc

SEQ ID NO: 518771 - DNA, 270 bp, Homo sapiens
catgttgccagtgtgaacgtgagttagcgtatgtcggctcactgcaatctttgctcctggttcaagaaattctcctgcctcagcctcctgagtagctgggattacaggtgcctaccaccatgcccaggtaatttttgtacttttagtaagatgaggcttcaccatgctggccaggttggtctcaaactcctgacctcaagtgatctgcctgtctcgggctcccaaagtgcttagataacaggcatgtagccattgcaacacggtctctca

SEQ ID NO: 518772 - DNA, 126 bp, Homo sapiens
tcagtagcggagcatcagtaagggagttcagtaaagcggagcacgcctgctggaggtatgttagagttgagctccgcttactgatgcccgcttactgaactccgttactgatgctccgcttactga

SEQ ID NO: 518773 - DNA, 920 bp, Homo sapiens
catagtggctcacacctgtaattccagcaccttgggggactgaggtgggcaaatcacttgaccccagaagttcaagacctgcctggacaacatgatgaaaccccgtttctacaaaaaatataaaaactatctgggcttggtggtgtgcccttgtagtcccagctactcagaaggctgaggtgggagggtcacttgagcctgggaggcagagcttgcagtgaaccgagactgtggcactgcactccagtctgtgtcacagagtaagacgccatatctgggaaaaaaaaaaaaagggtgtcggaccttggccttaattaagggtcttaaatctcatttatcaaggcctcttaataggggctgccacaattagaatcacccggggagcctgttaaagtccagttcaggtctaactgggtgtcctgggaggctgggggagggatagcaatcaggagaaattacctaatggtaaattgatggagtggcagggtgcagcaaaccaccattggcacatgttctatcttttgtaacaaaccttgcccgtgtgcatatataccctagaaatttaaagcggtaatatgtaaccgacaattccacaaaagacaacaaaaaaagtgggtctcgtgggcacgcggggggtggccacccctgggactcccgacctttgggggcacagagggggacatggggccaagaataaaacccccggggcacaggggaacccggtctcagcaaaacttacaattcggcaggggggtgcccagagtgcaaaatatggggcagcgagaaccgttactgacaacatggggcggagagacacgcgccaccgacagaccacacgaaagacttaaaacgacacgagtacggtcagactacggcgaggaaggtaacataacgacaacgcggtgagacaagcaagatat

SEQ ID NO: 518774 - DNA, 81 bp, Homo sapiens
gagagagatgaagggtcttactactgtgcctgtgacactactgggggatcctctagctcctgggacacccgacagatgttt

SEQ ID NO: 518775 - DNA, 209 bp, Homo sapiens
agagttcatatgtactattcattctagaacaagtgtcacgggaccagtattgtttacccaattttttatccggacactgaagcttagaggagtgccatgtttcgagtgttattacagagagcaaatggcacagactggatccaagggccatcttcctggacctgaagttcatgctcccagacatcccacccctagctgaactatctcaa

SEQ ID NO: 518776 - DNA, 540 bp, Homo sapiens
  misc_feature (426)..(427): n is a, c, g, or t
  misc_feature (524)..(524): n is a, c, g, or t
cagcagttcaaaagagagtgaaccaggtagacatcaactttcaagatctcaaaaaatattgtcaatgggaaaaaaaccaagttgcactatgataggtatatcgtttataggaaaaacaacttaaacatgtatgtgtttgtgtataaagatataaaaaaggtctagaaggatgtactcccaattcttatctggtgaatggaagaggggacaagtttgtggaggataggtaaaagcattttagattttttggtaatgctcttaaaattgttaagcctttaggattaatgcgtatattgaactacctcaatgttgtactaatttaaacttttaaacattgcttacaaatgtcaataacacctatcaactctaaagttaatgtatgtatacactagaatttttgactttgtttggggttctgaaataatnnaacttatatccccttctgatttctgggttaattcaaagtcttcactgaccagaaggaatgtatctcccaatccttttcctaaaccgaaatagggcanaaactataatttaaag

SEQ ID NO: 518777 - DNA, 249 bp, Homo sapiens
tacccttatggactcatctcacggtttgaagacttcctaggcttgtctatggacctcatcaccaaggattacaaatgcaacgttgagataggtcatttgtatcacaaggtcacttatgaagcacctagaatttttcacttatacgaatatgttctttgggttctgctgtggcccagacagtgttgacttttatattattgtgggtttcgattttttcccccagaaataggttccatttgatgtacccga

SEQ ID NO: 518778 - DNA, 116 bp, Homo sapiens
  misc_feature (59)..(59): n is a, c, g, or t
  misc_feature (77)..(77): n is a, c, g, or t
cggcacgagcggcacgagccaagacacactatcgcgctatgcaggcagactgcctcagnaaactacagcgatatctnaaatccggggtggccatcaggagaacagtgccccccatg

SEQ ID NO: 518779 - DNA, 791 bp, Homo sapiens
  misc_feature (348)..(348): n is a, c, g, or t
  misc_feature (397)..(397): n is a, c, g, or t
  misc_feature (523)..(523): n is a, c, g, or t
  misc_feature (559)..(559): n is a, c, g, or t
  misc_feature (591)..(591): n is a, c, g, or t
  misc_feature (627)..(627): n is a, c, g, or t
  misc_feature (690)..(690): n is a, c, g, or t
  misc_feature (757)..(757): n is a, c, g, or t
ggctgtatgctggagttggtctgtgatttggcgacagactttgacaggtctggagctcagggacatagagtcccccccaaaatccgtcagggtcctcagtgtccagacgtctgccccgaggtgcctgatcctagaaatacagactactgcccccagtgcccgacaagaatccctcgccaacctctaacaggtttggcttcttgttgtttgcgaagccctaggagtgcgtggtgcctatgtgactcgcggagtgttggcacttatagtcgttgagaagcgagttggtcgagtgcgaagcaaacgccagctcgtgacatggcgtgaccacgaccgtggtggagcggtacngtaatggtagcgattccatgtagcacggacaatttcgttacgtgctggntagctaacaacaccgtaaagcacaaacaatcgatggtctataataatagatgtctcatctgttagcgcgcatctcggtgggatagaggaatactttatgccaatctttgggtcgcacccatagatnaacttgcttgttatgctgttgtcggttggctctgcntttattgagaaccgagtaatgcaatatagcantcaccgcaatcatgactgtttagagtactctggtgntcaggtgtctgtgagcgtgcgcagaggtacatacaacggtgcgcgtcccacatggcgcacaanccatatcaagaagcaggcgcgacggccagacgccctggggtggagaggtgcctacgtgcgcatgtgntggaaaccaagacgagcgaaggtctactggggag

SEQ ID NO: 518780 - DNA, 240 bp, Homo sapiens
gattggcaccctccatcgtgtcgtgtgacgcagttgcccagacacaggtctgccctcggcctggtccatcatgaaggcgtttccatctgcaaggatgacgcgggtagcctccccgagagcaggcctgtcccactacccaaggtgggaataaactgtaagctgggctctcttatgttgctatggtctttgatgtgttgacatgttcccagcgagatagtactgcaggggttccggtgatgt

SEQ ID NO: 518781 - DNA, 166 bp, Homo sapiens
  misc_feature (60)..(60): n is a, c, g, or t
  misc_feature (93)..(93): n is a, c, g, or t
  misc_feature (109)..(109): n is a, c, g, or t
  misc_feature (117)..(117): n is a, c, g, or t
  misc_feature (143)..(143): n is a, c, g, or t
atagcttgcaactatactatcacatgggtcggtaagtaaaaataaataaaccaaatttgnctgaggacaggctaagatcaatcttctcatcanaccactttttctctangagcaatntcactctcagttttagggtggacatncttgaatgcctcaaataaaacgt

SEQ ID NO: 518782 - DNA, 1158 bp, Homo sapiens
gctgtgtccggcgatgtgtccgcggtgcacttgtcttcgcttcgtatagctgtctgtttgcacttcgtgattgggaacacgtgggatcatgtccatcatgccgatgggtgagtggtacactggagtgtatcccgtttaccagtgaccgccgagactgttgttctacttgatgggcgtccgaagggaataccagtgacagacgagctaaagtaatagtggcctgacttatgacaacagccgtgcttggagagtctcgcagttacggtctggctagtgctgcaagtattcgtatcaggcagcacgaattgggaggttaggctgcaactatccgtatgaccagttgatttgtaccttagggagatcactgacctggcctgagtgcgtcttggtgccatttcgtgtgcacgaccggtgtcatactatgcgagacgtatatcccgcgtgatgcgccagacatgcgagacacactcggaaagcgctaaggtgcgcaccgaagggcctaaacatatgcggttttatacgcgtaccgtcaacgcctgtattgttccccctatttacgccactgagttcctattgacaggtgcttctgaaattgacttaattagcggagttggtacttggcccaatgttggaggatcctgtgcactcaaatacttactggttgggcacgttggagaagtcccctttccgccgaagagagaaggttcccaaatctcaccgagcctactgttttgccccctgtttgtggcggcacgaattttggcgccccattttagggaactagagacccgggtttgtcttcccaactttaacggcaacgtttcgctttacgagataaccgaaagcacctcggaggcttttggcgacaatgtcggcgaaccgataggcaacatatttgcgtgaagatacatgccgtattaataattcatgggctaactctcgggtgttagcccccccctcgacagaatggctgttggcgccccttttgatctcggagtcaaaacgtgggacaacacacggtcgtcggtgtttggggccgcacacgtgggcatgttggcggcagttttaaacctcgtgggccggtttactctctagtagtaggggggataatttaagaaacaacacaagcgcgttttggggcacatttctcacacgtca

SEQ ID NO: 518783 - DNA, 222 bp, Homo sapiens
  misc_feature (142)..(142): n is a, c, g, or t
agaggatccccgtgcgataatagcgatgctattcatcggcacctcgctattcatcggcacttcgctattcatcggcacctcgctattcatctggcaccacatcacatgtgtccctgacatattaacacggggatgtgcacgnctcatccacatcgtgcccagcacacatcccacgggttgaacacaatgactccagggcagcttttactcatttgcacacct

SEQ ID NO: 518784 - DNA, 465 bp, Homo sapiens
tggctgggcgtggtggctcatgcctataatcccagcactttgggaggccgaggcgggtggatcacttgaggccaggagttccagacaagcctggccaacatgatgaaaccctgtctctactgaaaatacaaaaattagccaggtgtgatggtgggtgcctgtaatcccagctacttgggaggctgaggcaggataattgcttggacctgcgaggtggaggttgcagtgagccaagatcgtaccactgcactccaacctgggtgacagagaccctgtcaacaaaaaaaaaaaggaaagaaagaaagaggaagaaagaagaaaggaaagaaggagaaagaaagaaaagaaagaaagagaaagagagaaagaaaagagaaagaaaaggaaggaaagagaaagagaaagaaaagaaaagagaaaggaaaagaacgaaaaagaaagaaagagacaaagaaagaaagagag

SEQ ID NO: 518785 - DNA, 429 bp, Homo sapiens
ataagctttagtgacatctggacctctggagttaacattagtacattttgaaaacaaattatatggtgaaaagggaaaaggcccatagtaaatgttcatactatgtttcagcaaggactcttttttaggttgtattctatatctgggtttttattttcaccatttttcctttatgtatttattaactatttaaatatatatttaactttaaggaaaggggaaacttttgccaaccaagatcttttgggtaaaagataatatggaacacaataaaataacctagtaactctgatgaggagttaaagtgacaagagagtaaattgatgtgctgaaagcttaaagtgttctgttctcttatcacatctttgataacctgatcctgaatcttctatttcagaccatcaccactatctaattttagaatattct

SEQ ID NO: 518786 - DNA, 130 bp, Homo sapiens
agcgccagttgtcatattgtggtcgtgactgggagacacccttgcggacactcatgaacaggctatcttgcggttgcaagtcaccaatgttctgtctcagcctctgactcaggccactgttaaactagaa

SEQ ID NO: 518787 - DNA, 449 bp, Homo sapiens
  misc_feature (189)..(190): n is a, c, g, or t
taactaaaaacgcatttaagcacttgaaaactgggcctaaagcaagaaatttaattttttcctttggttcaagaaatttcaagaaatccgtgaactacctccccagtctttcctgaaacatcaagatgccgttcctagatataaaacagagacccggctggccgtggtggctaatgcctgtaatccgannggttttggaaaggctgaggctgggaggggggtggggatcacctgaggtcagaagttcaagaccagccctggccaacatggcgaaaccctgtctctactaaaaatacaaatattagccgggcatggtggcaggttcctgtaatcccagctactcgggaggccaagacaggagaatcgcttgaacccgtgaggcggaggttgcagtgagccgagattgggccactacactacagcctgggcaaaagagtgaaactccatct

SEQ ID NO: 518788 - DNA, 760 bp, Homo sapiens
aagagtgactactaagacacggaaggtgcgtgtgtcctgtggggatagtctctcctggtcgacaggcagcttgctatggaggcatccaggtcttggacgtcagtgcttgcgacttcgtcataacttaaaatatcgcctggggaatatccgaagggtctgagacaaatggagatggggttcgtgcgagtcattgacttggactctattcgacggtgacgtccaagcgacagcacagactgttcacgttgacgccgtggggctgaaacgccactaattggccttcgtccacggcacctacgtgagtcgagccctgcgaccttctaatgggacggaatccttgaacggagggagaccatcgcgcctatcattctagagctatctcggccccaagtactccacagatactcttcgttcttgatcaaattaacagcctagtgatcccaaaagattgtttcagattacgctgtttaagacttggagcgacatcacgactctttaacctgccgactgcccagctccgcgcaccaacccatccaggtgggccgggcttacgaagacgactgctcccaccaactcttgcatacgcatggggacaattgcactgcctgggcccaggtgctgtgcagcagcagtcgacggccagtcttgaggggctacccagctactgcgcctccgcaagtgtcgtgacatggcatcccgcttggccatactccccaacggacaaaggaatgccgaataattgccacactggtcgactgtc

SEQ ID NO: 518789 - DNA, 864 bp, Homo sapiens
catccccaagatggctggccgttaagtgacagtctgttgtgcgaacggagaaatgtgccacaggagaattggtgcgtgcggactccagcctgtgtggattcctgatggccgttgtattgtgtgaagcatgtacgattccttacatgaccaccatgccctgcggaactgacgacgtgcacgaatacacgtattacaacgacatgcttggactgaaacatgtacccacgaacgtattaacgttctattggaacctcaaccctttggctcacaaacgataacacgacagtgctaaacacacgcgtccacgactttccctggaagactttacaaccatgaagccttatcggacacacttcctacacaaattaacatttgcaaggacactgaacaacagcaacggaatcgtaccagacccataacgtccaacttgtggatgaacacaaggactattccttttggcctgggccaaggaactccaacccccttgttaattttgcgaacacaccgcctctcaaggtactcccttccccttaaaactgctattaacaaagtagctaggtaccttgtgtggagatatggcgccgtgcgcttaaaatgcgtaaaaattgcgttctggaacattatttcgcatccactctcggcacttgccaacgccttccaaaggggcccatttcagggctgcggggcacagcacagtgaaacgttctgagactaccgaaaagcctgggtccaacacaaaatacgcgacaaatctccgtcgggcactcttcccccccctgggacacgggggcaaacggtaaaacccgtttgtccaacccatatagaccctcgtcgcgaagcaaatttctcaaattatatagtcta

SEQ ID NO: 518790 - DNA, 418 bp, Homo sapiens
caaagaactggttttataggtaccagtacatactggttagcacgatggtcacgttgaaaaactgtaagtcacggacacggggacactctatgtacatttagaactaatctaagttcactttcaaatgacactataccacttaacacgtagtacaattactttataacagaatattcccaattcccttgtcctcttccttattgctgtcattcattttacttatccataagctgtaatcactgacacattgttgctattatttgttttgaacaatctgttgtctgtcagttaggaataagaaaaagatttcatttagccttcatttattccttctgtaatgtgctttctttccttatgtaggtccaaatttctgactgaaatcattttctttctctctaaagattatctgttatcattt

SEQ ID NO: 518791 - DNA, 198 bp, Homo sapiens
cattgcttctctacgtgtgaagtgagcgaactcaccatctatttttccctcctgcctccatccttctaccacataccactctgcacagctatacctttcctcctatagagccaagccttcaaatatttatattctgttcagtaattattaatgagtcatcctcattaatattaattacattaataatttaattttggg

SEQ ID NO: 518792 - DNA, 1540 bp, Homo sapiens
  misc_feature (829)..(829): n is a, c, g, or t
gtgttgtttgcaatcgctcgtgtctccagcaatgggttgttctgtttgccgggagcagcttcgtctgtggtgggtgccgcgaggtggtgctccctctttccctacctcttgtgggggcactctcggggttagtcacacgctctcttccgtggctcgagtgtattgcgccagtttggtcggggcctggagcgttgtggagtacatctccttgtgtgccgaccgctgtgatcggcttccttccccgttttaggccccgccagtgcgccccctggggtggtgaactgcgccccccgcggggggccccacactgtaagcacgtgggtgaccaagcccctccttggaagtccttgttttgcccaactaccaccaagtcctgtgtgaccaaagatgtgggcctgttttccggggtatcttaacctaatttggatactattttttggggtgcccaccggggccttttgggcccccagggacaatcaattctctttgtcccacgttcccacgggcacaatgttgggtcccaccccacgggaatgttgtaaggagttgttcccacagtgttgtcacagtggggagaacacgagtggcgttccacgggaaggaacaccctgtgtgagtgcccaggcgccacattgtgggccccctatatggggttgggttttcccccatggttggcgtgtcacgagttccgtcggccacactttgaggtttgggtacacggtatcccccccgagggagcctctatccacggggccactggccgtggtggcccccgcgagacaccccccgcgtgagtgtctcacacacttctgccctttccacatgtgtntgtggcgctcgcccccgtgagacacagtgcgcccctgagactctgtgtgtgccgcgtgtggttgtgagagcgccttgtgctgttttctccctgttcacagccacgcgtgagacgtgtcccctgtcacacagagacgcgtcacgccgcttgtttgtggtcttgagagaatgtgcttgtgacccacacatatctgccccacacatctacagagatactacacgtgccgcctcacagggtgatgatagacacacacacacgcgtgtgttatacgtgaatgtgtgtgtgtgccctcacgcgagaggagacccgcgccgtgttgccaccttcacaaccacagggcacatggagagtgattatcccgtgcccctcacaagagccccggaaatgtgccctgttcggcgtcctgcttttatatctcccacaaagcacccacccgcacttattccagaaggtggaaggtggaagtcacagacacgcttcacatgaaatgctgtgctctggctaacgcaccaccacacttgggcacagctgaaagccctgccacattttgcacatgaagctgaatcacagccctgtgccaccacacttcgctcttgaaggagctccacggtctggccgggccacccggaggctttttgggctttggacatccccggatagcgtgggccgaggaatggtgggctaagtagtccataataaattaggaccacc

SEQ ID NO: 518793 - DNA, 819 bp, Homo sapiens
ctgtattaagtaatataatgcttagaattaccgtattatagtagttgagggtcatgtaagagggagctggaggaagctacccaggataacagaaagagatgtccagcgtaagcaagaatggtctggcagattacctaggttggagttatctggttcaatatgaaatatgtgaaagtggtaactgtcatcatttgatgcagagtccgggtttctctataataaatcccttatgccaaatgcatgaattgcgagacatttgctacatggcaagcagtgaagcaagtgggtgagtaaaactattttgacgtgggagcgtcttcagataggagtttagtcttgacgaaagtgtccgtggcaggaagttggactccgaggtagggttacacgtatctcctgacgggacctgcactcgcatctgggcatgttgacatttgaggtggcacggcaggatgcctgtcttctaatatatttgggtgagtaactgagaccagccaagggcaggttgaatgcttaaatctgaaatgggattctctggtgactgaagacttttattcgggaaatgataaacttcaaaaaatctctgcatcgcgaactgggatcttccccgcggcttttttcccccaaaagttgtgggggacttttccggggaaagatgagggtagcaaatggcgggggttcgcaaaggggggaagtaccccccgaataaggaacgacgcggaaaaaaacagaccgtttttatcgcgcaacagggggggtaaccagaaataaagccccacgctggggggaggaaccccccacacggataccggggggaaacat

SEQ ID NO: 518794 - DNA, 900 bp, Homo sapiens
ggctttccctagttccagttacaagatggggaaatccttcgccaacttcatgtgcaagaaagactttcatcctgcctccgaaaatcccaatcatccaacacacaagtatggatggcagcaacgagcaaaatcatcatcatgcatcaagcacagcacacaccacagaagcaattgcatgccagccaatatcttcaaagcaacaaagaatcatcatgcataatagcattgcttcatgggcagcatgaacgtgtaacagcaatggccttcaatttccatgtcatgcaagccccgaccaaggcagctcaacaacacagcaaacacgaaagcagcaacaggaaagacacaccagcaaggagcagcacgcgaataacaaatttagcaatggcagcacaaggcagccctcacgcagcaacaaatcatgccgaaacgctgaccatgaacagtcagcagactcagccctcttggtcattcacggttcgacaatgtgcaggtgccattaccatgtctacaaatgggggtccatgtcaaccacagatcgagaatgtcctttgtgggtctttctggaatcaatgcaagttcggttccactgatggctcagggccatcgatgcaccctcggagctaatagcggagatgagacaccagtgggtatgcactggaaacgacaatgtcactggcggagaaacttgaccgcacatgcatccaatcaccaggaggtacatgttggccaggtgacggggcggacagcaaggactcaagcaaagttgcaagtcctgccagacggccacacaacaaccaaaacacaaaaaagcaaacattctccggggagctcagcatccgccgggacgaagcacacaacacgaacagacagccgcgcaaaacagcaagcggacgcagacca

SEQ ID NO: 518795 - DNA, 317 bp, Homo sapiens
ccacaatttgcaattactggctttgcatgttctggtactatctcactctcagtctctccccatgacctgaaactcccacaaaggcaaagatcaccacagtaccgagcactgaagcgttggaactgggcacctactgcaactggagccactgggtgatgaagaatgcatgcacacacagcgaccctgggactctcagcagggccacaaaagcagctggaggatgggttgcaaatatgcatgccatgcagcctgtgcccttgacaaccctggggcccatgttccacaggtgttctacaaagcatcttctgcccggcctg

SEQ ID NO: 518796 - DNA, 447 bp, Homo sapiens
ttctagtacctagaggatcttttcttggacggcgttgcgtagtatggtagtaggcggctgcgcgtgagctgtacttctcttgttgccggggacgcggtctagaggagcgggcccaccagctctctcagtgacgcttgcgccgggggagtggaggggagttggcgcgggaacccagcagtgtgaggcccccaagccgcggggaaagcctcctcggggtcgtggtctttggagacacgcagggagactgcccatggtgacgtcttggggggacgcgtacgggtacgagtagttggactcgtaggaggagcgctctgagttgcagctccggggaggacaggctgcttgccgggctcaggcacaaggggtctctgtagggcctccaggcgtgggcagaactcagcgtggccgtggagggggaccgtttggagctagggaggacgtcttcca

SEQ ID NO: 518797 - DNA, 144 bp, Homo sapiens
  misc_feature (14)..(14): n is a, c, g, or t
aggtcgatcactgnctatgattggactgactggaagtatggacctgtgaatatagattgaaaaataaaaaagaaatgctacaaaaaaaaaaccttagctacttattgtttaattatcaaacctcaccagaacaattccaatttt

SEQ ID NO: 518798 - DNA, 367 bp, Homo sapiens
gtggcagagcaagaccctgtctcaaaaacaaatgatgctttctaacttttttattttcgtgtacccactgatggtaaattaataatttaattggggattgaaaagccatgatttcctaattctgtcaatcggtctgtgtttattagctgtcacttttttttttttttttggaagacagagtttggctctggttccccaggcttggagtgcaagggtgcagactctcggtttgttgaacctttgcctctcgggtcaggcggttctcctgcctcagcctcccaatgtacgctggggattacttggcacctggccaccacggcccagtctaatttgggtgattttggggtaaggagatggggatttcggc

SEQ ID NO: 518799 - DNA, 514 bp, Homo sapiens
catgtcgaccattcaaccttaaaaagagacgctgcttcgccgggcacagtggctctcacctgtaatcccagcactttgggaggccgaggcgggcggatcacgaggtcaggagatcgagaccatcctggctaacacggtgaaaccctatctctactaaaaatacaaaaaattagccaggcgtggtggcgggcacctgcaatcccagctactcgggaggctgaggcaggagaatggcgtgaacccaggaggtggagctggcagtgagccgagattgcaccactgcactctagcctgggcgacagagtgacactccatcctaaaaaaaaaaaaaaaaatttttttttttacacacaaaaaagcccttcagccaggtgtagcattgcagtctacagtgtaggtggaggcttaataagtttagaggctcaagcaaatgattccctcttgagggctacctactagcagcaacggtcagggagaggaggagcatacagtctatgatgtgatcaaggaattc

SEQ ID NO: 518800 - DNA, 347 bp, Homo sapiens
ctccattcctcaaaaaccactctccatcctcacttttttgggctctttgcctcgcctcgagatctaccctctttcccttattctcccttttcgccctcttcctcttaccctcactaaacacctctttcattttttccattccccacacagtcctttatccacctgcatttttagcgaaaacaattaaaacgatttcgccccattgcttctatcaacacaaaccatccatatcatccatttcctttccctggtcttcaggctcccaggaaataaccccagcctttcaaaatcttgtcttaaggcttgtgaggaatcagaactaacccaggactcagtcctgcttcttt

SEQ ID NO: 518801 - DNA, 264 bp, Homo sapiens
cgttgaggtgacatgtgtagtggaaaagataggaaggtagctagggataacaactaatttaatcctggcatatttaaagctgctaaatctggtgctcagagggagtcaaaacagctagtcagtggcagacaggagacgtgaccaaactctggagtctccctagagttcccttcctaggaggcagtggtgctctagtggctcacgtgtgtatctactgcttgtctttcttatattttattttatgggcccagcagttaaaaattt

SEQ ID NO: 518802 - DNA, 110 bp, Homo sapiens
ggctaagttgtggagagagacggtacagcccacagcagtacactggcagcttgcaataccctgggcatgacgtcttcaatgtttttccattcagctcactgataaccttg

SEQ ID NO: 518803 - DNA, 180 bp, Homo sapiens
cacgctccaaccacacttggacctcaccttgactatgtgagactctgtgctagtctacacagcaccagaacaacacgacttggctgtataataacccccatttataatagcctgcatttggaagatgaaaaaaataattgttttccctggcagcatgttaagtccctggttactttatgc

SEQ ID NO: 518804 - DNA, 643 bp, Homo sapiens
  misc_feature (542)..(542): n is a, c, g, or t
  misc_feature (615)..(615): n is a, c, g, or t
aagagcagtaacacaaacagggctgaaacacgccctcctcccgtccccacacccccgcgacttgccatgttgcgggtgatgtgaaggagagaagtgctgtggcccttcagggagcacagacctaggggctccctgagccagggctgtgacaccctctttggggctctgcggtttctggtatcttcaaacttccgggcaccactgcattccccttgtccagacacaggtgcccacagcagaagccgcttgtggttcatcagatccagctgcagacttgcatagaaccggcgcctttgccggcgcctggagctgcctgcccagctgcagcagctggtgtgtccggctctgcgcagtggccaaaccctgcgttcgctcgcctgcacacccctcgctgttccgtgcctggctcaccctcggcaggcgtggaatcctggctggtagcatgagctgagcacagcctgccaggccacgtcagtggaacaagtctggcggggcctgatcaaaactcaggcaaaggcaccactggtcacagagctttctanctggaaaagcaacacctgaaggatcccgtgacacaatcaacctgctaaggagatccctggccaaccctgaaangctgcaggaaactgcctccatccaaggc

SEQ ID NO: 518805 - DNA, 178 bp, Homo sapiens
tcatctagaggacccgtgtcatccccttcgtgtatcatccttccaaagggccagatattacggccttctagcaggatgactttccggcccccccagagctcattgttcataactggcccctctgctagttttgggacttggtacaaggtgacaggtggaggctgcatcttagtgcaga

SEQ ID NO: 518806 - DNA, 372 bp, Homo sapiens
tgcagagatcacatcgataagagtgaaagcaagagagtggggaggtgccaggttctttaaaacaaccagctcttggagaaataaatagaggccgggtgcggtggctcatacctgtaatctcaacactttgggaggccgaggcaggtggatcatttgaggtcaggagtttgagactagtctggccaacatggagaaaccccatctctactaaaaatacaaaaattagctgggcatggcggctggcacctataatcccagctactcaggaggcggaggcagggagaattgcttgaacctgggaggcagaggttgcagtgagccgagatcgcaccactgcactccagcctgggcaacaaaccaagactctgtctc

SEQ ID NO: 518807 - DNA, 185 bp, Homo sapiens
  misc_feature (146)..(146): n is a, c, g, or t
  misc_feature (184)..(184): n is a, c, g, or t
tctaaggatcccctgcggatggggtctgtatgatggcggcctcgttttgcgtgtgactcccagcagccttgcaaatcgggggtccaatttgtactggggaggctgatgatccagcatgagcaggagggtgcacttgacgttgaggntctccaggccgttttacttggaaaagccatctgtctcnc

SEQ ID NO: 518808 - DNA, 198 bp, Homo sapiens
ggcccccctgatcgtgtgccagaccttctgccttcaaacggagcaagttttcttgtggtctgggtcccacttccggttcggagacgaattagtctcaggagtctgttccaatacaatcacctcgtgtgagaaaaaaatggaccactcatccaacagcaagccaagagggagcctgaggaccacccaggtgagtcggtg

SEQ ID NO: 518809 - DNA, 631 bp, Homo sapiens
atatgttgactgtaggatatgaactatatcatagcagactgtccctagcagcatagcaggcaagcaagctccacacagctcgaaacaatttgattggtattgatataaagtagaaaaggcaatatacatatgtgttatctacccatgatggcaaatgtcaccaacataaatctaccataaagacagtagtctgggctggggaggtggatcacacctgcattcccagcactttggtgggctaaggtgggcagaacacttgaggtcaggagtttgagaccagcctgggcaacatggtgaaacccagtctctaaaaaatacaaaaaattagctgggcatgggggcgggcacctgtagtcccagctacccgggaggctaaagtgggaggattgcttgagcccaggagttcaaggttgcggtgagccgagatcacgccattgcactccagcctgggcaacaagagcaaaactccatctcaaggaaagaaagaaaaaaaggcactatatatgccatcaagggtggggtacaggagtacgaggaagtacctgatgttcccggccccgatgcagttgttcacccaacacagtgatggtcgaaacggtgccacaccagttaccacactcagtgctggatc

SEQ ID NO: 518810 - DNA, 189 bp, Homo sapiens
  misc_feature (75)..(75): n is a, c, g, or t
  misc_feature (99)..(99): n is a, c, g, or t
  misc_feature (110)..(110): n is a, c, g, or t
  misc_feature (172)..(172): n is a, c, g, or t
  misc_feature (178)..(178): n is a, c, g, or t
cctctaacattagcagtagaggcaggaatgtgctaacatccctgatgcacaggcatttctcagccaagaatatcnaccaaatgtaatgtctgagatganaaactgctatngaccaaattcactctgatgttcttaaagagataccatgagttgcttacttggagaagctaangacgantaagggcccaa

SEQ ID NO: 518811 - DNA, 100 bp, Homo sapiens
cctgcagctgggcttggctgagttacagagcatcctggacagtctaaagccaactcccgagcatccttcagttcccagcgatatcacctcctccgagaag

SEQ ID NO: 518812 - DNA, 1505 bp, Homo sapiens
tctcatttaactttttaaaatgggtctcaaaattctgtgacaatttttgggctcaagtttgtttcccatttaaaaacgttacgtgatttttaaaaactaattacctttaaaagcgtgccacatcgcaaaaaaagaacaaccaataggtggctccacataaacatttctcctttctcctctcgtgagaggttttacgaagtgccattgtgttactcatttaacccagactctttatcacctacttaaactttaaatgtggccaatttgaaacacaaacgagttctcttgagaaccgtttcttctccacccacgtgtatttaagaagtgtgcggggtggacaggttattatgagggcattaatcttctcaatttgatacgcccttctctgtgggaccctttctctgtggcgcagacacttgtggtgtgcacacttgtgtccgaggctctcccgaagctagacctctcctctgtgtgttcccccactgtgcctatctgtggagtgaacacacccccacaccggacaacactgtgcgtctgtgtctcctacattatttcgagcgaagacgaggacaaaaggcgaaccccccaagagtgtgtgcgcaataggtctcgtgaacgaagaagccctctctcgacaacaccacacatgtggggccttttgccccgagggaaccccatattagtcaaccaaagtgggcccagactaatccactacagaaatttctcagagcacactttgagagcgccattcttttcccaagtcgttgttttcaccccagaaaaagcggggcgacataccagattcctatctatccctacacaagtcttccacggcaacacttttggctgtggccaattgatggaagcccggtggtgtgccaattcccaatcaacaggggggccaataagacgcgggcgcctatattggggcccctggaatgtgttcccgggcgaacatctccccctgaatcctcttggaaacccagcctgtgcttccccattggggcggggccacatttcgcgctgtctcccaggacactgttgtgccccgcaggtaccttctcttgtcactacaccccttcttcttctcccttgtcagccccccattttttctcccgcgaacacagctctcactccaaaggtctctgagcgacatttgccacgcaccttttccttccgcgggtcaagttgttcgtgggccacggtgtgcccaccaaacgcagttgggggaaaaatctaatatcatcagggcagcacgagtaggtaatacaaaaacctttcacggtatactccgtcaagaaggcacgtcgttatttcatgatcagtcatatggagcgtgacccacaatggtggtcgcgacagcaacatgcagaggacacacacgatagagtgaacttctgacacacagacactaggatacttcgttctttcctctcccttctcgtgctcattctcttcagtctctctgctcaccacaccaagaagcacaagcacacgatgcgcaa

SEQ ID NO: 518813 - DNA, 114 bp, Homo sapiens
gtagcttaagcaggcacgtgtatagtagactttggggaccagaagacaaggcaggcaagaactacaggggacggcggacagacgggcgacatcctaatttccaccttgccagga

SEQ ID NO: 518814 - DNA, 366 bp, Homo sapiens
aggcagtctcactttgtcacccaggctggagtacaatggcgtgatctcggcccactgcaacctctgcctcctgggttcaagcaattttcctgcctaagcctcccgagtagctgggagtacaggcacacaccaccacacccagctaatttttgtatttttagtagagatagggtttcaccatgtctcccaggctggtctcaaactcctaacctcaagtgattcgcctgcctctgcctcccaaagtgctgggattacaggtgggagccactacagctggcccagcagctctggtttctgatagacgtgggttgggggcttttattccctagaatcctaaacccttttaatatgcctgggaattcctac

SEQ ID NO: 518815 - DNA, 1231 bp, Homo sapiens
  misc_feature (201)..(201): n is a, c, g, or t
  misc_feature (1001)..(1001): n is a, c, g, or t
agcggagctggttctcgtgtatcgaccggctaacagtcgcgctgtaagtatgcaacgaccctctcctcttctttctccgccatcacgtctcggcagatcggcagaagcgagcggatcacatgcagtgaagtcgctcatctcaccatctcacgtcttgtgccagagctgattggtcccagcattgtccgaactcgcgctgcntgaggacgcctcctacgtgacctgagatagcgactggcaatccgacgccgcctggatgagcgcaagtagctgcccatgtagactagagagaacccgagttggaggagagacgcgatcgaatcgagttcccctttcgacccctagcgctatctcttgtcgaggttcgatcgaccgggagagagctttaggcaccagtctaattcgatgcacacgctgcgaagccattgatagcttttcggtagagatctcttggagaaacctctaccctttccacattggatggtgagcatgtcgcagacatgagtctgacctctacccggaccttgtcctcattctcacaactccctggtggagcctttcacctgttagtccgcccagcgtcctattggagaatggccatgtctggtgcccggaagtgacccttgatggccccgggccagtgagtcctcgagttctgggccccctttgtgtctgagaggaagcaatcccaatatcgcatggtgtctgggccgttttgcgcactcgcgccccattaccgcctgatgccttgagactctgaatagcccagatgacagccagcgagtttccttccccatgagggccctcgtccctgtgggattaccggctgagccggaacacctgtgttggcttgtagggggaggaaatccctgggattaacctgtagggggcgtgtcaaaacccatacttctctgtggttgtccatcctgggaaccccaggttccttccctccaaaggatattggaattctactttgggggcgaaatagcaccatggttccncaaaaggggcgaggggggaaacgctttccgtaccgtgcagctttttaagccccctcatggtgcctgggcccctcccccaaaggagtatgtgtggcgccgatcacaaaggccatggggtgtagagggctctctggaagaggcccgccctttaatccgaagaaagcttgtcccccaatataccgcgtttgcgaaacaccaaacacctccaaagcggagggcgcaaaacgtcg

SEQ ID NO: 518816 - DNA, 484 bp, Homo sapiens
aaatcagttgagataaacaaaagactggaagcaggataaatacagagacaaggatggacagaagggacatgccctactgcaacttgagaagggaaatgtgagaatggagttagtaatagaggggtgggggtggggttgttgccattcccaaagtagaactgagtttgatctaatctgtggtaggagatacaggaattccctagattagtggtaacaggaggactcacgtagatgtgtgtagaattgactgaaatataggagagactagccagtagataagtaacaggtctctatgctcagcttatgtacacaagagatggagcccattaggcctcccctagctctcctgggcctgatggtccacttgcaggtcagtgcctcattaggtacttagtggtctctgtttattatttccatgtcttgggtcttcagccaggagacgatcctttctggagttcctttaagtgggccagtgttcttcgag

SEQ ID NO: 518817 - DNA, 221 bp, Homo sapiens
ttttttgcccccccccgcccgcgttttagggcctcggtccataaaaaaccccccccccctggcccggtggaagggttttttagtccctgcccacaactgtcctccctggtgcaggtggcctggccagccccctggattgggggcgggccaggctgggcccggtcgggggctccgttttggaggtaataaaaaccgaccccccccccaattttgcttgggga

SEQ ID NO: 518818 - DNA, 384 bp, Homo sapiens
cttttgccccttaaaaagccctaaggtgttgtagacaggctgggaaaaaaaacgcatgcccagagggaaatggcttttttttcccccttgagggccctgcttttcccaaagggcatgatgatggttttactcctttggaaggaagcctttaaaaaaattaaaaaaccggttggttttaaaagccccccgaacaaaggggccccttcccaaatatccaactcctttgaaggggaagccccgagtgaaccttagccctgttttttagttggctgttacatgggggcgttttccgaaaagaaggaaaactttcccgggggatccagtggaagtttgtgaatttcctttttccagtccccttcgcttaattaacatgttccagtgcca

SEQ ID NO: 518819 - DNA, 1448 bp, Homo sapiens
ggtctacttcctcctgtttcggcgtccggcggcggcgctgccatcatgaggtaaatcgtgcactttgctggtgcgggtgtccagctgtctggctcatcaaaagtcggacagtcccaagttttggagcagtgtgatctagggaattagagcacggctgtcgaacgcacgggcgaccttactctaggggaacagcgtaccctgctagtgtggtgacgcaatcataccagtgttagcgttagaactagacgtgtcccatcacagtgtcgaggcatacggtcatcggttgccggcgccgtcgctgtgtctcagttcgcgactacttgcgaagcgcctgtggcaggctattggaatcgcctgttgttcagctcgcgggggctcttcggtgggcagatccttgcccgtgtacctgagatcaacgtgtcgaatttatcgaggtttagcatgtctgagtgcctgtaggttgaacgcaatggtgtgggctctaaacgggcgtgaagctaatgatcagggaacggaccgccggaagcctgggtgggacctcaggctgtcgtggaatgtttcgtggacggacacaaggaagggactgggagcaagccttgccgtagcgtgcccatagggacgcgcgttgtattcgggagcaaggcacctcgctaccttctcggttgtgtcgttggggaaagcgtgaagctcggtgctcatcggggacttgtggttgggcccttatcgtggcaatctaggtgacaaacattaactttgtggggcgcattgtgaccggcggttggacctggggttaagctagaggacggccaccctaatcacaagggttcgcatggaaactccacggttttacaacaccttttgctccaagacaaaggtaatgtcgtccaagggtatggcgcttgaaagaaacagcttgagaccagggtttggcacgaacattggttgttgggcatagggagattagttaggggaccttacgacctcgaggttacttggtgagaaggctagtcttggaagtatagcccaccttgtcggcaactaggtgggcacccctaggttcgccaggaggagcttgctcataaccgtggaaagcattcgaggtcgacttggtaagtggctcaaaccttggtaacacttagctaggggagcaacaggcgaacccgttgggccttggggtgacactcgaacacagtgaccctgggatgcaaccggccaaggtacctaaacgtatggaaaggcaccggaaggaatgcaagaggttgcactcgtggaaccggtgggtccccaaccagtgcggggatgaggacccggtaaagtacccgtgaagtggggccaagtacaaagagaccgcgaaccgagaaaagtacagggggaatggacggagaacagcaatacgaacagcagaggtgtgagacgaaaacacacaaagagaggaacgaaacgagcag

SEQ ID NO: 518820 - DNA, 311 bp, Homo sapiens
  misc_feature (17)..(17): n is a, c, g, or t
  misc_feature (68)..(68): n is a, c, g, or t
  misc_feature (131)..(131): n is a, c, g, or t
  misc_feature (136)..(136): n is a, c, g, or t
  misc_feature (167)..(167): n is a, c, g, or t
  misc_feature (217)..(217): n is a, c, g, or t
  misc_feature (259)..(259): n is a, c, g, or t
  misc_feature (266)..(266): n is a, c, g, or t
ctcggtagacctggtgncaccaccaccatgttgggctgtcaagggctggtgtgtactccgggacactnaccttgctagggttttccacccagctttcaccaaggcctcccctgttgtgaagaattccatcncgagntaatcaatggctgttaacacctagcagggantatgccaccaaaacaagagttgggatccggcgtgggagaactggccaagnactcaaagaggcaacattgggaaccattcgatggaatatttntgatcanatgggaaggatggtttgttgctggaggggctgctgttggtcttgg

SEQ ID NO: 518821 - DNA, 95 bp, Homo sapiens
aaccccccttttaaagccggagctatacttttgttttatccccaaatccgttcccttcctaataagtgatttttcccacccaaatgggtttgcca

SEQ ID NO: 518822 - DNA, 173 bp, Homo sapiens
tctactaggcgtacacaaattcccagggcatgtggcgcgtgtctgtagtcccatccactgtgggaaggctgagtgcagcgagagaatggcttgaacctgggaggcagagtgttgcagggagccaagatcgtgccgctgcaccccagcgtgggcgacacagtgagactcgtctc

SEQ ID NO: 518823 - DNA, 413 bp, Homo sapiens
ctcccccagggaccgggggaccccacccatccagggggcaaaaggaattaagtgctttgtgggtttccccccacgcgcctcgccggatttgagggaaaacaaaaccgatcggcggcccctgcgcccttaaatgcatccagcctgggggtgaggtttaggccctggcgaggaaagggggctcctctttgcccccctactagtccccaaagactttaggggggggggattcccctcgggggtttttattttttgaaaagcaacccttttaaaaaatggtcccgtttggggcttttcaaatttttgaggaaattgctttgtattgtatattccaatgatccccccctgaaaaaattgttttccaaaagttttggggggcggtttttttgttattaaacaaaaaatttaaatggtga

SEQ ID NO: 518824 - DNA, 237 bp, Homo sapiens
ggggcttttcccccgggccccccaaactgtttggggccaaaggaattaggattggccccccccaacccgggggggggggtccccaaaaaggttttggggggggggtttcccccatttggttttttttttgggtttctttgggcccggttccccctttttaaattttccccccggcctttggggtgggggctttttcctttttggccggttcaattaaggtttttaatttcctttcca

SEQ ID NO: 518825 - DNA, 222 bp, Homo sapiens
caaaacccttttgaactggctgaggacacggccaggcaggctggccacactgcggaagggcagctggacgcgcggcctctggtcagtcctggccgtgcttgatgagggcttccagcagctcctgcttcttcagcccactcttcagcccgtaagcctggaaggtgtctttcagcatgggcgccgtgaacttgccgagcgtacccttgctgatgtggggatctt

SEQ ID NO: 518826 - DNA, 200 bp, Homo sapiens
tcatagcacatataatttcctcacactgcgattacctcctttataataccaattacagttcactgcagaacctgtattacttttccgatagcataacatattaaagatattctggatcgtctggaaaccatttttttacatatcatcatttgcaaacaactacatttatatggcatgctatttaaacttctaaaactagg

SEQ ID NO: 518827 - DNA, 417 bp, Homo sapiens
gcacgagagggagactgagaagatagcgctgtgagagaagatgatgggtacacgcgacagactgtgcaccatatttctgtgagatagagcgcgagaaaccagatgcccagagacgcaggagccgacacggtaggcctggcgcggtaaggaggcttgcggagcaagaacggcctttcttcacacgagctattccgcgggtttcagaattccatatggcggacttctcttcctctctcttctcctacatttgggtcttctatactcggggtccttggatgcgctatattcctttgtggcttggaacctcttaagcctggcacaaggtactcttttccttgggaggtctgaactttaaataaggtgatggctgtaagaatggcattgcgcaatttgtcatctgggattatatttcatcgg

SEQ ID NO: 518828 - DNA, 137 bp, Homo sapiens
cctattttagaagtttcaatagcagatcattgctgcctgggggacatgacatctattccattgttctctatcttatagaggatatggaggaaacagtagacctaaggaagactgctattgaaacttctaaaactagg

SEQ ID NO: 518829 - DNA, 334 bp, Homo sapiens
gaggacccgtttggggtgcctttcacttctccttcccacaggcaaggtggggaagcagtttggccagccaaggagacccaacttgaagcttatttcctaaatgggtcacctctcaatctggatctttcaaaacttccaaggttcttgtgcaaaaccttaagcaagtgacaatgtccccaatgagactcgccctgaagcagacttggggcctggctttttcaattttccaacctggttcaaggaatgccttgtgggtcattggctctcaagttccaaccttggcattgaaggaaagggaatccctgggccttcttgggcataattccaatccaaa

SEQ ID NO: 518830 - DNA, 307 bp, Homo sapiens
cccccccccccctttttttagggggccccccctggtgttaaacccccccgggggggggggggggggccccccccccccccctgggggggggggggggggggggcaaaaaggggctctggggccccccattttttttttccccccccggggggggggggggcccccccccccccccccccccccggggggggggggtttttggttttttccccctgaaaaacaggggggggcccccctggccccccccccgccccgttttttttttttttttttggggggggggggccggggggttttttttttttga

SEQ ID NO: 518831 - DNA, 469 bp, Homo sapiens
gctgttccgaggtctcgagaggtgggacacgggcgctgcaccatgcctggctaatttttgtatttatagcagagatggggtttcaccgtgttagccaggatggtctcgatctcctgacctcgtgatctgcccacttcggcctcccaaagtgctgggattacaggcgtgagccaccgcgcccggccggaaagtagaatcacttttgtgggtggcccctagaacctgaaagtgaacagtgtaataaaagtttagtgcaggaagaccagaagatacagataaagtaaaagagaagaaacaatgaccagtaattccagatagcctgctcatttatttttggtttggtttcttggttttggagagggagttttggctccggtggcctaggctggagtgcaatggcgcgatctcggcttaccgcaacctctgcttcccaggttcaagtgattctcctgtctcagcgtcccgagaa

SEQ ID NO: 518832 - DNA, 814 bp, Homo sapiens
accacgcgtcgccacgcgtcgcgtgagctgctctttgccctcacgaatcagaggctagtatggcaccatgacttctaggaatccctgtaaagctgttgccatactagcctctgattcgtgagctgctcttgccctcaagtggtcattcagggttcctgacagaactgtgggtaagtacaggagcagtgcaggtgttccaagatgggagcacgtggaatctgctcatgcagtcctccttacacggggcctaacccacaagggccaggtagctagtggaccgagtgcaaggcacagcagtcaggctctgtggtctcaccccctccttaattctcatgcaattcccaagagacaccacttactgggcctgtcctgcagttgaagggacagggtcagattaagtgggtcaccaggctgcaacccacacaactagacagcccaggatctaaacccagtccctgacccctcggtagtccccagcttgtgtatgtggtcagatgtctacttgggaaacaaatgactcagtaatacatagataacatttctagaagtttccttactcctttgaagggctgaactgaggatctgtcttgagttgcaagggtacacatggccagcatccagaagtctggttatgaaccggagcactctcctggagcacatggcactcacctgtgtatcctcagatcaggactgggctgattcgagtcctcccacatgtcctttacttagtctcagggtcctgctcagctcattgctacgttaatacacgacgatctgtgaggtgtggtgaccttaaagcactcgggatcccttt

SEQ ID NO: 518833 - DNA, 87 bp, Homo sapiens
acttgaagggaaggaatcctcacaggtcagtgaagtaggtcaccaaacagttgtgataatcagcaccgagctgcgcgcccggcgtcc

SEQ ID NO: 518834 - DNA, 104 bp, Homo sapiens
tgggcttatggctggctggctggctgcttatttatttatttatttgtttgtattgttgtttgagatggagtcttgctctgttgcccagactggagtgcagcgcc

SEQ ID NO: 518835 - DNA, 141 bp, Homo sapiens
cacgcaccatcctggctagcaaggtgtccgctctgctcctgcatccagcgcaggcatccattgcccactcccgcatcgggctaacaggcttgcccattgttcctgccacagctcacaacgcctctgccagggtcacgcagc

SEQ ID NO: 518836 - DNA, 227 bp, Homo sapiens
caggaaaagggccagggccttgggttttggggattgggcccttaaagggctagttttgtggctgaaaataaagcatgtcccccccccccctggtgttttggcattaaaggttggagttaaaaaaaaccgggttgtgggaggagtaaaccctgggaaagggtgggggggtggcccgctgggagcctgatcctttttacattaattaaccccatgcctgccgggactta

SEQ ID NO: 518837 - DNA, 189 bp, Homo sapiens
atactctcttaatcggtgacactccgctccgagtgttttagtgcagactctgagcaagacatgtgcgcttcaacgtgctcaggtcatccgggggtgccggcaccaagaagcagttccagaaggttctgagcgctggacatcggcccgctccccacaatgaaataaagttattttctacataaaacaaaa

SEQ ID NO: 518838 - DNA, 215 bp, Homo sapiens
ggtgggagcaaaaccaacgcctggctcgggagcagcagcctctggaggtgtccctggccagttgtcccttccatcctgttccacaaggcatgggggaccatctttggccaacttttttttggggcctttttcggcaaaaaggaattgcgcatcctcatggtggccctggatgctccaggaaggaccacgatcctctcaaagagtttaaatctggt

SEQ ID NO: 518839 - DNA, 168 bp, Homo sapiens
gataccgccaatgcagctcctagaagcgcgttttgtgccgtttcggaggaagtctcctaggtgggtccatccctagctggctatgggtgggatactagggccagtgcaaacagggcttcttcatgccaaatcagacttctccgcgaaggagaagacgtttggagttgg

SEQ ID NO: 518840 - DNA, 109 bp, Homo sapiens
gatggcacgtgcagcttctacacggtgagaagcatgcctgcatcccagagcgaggaaggcgcccctgggttgacttacccaagtataaaagtttataattttacagcag

SEQ ID NO: 518841 - DNA, 130 bp, Homo sapiens
tgtgtcatgcactacgggcgtatgagtcagctcccccaagatgagctgcagcccccagagagagctctgactgtcaccaagtaaccaggccccagctccagagccccaactccgcccagcatctccccgc

SEQ ID NO: 518842 - DNA, 657 bp, Homo sapiens
cgttgggcccggcgcgaccgtcaggagcgtaaaagcgcggactagagtgcacagctccgggacgtggatcgaagccggtgcgatggtgcggagagcaggaggaggagcggttcgacgtgctatgttgctggccatggctcagagagatacgagggcggcgtgcaggagccttgtgaagcaccttcttacacgcttccttcgacgcagaacagactttttcattggaggagaagaacgggatggcagagaagattggccaggagagagaatgagtgccagcagaagaaatgccagacgcctaataaaagcatcagatcttgttgagaactcacgtcgtatcatgagaacagcatgggggaaaccatcctggtgattcgagttacctccagctggtactgcctttgacatgtcgggacattacaagttcaagcgttatcacacagacctttcagccaccaaaattcagttggcagagaagacccggcgggagaagagagcccggcaggagggccgagcggtgggagaaggcggaggcgggcggccagattgggcaaggaagccaagtcagagacctcagggccccagatcagggagctaactgatgaagaggcatagaaggctgcgggtaggagattgagccggaaaaaggatgccgag

SEQ ID NO: 518843 - DNA, 253 bp, Homo sapiens
cgccagcagctgtggaaatggtttaacagctggagaatagtaggcgtacattgagcgggactgcgggagtcaagaggcagcccagactgctgacggtagacaggatatccacgccacaaaggtgatgtggagaaaggcaagcagcaagccaccttcggagtcacatggccgaagaaagcaaaaacgaatattgcgggtcaactggcagcggttcaagcggagaccaagcccacttctattttttcacagatac

SEQ ID NO: 518844 - DNA, 115 bp, Homo sapiens
cccaaacccactccaccttactacagagcacctagccaaccattacccaataaaggataggcgatagaaattgaaacctggcgaatagatatagtacccaagggaaagattgaaa

SEQ ID NO: 518845 - DNA, 950 bp, Homo sapiens
tagaccgagcgagactccatctcaaaacaaaaacaaaaatttttttggaaatcccataaaaggacagttaggataaaaggtttgaggttgccttttttactattctcctagcggtctcaatcactaagtcatatatggtgccactggggggtggggctcctttaattacaattactcagtcctagaccgtggtaagggacatctcattaggaagtttgggtctccatcatatatatacaccaattcaatactgccgtgcacttgccgataagtgtcacacccattacaacagaggaagataatctcaacaggggtgcacgataacaaacagaggggcaagaatccagtggacatacgaggggtattcccgctgaaggaacgtgaccccatggttgtgaaccattacaggcttcacctgataaactttggttaaaagataggctggggtagtaggtggctcatcgccttgtaaatcccagcacttgggtgaggtggcatgtgcaacgagcatcgctatgacgcccagcatgttttcgagaccagcctgagcaatcttggggggaaaccccatttctggtgcaaacatcatgacactggcgctgggcacgaatggtgacactcttgttggccccagcatactcgcgacggctgaaacaggaggcacacttcaatgggaggccacacgaaggagcgtaaacatgcaaatgaccccagggggagacaaaacaagacgtgcccaacagccagaagccaaactactacctaaccgcccggtcccccatcatgccctaactaacaggatgtaacccgtccacgcccggcgcaacacatgtgcctctcaagtatacaccgggagaacaggattgcgcacttggacgccgccaaacgccacaaaaggggcaaacgcgcacccataaggatataacggcaaaacgagaacgcacatgcga

SEQ ID NO: 518846 - DNA, 282 bp, Homo sapiens
ctggtaaatggagggttttttacgacagaaggccaaggggggggtgttcggatggagtagggctgtgtgttgcgtggtgagaatggatcacatagtgggcgtcatagctttttacacgagcctcaagagccactggggccctttgtgccagatgagaggtgccgcttctgtgcgagcatgcacacgcgtgggcaggcccagtggcccaccctgagattctcagagtcttttcatgaggcaaatactttttctttaacctcccacgtcttccctcgtgggcgc

SEQ ID NO: 518847 - DNA, 876 bp, Homo sapiens
tctttcattccttcctccctcttgttctctttctttctccctttcattttttttctctttttataaaagcgagcggctctggggggggggtttgggcgctggggccgcccgccgaggtgaggtcgtctcgcctcccgcgcgccgtatgggtttgtcccatccaattggcccctctgctgaagttattgtatctggctctccccccgaggccggggtcgcctcactctggggacgcagcgatctccaagtccagctcaagaacaggcagaagggccccccatttcaatgtcgccccgccggaaaagattttggttctcctctccattcttctcccagagaccagacactcttctcccctcagaggcgcccccccataggtttctctctcccgggctccctataacagcagggggaacgccctcctcctcccccacgggggtgtaagatctcgggccccgggtctcatgtggcgtgaccaatatgtaggcggccatatttatagtgctccccccctcaaaaagaaaaagactctcctgtttgtgccctagcatctccctgtgtgtgtttcaccaacattgtgcaaccatttttttttttaacccccagatctcgcacatctctttaaaatgtgtgtgtgcgccgaggatatttccccacctgtgtgatggccccaggaatctgcggtggtatgtggggcaccccctctgttttattataccctcccagtgtgggggtaattaaccccaccgccgtggtcccccagagggtgcgccactttattcccctcaaccgagggaattttgtggggaagggaaggggcgaaaaggcccccaacggcggaagggttccccctttaaaagattggcccggccggga

SEQ ID NO: 518848 - DNA, 228 bp, Homo sapiens
tatattatgtcagtgctgtaatagcatatcactgctctgttctatcatcagcactctatgccttagatgggaattagtccattacattgaaataattatgggccatagggacttactatggctatttattatttttatctggtttgcagttctttcatttctctcttgctgtcatcttttgttatgtaattgtttttgtagtatatcatctactgattgaaccggata

SEQ ID NO: 518849 - DNA, 155 bp, Homo sapiens
gaaaaaaacaataaaagaaagggtggcaggagaaggacagctccaggagcagctccagtgccctcaaagagtccttaagtgtcaccaatgtggcagccttgaagaggagaagcgcagtgctgcagatccctggaagagcagcctccttctaatat

SEQ ID NO: 518850 - DNA, 441 bp, Homo sapiens
gtcatcgtcccagcttatgaattagaccatgccgacagttagttctcttgtactttagtgttacgtcttgctgagaatgatggttctagtgtctagcatgtccttagcgaggacatgaactcattcttttttttatggctgcatagtattccatggtgtatatgtgccacattttctttatccagtctatcactgatgggcatttgggttgattcccagtctttgctattgtgaacagtgccgcagtaaacgtatgtgtgcacgtgtctttacagtagaatgatttataatcctttgggtatatattcagtaatggcattactgggtcaaatggtatttctagttctagatccttgaggaatcaccacactgtcttccaccatggttgaactaatttacactcacaacaccctaggctcactaaacattctactactcact

SEQ ID NO: 518851 - DNA, 412 bp, Homo sapiens
  misc_feature (249)..(249): n is a, c, g, or t
  misc_feature (302)..(302): n is a, c, g, or t
  misc_feature (317)..(317): n is a, c, g, or t
gttggtgagcataccatgtacatagagtggaagactcaacacagtaaagatgtcaattcttccaaagatttgatgcaattcctatcaaaatcacagcaagatttttttctacgatacagaacacgtgtatgctaaacatttatactgaaaaggacaataggaactagatataacagaacacaattttgaaaacagaaaataaagggggcaatcatacagtgtaccttgatttcaagagcttattatatnagctatagataatacaagacaatatatatatacagctggggagacatacacangatcaatgaaatagnagtagaaaatagcaaaaacagatgaacacgatatgtccaagatgatttttggagagaggtgcaaaaaaaattcaatggagaaaaaataggctttt

SEQ ID NO: 518852 - DNA, 867 bp, Homo sapiens
  misc_feature (291)..(291): n is a, c, g, or t
  misc_feature (332)..(332): n is a, c, g, or t
  misc_feature (587)..(587): n is a, c, g, or t
  misc_feature (604)..(604): n is a, c, g, or t
  misc_feature (613)..(615): n is a, c, g, or t
  misc_feature (632)..(632): n is a, c, g, or t
  misc_feature (641)..(641): n is a, c, g, or t
  misc_feature (647)..(647): n is a, c, g, or t
  misc_feature (656)..(657): n is a, c, g, or t
  misc_feature (669)..(669): n is a, c, g, or t
  misc_feature (687)..(687): n is a, c, g, or t
  misc_feature (705)..(705): n is a, c, g, or t
  misc_feature (739)..(739): n is a, c, g, or t
  misc_feature (771)..(771): n is a, c, g, or t
  misc_feature (782)..(782): n is a, c, g, or t
  misc_feature (788)..(788): n is a, c, g, or t
  misc_feature (806)..(807): n is a, c, g, or t
  misc_feature (867)..(867): n is a, c, g, or t
tacatgattaataaaagtttgctgaacatacaatcttagatcattataaattctttttgaaaggtagactgggtgcagtggctcacgcctgtaatcctgacactttgggaggccatggaaggtaaaaagcttgaactcagaagttcaagaccaccctgggcaacatagtgggattctatttttacaaaaaaatacaaatattagccaggcatggtggtgggcacctatagtcccagatacatgggaggctgaggtggaaggatcacttgagctcagaaggtcgtggctgcngtgagccaagatcgcaccactgcactgcactccagcctggncaacacagcaaaaccctgcctaaacagaacaaaacaaaacaaaaccaaaacacactgatcttataattgagtgataaaactaaaaagtaatgcagcgctgctgcgcgcaagcaaaaatgtaaagcaggagcgcgataatttatgattttattgtgctttgcgctttgtcgcgggcgctttaacatgtttgctgtaatttaaataaaaatgctatttagctttgctgcgcattttaggcaaatggtttgctttagngcaacatagggttggcnctatagtgnnncatatgggttttgctantgttggcanaaggcnctatttgcnnaaagattttagnaaagctttaaataaaagnttaaattttagagagcancttaagataagcttgcgcaaatatgtagtaaaanagaatgcgattgcgcaaattaagaatattttngctaatatcgngcagcngcaatttgcagcaaatgnnatgctgcttaagcgcatatattttaatctgcgtaatttttgctagcaaaattttaatggn

SEQ ID NO: 518853 - DNA, 1674 bp, Homo sapiens
aaatgcattgcttgtaccttcctccttgaatttccctttgatatctgtctgacccactgctgtctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgacgagtgcgtggggcgcgcgcgcgcgcgcgcgccttcgtctctctctctctctctgttgtgtggtgtcccagctctccccgccgcccctccctttttttttccgcgcgtggcggcccctcctctcttgcgttcctctttttttccctccgtgcaggtgctgtcgctcctcgtcttctctctcctaccccaccacctcctctgtctgtgggtgcggtacgacacccgcgcgctgcgcctccagtgtggtcttctctctctctggtctcggcgcgccgccaactcatttcttctctggcgcctgcgtccaaccgtcaggtgaggaggtctctgcatcctcatctctcacactccctatctacatcattacactcactctctttcttggcgatgctacataccacaacacactaactacatcactacatacgttatctcaccacgatctcgagaaagttccccaccacacctctcactactacccattcccttacacgtcattacaatagctagcccgacacctcgtatccatacaccacacttctcacatagtatacttcatatcactcatatttcttcatccatctccatcacacctcaaattccaaacacaaggtacacaaccacctactccactcacaccactaccacacataacaaccccaataacacacccccaccctacacctacactactcccacatactcccaccacaccatactctacacacaacaaaacacacacacactaccagtctaatccacactacattccaccccaaccgacacgaactcaacactacactaccaactaacctcccattaactcaaagtcaacatacaaccaccaatcaccccaagtcaaccacacaacctcacagacactcccaccaccgacacccacactacacaatctcaagcacactaccccccccaccatcaaacacataatcaaccactatatacacacacctctacacatccacttacccaccacactatactctaatctatctctcacgacactaccacaaccatagaatcttaacatccatcacaaatactcatacatctataccacaccctaaactacacatccactccccccgtcctctcacaaccaatccttattcagctcatccaaacttcaacacatctacccatacaatatccaatctctatagcaactcttcacatgtcaacactaaatacaccatcacttacccaccctcacacaacactccaccacaacagaacgatccatacctctaacaaactcttcatctatacaacacatccatcactcaaccatctcaccgctaccacgatccaaaacacacacacaacctcacaatctaaaatcacacacacacatcacatcaataccacacctaccacaccccacaacactcatctccccgaccatctatcacaccacatcctcaacaacaccatatcacacacccaaccacacatcctatcaaaaacactaattccctcccacccaacatgctacac

SEQ ID NO: 518854 - DNA, 130 bp, Homo sapiens
tccttgattgcatttagactgattgcatttatacctttctgcttccggcggcatctaatggtttatatcgggatcgcgatatttcttttcttggtggggctgttatataagtagctcgtctaactgcaat

SEQ ID NO: 518855 - DNA, 215 bp, Homo sapiens
attttacattttcagcaattttttttttaccagtttagtgagcaggactgatatggttgatgctgtgtccaaatctcatgtcgaattgtaatccccacatgttagaagagggacctggtgggatgtgattggatcatggggtggatttcccccttgttgttctcgtgatggtgagtgagttctcatgaggtctggttgtttggggcgtacgggga

SEQ ID NO: 518856 - DNA, 210 bp, Homo sapiens
aattccggctctgtgaggctggatctgggtcaccatcacagggacactttttcacacattttctagggaaccaaccccttattcttgaaacaccttctataaaggaatcatctagaattttgtcttcatataaccagtatcgtaaacctctcgtggctaaaatgaaatcccctttttgcacctgtattccaggctcttttgtgcacggac

SEQ ID NO: 518857 - DNA, 300 bp, Homo sapiens
ggatggtattcagtaagtgacagactaccatcctcagggggtcccatgatccccattcctcctgactgggagaaacctcctagcagtgatcgacagacacctcatacagagagctccaactggcatctggatgggtgccgctctgggacaaagcttccagaggaaggaacaggcagcaatctttgctgtactgcagcctctgctggtgatacccaggcaaacaggatctggagtggacctccagaaaactccaacagacctgcagcagaggggcctgattgttagaaggaaaactaataa

SEQ ID NO: 518858 - DNA, 466 bp, Homo sapiens
cttgggggtttttatcttgctcaccgtggagataagcgtacggattgtctcaccagcgcagagcaaaggtgataatgcctttaggcaacatccgtcatggcacaacaaagctacacagaagtgtccaagcagcgttcatgataagtgttttcccatgaatattggattcatgtgtcccaccggctcagcctccggaggtaacatcatccagccacttatgacgaaggtccagaattatattttaacttgatgttgagcaccttataaaacgttagtatgtgtgttgcagtaattgtaaacataggaggcattttgttgtgttaggccgatctccactgtaaaggtccaagagtcgccagtatgtctgtgaagaaggcattgaaccaaataaaaagcttcccatggaggattgtatagaccttgtaattatatgtcaatatcgtgttaaaataaaatagcacttgct

SEQ ID NO: 518859 - DNA, 187 bp, Homo sapiens
cgtgtacctacatggtatggagtagacatcaacaacaggacattgctgataactttgaagcttttgtgttggagccagctattgtgcggatcaagtgccatgtacccccctggtgtgtaatggtcctccagaatgttgagaatgtttgtggcatcaaagccagcattgtcacacagctggcgtggga

SEQ ID NO: 518860 - DNA, 992 bp, Homo sapiens
atcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctactgtcttaacacatctgggatacccgactacacaactccagtgtaactggagtcccgagatcgacctccaagccacaggagcacggattccctgtacctcaacacgccagacccgtgtcctcccgtcaggcaccagcatccagatgtcctaagtgaaacggctggactcctacgatccaccaaccctcagatacgcccatgcctcgcagcactctggcatgctccaacgctccagcatgactgggattgctggtatgtcgaactaataccttcacctaactggagtccatgactaaccaacgaaatgcctgggatcctgggtacccccaatctactggagtccccagatacccgctcacgtccaactcacgtggcttccgtgcatcggattggaggattacaagtataatcaatataaacctccgacactgaggtctcaagatccttactgctgacatgcacagatcccatgacaattcaatgcactacgcacttccacaccccaaggcacctggatcaccagattcccaagaccttcagaccaccagattcgtggctcctaacaacaagtgcgggggccacagtggcacagacaagtggatcctggcaactgcagctgctggattccagattctgggtacccaatccctctgccagtccctcaaagttgaaaccttaatctcttgaacggcagatcctgatattccaagggaatggaatcacaaagacctggaatccccggttctgatctgaatcattcaagggccgggtcccaatgttcaggccccaagtctcagatctgggcaaacaaagacacagagtatcca

SEQ ID NO: 518861 - DNA, 324 bp, Homo sapiens
atccggttctagaaagcctgttctcatgacccatcctctccttggggacttgttcttcacacagtcccaaccaacccctgttttcctccctttgcagacaaaggagagctgtttgtatggggcaagaacatccgagggtgcctgggaatcggtcgcctggaggaccagtatttcccatggagggtaaggctggccggggaggtcatgagactggatgctaagagtagagtcacctgacgtcactgcagacacctcgcgtgcagatgggccaggacgagggccatgggacctgctcccccttccgggtcctggctgcactcctgc

SEQ ID NO: 518862 - DNA, 1413 bp, Homo sapiens
  misc_feature (1041)..(1041): n is a, c, g, or t
ttttaccgggatcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccacgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaantggaagagaccagcacctgggcgtggacccaacagagcgttattgacgaatggcagtgagttccctcaggagctggaggccgcgggaccgacccaggcaggcctacgttcaccaacctgttcatattaccacctggtcccccttcgagaacgactttgggcgtggacccttctataaggctgcccggcctcagtggttactgcccgtcctggtgtgtccctgtgctggcccaggtccagctgtggccccttgggacccgagttccgggccctggccgggcggtgtctcctgggacacggccctggcgggggcagagccccggtggcggcgcgcgggtggtcccggcggggcccggggtgtcgcttcgtgccc

SEQ ID NO: 518863 - DNA, 271 bp, Homo sapiens
ctcgtgctccacagcctgcaccgcccagggaaggacgggaaacagcacccagaagaagcttcttcccaacaccttcatgatccaggtccagagggcagtgcacagcagatccacggtactctgccccactgagcttgcatatcagacacacattttcacggacgcagggatccgcgccccccgtccggcacgagcatcaccgtatccggcgctgggccggctctgaggcgccaggaccgagggcggagggggcgctgctccccctcggagc

SEQ ID NO: 518864 - DNA, 918 bp, Homo sapiens
  misc_feature (830)..(830): n is a, c, g, or t
ttttaccgggatcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccacgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggtgcggggccggggacgcgggaggggcgcggggccgaggcagccttgaagtgcacgaaggaggcggggnagagacttcaaccgagattgcgacttctcctttctgcccgccctggacaggggacacttggaccccgcgcccgcagacgaggggtgcc

SEQ ID NO: 518865 - DNA, 370 bp, Homo sapiens
aaaggaactgggggatgtgcagggccccggcagggtggtcaccagcagagccgcccctccctccctggggtttgtcagctaacagagcatttggtggaagaaagacagcccagctcttgccatgattgggagccgcagccctctttagatgaaagggggaatgtgtaaaggagaaattgcctctttataaagagcccagttgtttccttggggccttttttgtttttcagagtcattgccgtcgagtttttgctttttggcccccttttggggtcagcttactgcatgatcaaagatgatgtttccctctttttacttttcctcagaagattgagctgttttttatttggagaataaaatgaagttttga

SEQ ID NO: 518866 - DNA, 2318 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518867 - DNA, 1049 bp, Homo sapiens
  misc_feature (938)..(938): n is a, c, g, or t
ttttaccgggatcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccacgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaagacctattcaacgaatgcttgaaaactgaacaggcttttcccctgcaaaacaaaatcagaccagaacttctgaaaaagttagtctccgtgaccaataatactaggcacgtttgcatcagctcggtcacacaagtgtgggggagacgccagtgtcttgggcacctacttcccatcctgnaaagcgacggatagaacctgtgatgggaagattttgcctgggctctcatggggagatagaaaagccgagcttatgcttgagtatggatgtgcataaagagcccgattgaac

SEQ ID NO: 518868 - DNA, 710 bp, Homo sapiens
ctaaaggggaaggcccctttttattaaactggtacattttactttccttctttcagaatgctaataaaaaactttggtttatacttaaaaaaaaaaaaaaaaacaaaaaaaaaaaaaaaaaaaaaaaaaaaaaaaaaaaaaaaaaaaaaaaaaaaacaaaaaaaaaaaaacaagggggggcgcgccgcgccgaaacatcattcctccctacagggggcgcaccaagatcaaagccgaccccgaccgagtgttttctgtgaaacaacggggcgcccccacaagaggggcgcgcgactaaaatacacaagccagcagcgaaactgcggcggcgggtatataacaacgagcgtgtaggacgtgagaaccagctggcgacagtggaggatcacctatggtggggaaaaagaagacccaccactattccggggggggggcgaacaacaatctggggcggaccacacaccacaccaccagcaagaagaaattatatataagaccatgatacgacgggtgagtaacaaaataataaatattattacagcagtgtgttataatatgggggggtaaacaaaacaagcggggcatagtataatgctgctggccgatctgaagaagagtctgtgtgtctaggagggagtattatttctttgcaagaatgatttttatatatacagaagggggatattgtgtttaaaaaacaagggagagag

SEQ ID NO: 518869 - DNA, 1154 bp, Homo sapiens
aaactcattaaggtgcttcagtgtaggcagggccctggcgcgttttatacaattggcagagctctttggttgtttgattcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518870 - DNA, 1493 bp, Homo sapiens
  misc_feature (1121)..(1121): n is a, c, g, or t
ttttaccgggatcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccacgccgccccgctgccccgaacgcgggccatacgcagcctccttgtgatgttgactgtgtgcctgtacccctgtgactgacccctgtgccacttggacatgaccctgtgtgactgacccctgtggcctgtgtggctgctgcctccttgtcgtgtgctgtgtgctgtgtgctgtgctgtgtggtgcttgtgtgtgatgcctcttgtgctggtgtgtgcatagctgtgctgtacattggccttcggctggttgtttgatgggggcactgtctgcctcctgtgaacaatgttctgtgcgctgtgctgctggtgtcgaacgtgatcctgcagtcctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaantggaagagaccagcacctgggcgtggacccaacagagcgttattgacgaatggcagtgagttccctcaggagctggaggccgcgggaccgacccaggcaggcctacgttcaccaacctgttcatattaccacctggtcccccttcgagaacgactttgggcgtggacccttctataaggctgcccggcctcagtggttactgcccgtcctggtgtgtccctgtgctggcccaggtccagctgtggccccttgggacccgagttccgggccctggccgggcggtgtctcctgggacacggccctggcgggggcagagccccggtggcggcgcgcgggtggtcccggcggggcccggggtgtcgcttcgtgccc

SEQ ID NO: 518871 - DNA, 1059 bp, Homo sapiens
gggcatggggtgggggattccatcaaaactgttgtttttttgccccatgatttttctttggtcagtaggagtgctggattggcagtgggctgattattcccctggagctaagctcagcgagcccgaagcggagagactgaggactgactcccttatcctcttcatattctttcattccctagccagattggatttactctctctttctctttttctttgcgacaacggatgtctccgcccctgtccgccagcgctcgggagttgtcgtgggactgatctccgatctcacctcgccaaattctcgtcttcaccggtgttcaagccacattcctccctaccctactacacccctccacgaagtaaacgcctcgcgcgatacaccacagcgcacttgttccccccacacccgccaaagactacactgtctgtggttctttttacagcgctaagaagaagcgctgggttacacccagtgtatgtgccccacgagcattgcgcctccctcagaacattcctcctaatgaacccatcgactagaactctttacgccacagccctatgtgaccaccacacaagaacgcttcatgcaggacgaatgctatacacacgcgagtctagtacgacccccatacctaaccccccaccgcaccccccagtggagcagtacaaaacaccctttcagcgcctgtactaaacagccgtggcacgcgtcaaaccacaacgagggtgatgctacacacacgcatgcgaccacaacacgcgcgctgccggacccggcgcacccactctacgacgacacaagcactagtgagcactactttaaccgaccacgcagacaactgtggcgtcacaccgacccacttacccccccctgaccactgccgcacacaccactacgcgaccgcctagcacgacagcgcaaacctctgcaaacaccggtgcccacctaccaccaacacacacgcgcaactcagaaaccacttcccacggacactcgaccgccccctctacgacagcgtggacagaacaacgaccccttgggcgtaaccactggggcct

SEQ ID NO: 518872 - DNA, 134 bp, Homo sapiens
actgttacacacgcatattgacatcctcccacgtcctcttggcccaccacctctgttcacactggttcttgccactcttactttttcattgcttttctttgcgcccgtgttctgtttcttttctggtggtctcg

SEQ ID NO: 518873 - DNA, 2144 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacgacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518874 - DNA, 2060 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518875 - DNA, 252 bp, Homo sapiens
agactaataaaaggagctagctgctctacggcatcttgcttagagtaaacttaacctggctttaagcagtagtactgccccaccaaggtctaaaagcatttttggagctattgcactgtgttctcctactgcaatattttcatatggaagatggtttctcttcatgtagtccttggaattgattctaagggtgatgttcttagcactttaactcctgtcaaatttttttgttctccccttctgtcgtcttct

SEQ ID NO: 518876 - DNA, 1319 bp, Homo sapiens
  misc_feature (313)..(313): n is a, c, g, or t
  misc_feature (361)..(361): n is a, c, g, or t
ctattttctctgaatgtccgttttatcttgcagctatgtgaatgcaccgcctagtcattataaagaagaaagagaatgcagagtgcccctttcctggatgctggattggctatggccctgggcacacctggagttgttgaggatgtccgtttccatggcgaggctatagaacagtgggcgcccttccaacaggctagagcctccatgtctcagtgagggccatcttcttgctcccttgaagcttgggctgtcctctgatgccatgttgtcagcccagacaggcagtgtgatcagggctcctggcaagggtctnttgagacacagccactgcccctgcttggtggtcgtgacttgggacgcngcctgcctgtgactggagctgggggtgacgggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518877 - DNA, 1011 bp, Homo sapiens
cttcctatgttgcccaggctggtctcgaacttctgcctcaagtggtcttcccaccttggcctcacaaaatgttggaacttctgggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518878 - DNA, 188 bp, Homo sapiens
tagtcatgtacactgaactgatagacatcactatctttattggaacacacaatttatataacactcttcctctggaataatacactttttagtggacaaataccgagttgctccctctcttctccccaccacacctggcgtgtggtgatggatgactgtggtcccagctactcaggagactgaggtgg

SEQ ID NO: 518879 - DNA, 2655 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaaaaaaaaaaaaaaaaaaaaaaaacaaaaacagaaaaacaaagaaaacaaaacaaaacacacacaacccaccaacacaaacgaaacaagaacaacaaggggggcccccaaaaaaagacaccaggagagaggagcacgaatgggaaagaaacaacagaaacggagacagagagggcaacaagagagaaagcaaaaagaaaggagaggagccgagcacacaaagagacaacacgccgcagagcagcggacgcggcagggccggcaccagacaagaagagaaaaaaaggagaagagaacaaaggcggggcccacgcccgacgcgcaacgaggcgacggggga

SEQ ID NO: 518880 - DNA, 1783 bp, Homo sapiens
  misc_feature (1286)..(1286): n is a, c, g, or t
gcgcaggatccggagtgaccgtaggcaggcatggcgacccagccggcatgtgcatggtcttgaagccactcatttccaactagagggaactggtcatgcaggacgcggttgtgatcgtgatggattctaaccaagaccaggagctcgtcaagatcctgcgagacagtaacgggccggcatagaccgaatggacgtcgcgcagcatcagacctcgcgacgccctgcgattggtgtccccattgccggacccaatcggtgcagcctgtgccccacagggtacagggtgagcacatcacgacacagggtgggcgcagcacgagacccggcaggctttccagcagccagtgagcgtagccttccagaggctggggctcggccaatttcaacagagaaggactgggtagggtcccctgagcacactattactggactagtatatcgtagtgggggaatcgcggaaggggaacgtgccgagactagcaaaggtttcccagcgagccaggtacccatggcctatggggccaaacgggttgtcgacgcctgtcgctttggaacatgtgacgaatacctcggccattccactaaacagcggttcgacttacccgtacattttcccaccgcaaggggaaaaggtccccccttcaggggaacgcgcacccaacaaggaaaaaggggtggcacgtaacctaaggatttccgtagaccgttggacgcagcaatagcctttgcacataggctagtggcaccaccacgccgagtgcgtagtagcccggtgaacacagggattctaggtggcaccgcggtttcccggagaaaaccgggtcattcattagaaagaacacggcgaacgaacaaaggcctccaggaaaggatcacatcacaccctggaacgggacacaggcatgaaatggacaatttttggcgaacaaaggccggctttgccagccattacggttccgttcgccgggctagttgggagccccctggttgggctaccaaagcagccaccccgaggcattcgtatcgggaggcaaataaccggggtgcgcaaaacgacagaggaggccccacagggaggaaaggggcctgagcacagcaacacaacggggcattgggtatggacacacacaggaacaacaacacacactttaacgcagtggccccagttcacctttggtggggaggaacaattttatggggagcacatccaccgtgtgacagtgggcagaagaacacagagcagacgcacgatgagacacgcacaaacacctcaagcgagagggcancaaacctcattgaggagcagagggcgttgcgtagacaaatgacaacaacacaggagggtaacaagaaccacgatgggtgcacgaaggcgggccaaactcaacgggagggattactccggagcaacacacacgaatatgatcggtgggtccacaacagccgtggcaaaaacacgacggacgagaaacccccaatagagggagagacacgagcataaaggcaggacaaagacaccacggataaaaccgcagtacagagcagacacagtgagaacaacagagaaaggaaagcaagacaaggagaacagggaccagagatcagagacaaagacacagcagatcagcgacagaagagcacatcgacaacgagagacgaaagagactgtaaaaacagacaacacagcccgcgaacagatagccaaagaacgatgcaaaagacacaagacagacacagacagaccaagcagcagacagagagaagacagctcaagaaggaaaaa

SEQ ID NO: 518881 - DNA, 852 bp, Homo sapiens
aaaaaagtccaaagtttttaaaaactgaaacatttataaagtaaaaacttaacagtaagctaagtttaatatattattaaagaaaaaaaattgtttttgagatgggatctcgcttgtgcccagatgggagtgcaaggcactaccatggctcactgcaccttcaacctcctggctcaaatgatcctctcacctcagcctcccagtcctcagctgggactgcaggtgtgcgccaccatgcctggctaattttgtattttttgtagagatggggtttgccgcgctccccggactggtcttgaactcctggactcaagtgatctgccgacctcagcatcccaaagtgctgggattgcaggagtgagccaccatgcccagccaagaaaaattgttttaaatttagtgtagcctaagtgttcagtgtttataaagtttataaagtctccagtagtgtacaataatgtcctaggccctcacattcactcatcattcacctccgactcacccagagcaacttccagtcctgtaagccccattcatggttaagtgccctatacaggtgtaccagttttggccttttatacgtgtgttttttattgtaccttctctatgtttagatatagtttcagatactcaaaatacttagcactgtgttataaactggcctacagtattccagtacagtaaacctgcttgtacaggtttgtgggcttaaaaagtaatagggtatatcatatagactatgcttagttagtatgttacaccatctaggtgtttagcgttacaccattcccggttctggagtacattccgggggtccccacggcaggtttctctgaacttttcgggctggga

SEQ ID NO: 518882 - DNA, 2342 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaatcctttggcgtcccctttaaaaagacaccctaaaagggggggctattttttttttgccctggccccct

SEQ ID NO: 518883 - DNA, 2252 bp, Homo sapiens
  misc_feature (582)..(582): n is a, c, g, or t
  misc_feature (588)..(589): n is a, c, g, or t
  misc_feature (591)..(592): n is a, c, g, or t
  misc_feature (600)..(600): n is a, c, g, or t
  misc_feature (604)..(604): n is a, c, g, or t
ggccagaggctgttgaggcgcggaactggaggatggcgctggtggctgttggtgtgctggggctcggttgtggcggcggctgagcgggcctggggctggtggcgagggcactggactggctgtgcgtggctgctcccggaccgtcgcgaagcggcagaagccgaggcggaggtgcccgtggtccagtacgtgtggcgagcgcgctgtccggccgatcgggtcttcgtgtggggcttcatcttctcgcggtggctgctgggcagtgccttcctttgtggtgcccagctctcgaggactcccgggtgccccgttgccggcagctccagacgcagacctgtgagtgatccagacccgtgcctctatcgtctggagctggatcaaaagatttcatctgctgtcttgcagtgtatggattcacatttgctgtcctctaagactgcggatgttaagaaagtcttgggcgtgatgggactcaacaaggattctcagcttgtgatttacacaggagccgtgaaagataatacgaggggctactgagtatgtgttggagcccgttcagccgtctctcttgcctctggacangacctnngnngaccacgngtcngcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 518884 - DNA, 341 bp, Homo sapiens
agtggcttcttgatgatggcggtggaggtggtggttgtagtgtgagggatcccctttaggttatttgggggtatatgtcccctgcttgaaccctgaaggccaggtaatgagccatggccattgtccccagctgaggaccaggtgtctctaaaaacccaaacatcctggagagtatgcgagaacctaccaagaaaaacagtctcattactcatatacagcaggcaaagagacagaaaattaactgaaaagcagtttagagactgggggaggccggatctctagagccatcctgctgagtgccctgtgtgtaagtcctaataaactcacctactcaccaaaaa

SEQ ID NO: 518885 - DNA, 444 bp, Homo sapiens
tatggaagatggactggaacaaggacccagccagttaaggaggcttagaatgctgggagcctgacctctgcctgtggtatcacctctgcctgtgataacagacaaaaccaggaagtgtatttactaaaaagaataaacagtgctcggtgaatggtgagaggaccagagaggaaatgggaataagtaataggcatgtggccagcagaaaaaggagccaatatataagaaagcaacaagtaaactgctcccctcgatggcagtgggaagcctgctgggatggtgggggatcaggaaacttctctagccctggaacactgagagagacagaagtgatcactgctgtgttggaactggggaggggtggggaccaagtgaccgcagatcagaagtcactgaatatcaacgccatggagagagagctggctctttcgttaagagttgcct

SEQ ID NO: 518886 - DNA, 760 bp, Homo sapiens
atcagctgccagcaccgctagaataaagcaggccgaagaaggtggaaggagcagaacttgctgagtctttctggccttcgtcttcctttcgtgctggagcttcctgccctcgaacatcagactccaagttcttcaggttttgaactcttggacttacaccagcggcttgccacatggtctcaggccttcaactacagactgaaggataccctgttggcttccctacttttgcggttttgggactcagactggcttccttgctcctcagtttgcagttggcctatcgtgggacttcaccttgtgatcatgacatctccaagaacttcgttcactgaagtcttaaacccctcacagtgacccatgaggattggaatcagcttctttcaaactcttactattgttgatattttgatcgcttcctatgaatcgtgaatattttaatgacatctaaaatgtgactcctggccgggcacagtggttcacgcctataatcccagcaccttggtaggtcaaggcgagaggatcactttgaggttagaagtttgagaccaacctgaccaacatggtgaaacccctgtctctactaaaaatagtaaaaattagctgggcgtggtggagaatgcctgtaatttgagctatatgggatactcagccaggagaatcgcctgaacctgggaggtggagattgcaggagccgagatcgcgccatgcactccagctgggtaacacagtgaggactccacctcaaacttaatacctc

SEQ ID NO: 518887 - DNA, 124 bp, Homo sapiens
ttgaggactcccagtgaactatttataaggtctaatcagtgattatttttccagctccgtgttgctctaaggaattatttcacacacggaccatctttagctagtttccccagtgtggagagag

SEQ ID NO: 518888 - DNA, 402 bp, Homo sapiens
tcatttataaagtcagcaggatggtctctcaaccaccctgtggtggtgtctaacaaatttatcttgtcatgctcaatgtgtttggcagcacaccgatcggctgggtgctgaaccgcctctctgtaattgtagcatcaaaatgacaacagcagcagagcagcgaatcttgcacatgcccacagcatgtctgtgacaatactccaacaagtaataattagctttttttctcctggcgcctacagtacctgtctaactaaagagttcccaaagtggagggaaaggccatagaatccaggtgtcattcagagccagtccttgctgaaatgtggtcttccagtggaagcacctgtattattgagaggcaaaagtgttgggtgccaagtaacaccaggactagagaga

SEQ ID NO: 518889 - DNA, 441 bp, Homo sapiens
  misc_feature (191)..(191): n is a, c, g, or t
  misc_feature (324)..(324): n is a, c, g, or t
  misc_feature (326)..(326): n is a, c, g, or t
  misc_feature (331)..(331): n is a, c, g, or t
  misc_feature (339)..(339): n is a, c, g, or t
  misc_feature (342)..(342): n is a, c, g, or t
  misc_feature (346)..(346): n is a, c, g, or t
  misc_feature (349)..(350): n is a, c, g, or t
aattggtacctaatttgtgtactcagcaaagccggtgttagttataggtgttaggactctagatcgcacacagacactgtgcgtgggtttgatggggaatgattacaggctggtcgagtcctcctcactgacatcatgtctcatcgacttcccctgttttgaatttgtatcccgtaaatggacagagaganacgcagggttctgccctgggagaatgacagccacagcgctgggtgccgtcaggcggcttcgtgtgcagttagcgtttcacaaactgagaagagtataaaaaagcccaaaccccaaagatttcttatttcaagngnctaantctagaancanagangannagggatataagagctcccctctccacacgacgagagggccctccatgcagggcagctcgcccgccgcctctccggaaggcagcaggttcac

SEQ ID NO: 518890 - DNA, 320 bp, Homo sapiens
aggataaacagacgacgcggagaaccccttttgctaaaaacgctagtacatgaggtaaaaatggggcgcatctaaaaataataagagctacctatggcaaactgacagccaatatcatattgaatgggcaaaaactggaagcattccctttgaaaacgggcacaagacagggatgccctctctcaccactcctattcaacatagtgggggaagatctggccagggcaattaggcaggagaaggaaataaagggtattcaattaggaaaagaggaagtcaaattgtccctgtttgcagatgacatgactgtatatctagaa

SEQ ID NO: 518891 - DNA, 293 bp, Homo sapiens
tatagaggatcccgtcttcttaccctgggttgggaactaggacgaaacaggtgaagcccagaagagaagtaaacacatcctgcagttggaagacagggaggttctagggaacatcaaatgagaatggccaataagtgaaatctgggatctcgtcttagcacaatgtaagccttttctcttcctcataacaagtgcacatcagatgagtcgactcaggatcgcggtagagatagcgatggcgatgtcgtcatcatggtcataagtgtggcctgtgtgcgatggtcatctgcgag

SEQ ID NO: 518892 - DNA, 294 bp, Homo sapiens
ggaggccccaacatgcacctgtgcagccaggacttgagggagcacagtgtggtagaaagcgtggatgccaggcggtcagaagaacttggttgagtctgtctttactgacaggcgttgtcccagggagcaaaatgcacactgtgagctctagtttattcaaatgtaagcaaaggatgatcgaacctgtgccatcttcacaggtttgtgtcaggaccagatgggttgaagtagatgaaagtattatctaaattataaaataccccatcattagtaaaaagagcacgcacttgcata

SEQ ID NO: 518893 - DNA, 1043 bp, Homo sapiens
aataaggctaggtacgaggctgggtgttgaatcggccgagggaaaatacaaaatagggggcaggcacagtggctcatgcctgtaatgccagcacttgggaggccgaggcgggcagatcacgaggtcaggagtttcagaccaatatggtgaaaccccgtctctactaaaattacaaaaaaaattatccaggcgtggtggtgcacgcctgtgatcccagctactcgggaggctggggcgggagaatcacttgaacccaggaggcagaggtggagtgagctgagatcgcgccaccgcactccagcctgggcaacagagcgagactgcatctcaaacaaaaacaagaacaaaaacaaacataaagtggcacagaaaagggaccaagtttaagggaaagggttttaaatgtaatgagacttgcatagttaaggaaaaaaagaggaaaaaaaggaaaaattcccttaaaggggggggggggcccccaaggcctaaagtcccagctttaaggggggctgagggtagaaggggatggaaggacgcctcaggagtccggaagaccagcctggggcaaggggggcggaaacccccggctcttactaaacgaaaattaagctggggttgggggcgcagggccgccgggtagccccagggtaccggggaaacactggcggcccggaaaattgtggaccctgggaagtggggaggtggccggggtgagatcacaccaatgggaccctccaccttcaaggagaatggtgggaccgtggagtggcgttcgcggaggtggggaatcacccaaggactcccgcggggaggggagacggtgccaaaaacaacagagaaaaaattctctcaccggggagggacaaaaaaactcccataacgcttcaccggaaggtgaggactgacccaaaggagtgcaggggggcggccaaggacacacggattcaggactatacggaacgccaccggcgcagaaaggggaagcaaggaggagaacagcggtagcaggagacaagaaggccacggcccgacggcgaaccggt

SEQ ID NO: 518894 - DNA, 1089 bp, Homo sapiens
  misc_feature (51)..(51): n is a, c, g, or t
tgtgtttactccactcaagtcgtggttaagatatgcagtctttcgaggagntctcacaggtggaaattggacgcggcgtgaaacattcctccctcgttgccaatcttccacttacacgaagtgtatatttaccaatctccttgccgcttgggacggtccggtgctccaatgtctttctcggtccctgcaagtaaccggctcgaagtcctctagaggttcagtcgtaaccaacgccctcactgtggaggtccttgcttcccctacatggggcctccatggtgtccatcggcccccaaggtttgctggacaaagctgttctacccccttaggttgctttgggtggtggccaccccttgtgtggcccacaggcacgtgctcctggccaaagtcaccattcatcaaccggggttcctcctctcaaacaatctatatccaatgtctagccccgtgctctatgtaatgggccaggccccacctttctggggaaggccaaggaggacatcgggcaaatatacgggtgcgcattgggtcctgggggcttgcttcctcgcgatcctccgcgtattttacgtgcctcagcctctgtcgacagtgggccttggaccgttaccctctccgaacaatctctcccagttgctccctggctgcccagcgcccatctctgaccataacgacctgatatctttgaggagaggaggcaagggagcgatttagcgggcagaaaggttgagaaagcattatcggctcgggtctcggtgttcgttgcccttcgccgagacgggtcatgtagctgttccagtggtggcacaccagcggcaaggcaaaggggccactacctatgcacgtgcgcccatggtaaaggtggacccgctgccattgtaccacgcacgccctggccatgttccctgctcccacaggaatagaatgggagggagcgtccagaaactttccatcccaaaggcagtctccgtggttgaagctagactggatattttgcctctaagcgctctgacgcccttgtccctctttgagggaggggagctatgctaggacatccaacctgcagggactcgggtggcctgcgctaga

SEQ ID NO: 518895 - DNA, 201 bp, Homo sapiens
  misc_feature (97)..(97): n is a, c, g, or t
  misc_feature (118)..(118): n is a, c, g, or t
  misc_feature (130)..(130): n is a, c, g, or t
  misc_feature (162)..(162): n is a, c, g, or t
cagccaacatggcggcggaacgggcgcgggagcagcaacagtcgcaggagatgatggaggaagaacatgagctgcctgtggacatggaaaccatcancctggacagagatgcagaggntgttgatttgantcactatcgcatagggaagattgaaggatttnaggtactgaagaaagtgaagactctctgcctccgccaaa

SEQ ID NO: 518896 - DNA, 206 bp, Homo sapiens
ccaagatcacgccactgcactccagcctggaaggcagagagagactccgtttcaaaaaagaaaagaattctgggtttgaatcctgcctctccgtctgctagggataatgatttagggcaagttgcttgagctctaatgggcctctgtattcacgtctgtatgatagaggtggtatagtgttccaatgtctttgtggtttgtaaaag

SEQ ID NO: 518897 - DNA, 282 bp, Homo sapiens
tacgttaatatgactagctaacacaatagcttgctagtagagctacctctttacggacaccagttatactccctaatagcccatgtcgaaggccccatcgctgtgtcaatcgtacttgccggagtactcttcaaactagggcggctatagtatactccgcctcacactcattctcaagcccctaacaaaacacattgcctaccccttccttgtactatccctattaggcataattataacccgctccatctgcctcccacaaacagacaggtgcagcgtaga

SEQ ID NO: 518898 - DNA, 453 bp, Homo sapiens
  misc_feature (104)..(104): n is a, c, g, or t
atctagaggatcgcctatgttctcgatccgttacaaaccataagagaataaagagaaataactaaatgcaattagaatcctgaaacagaaaaaggacatcaggngtctctccttccagcacagtacgagggcagagtaggacgtgtagtgctgggagtcatggcaggaaaagcatttagaaagtttcttaggcctgtaatcccaacattttgggaggcaaaggtgggtggatcacttgaggtcgggagttcgtgaccagcctgaccaacatggtgaaaccccgtctctaataaaaatacaaaaaatagctgggcatagtggcgcatgcctgtaattccagctacttgggaggctgaggcaggagaattgcttgaacccaggaggcggaggttgcagtgagctgagatggtgccactgcactccagcctgggtgacagagtaagactccgtctc

SEQ ID NO: 518899 - DNA, 139 bp, Homo sapiens
ccccctggatttggttgagggctcaggacacaggcccagccccccccaggggcctccacaggccgttgcataacagcgatacagtacttaagtgtttgtgtagccaaccaaagaataaatgattcatggttttttttta

SEQ ID NO: 518900 - DNA, 346 bp, Homo sapiens
tccccgcccagggtttgcatttacgacaaggagagagcgaccacgcaccgttaagtccaggcggctattattgggggacatggggctacacgatggcggctggactggaattgacttcctgacctgagatgatccacctgcctcagcttcccaaagggctggaattacaggcgggagccaccatgcccagccccaggaattccttcttaagcatccttaacaaacagttaaccttgacatcacttgcttaccgttgatgataggcacctcattactgcaggaaagggcctttttctaatgcttaatagttggggatattcacttttaaaaaacctttgaattttga

SEQ ID NO: 518901 - DNA, 522 bp, Homo sapiens
tctcatccttctgaatcctctgtcaaactggtatattttccttcaacttttcaatcgttcttgctcttatattcctctagtcctctggcgaacttgctctgttcttgtccttcctttcttccagttccatgttagattcttctacaagttgctctcgtgcctcaacttgggccaggaagtctatgccagcaagaataactctgctactccaggtgagataatttatccatgctaaagactgatgctcttgtatgggctttaggaagatctttcccccgttcctctaattcagctctctccttgtttcttatcgtctacttccatgtcgagctttgtatcgagtgctttcctgtccgcatcactttgtgtttgcttttgaatcatcgtgtgtggggagactgtcgggattccccttctttttctccttgtctctccatgttctccggacttaacctctttatcctcatcttgctctgacccactgatatcagaggctgagatttcctctccttcttcaagctt

SEQ ID NO: 518902 - DNA, 378 bp, Homo sapiens
gaccccggggtccgcccaggggtccgccccgggggccgcctaaatttagactttgccttgggttgggaatttaaatgataggcccctttttttttaaaacccaaaaaaaaataatgaacccccggggatttgtagggtggggggtttttcccttttttccaggggggaggggtcctaaaaccttttccctttgaaggggtttgcaggggtagggggggggtttgtttccaaggttgtttggggtttcataccccccccaatttactccccaatttaaacccgggggggggggcaaacccccaaacgggtttcccttttttttcggggatttgggggtttttcaaagggttttttttttttaagcgggaattttcccca

SEQ ID NO: 518903 - DNA, 456 bp, Homo sapiens
  misc_feature (17)..(17): n is a, c, g, or t
  misc_feature (47)..(47): n is a, c, g, or t
  misc_feature (246)..(246): n is a, c, g, or t
  misc_feature (451)..(451): n is a, c, g, or t
gaactttcacctccccnggttaaaattaaacccctaaaaatttcaancctttttggaaattaggggtaaattggaattattttcctggatttcctataaattatttattatcatactcatacttggtcaggcctctgggcccaagcctgcatgtatacatccagatggcctgaaataactgaagaatcacaaaagaagtgaaaatggccagttcctgccttaactggtgacattaccttgtgaaantccttctcctggctcagaagctcccccgctgagcaccttgtgacccccgtccctgcccaccagagaacaaccccctttgactgtaattgtccactacccacccaaatcctataaaacagccccacccctgtctcccttcactgactcctttttcagactcagcctgcctgcacccaggtgaaataaacagccttgttgctcaacntaaat

SEQ ID NO: 518904 - DNA, 120 bp, Homo sapiens
acgatcagcacgtaccagccacattgattgtggcaattacatcacattcccccagtgatacagccaggagatcccaaataaattcttaaaacagtcttatgactctttaaggtcagaaat

SEQ ID NO: 518905 - DNA, 198 bp, Homo sapiens
catgtgtccgcctctggtctctgtgttctctgccctgcgcagttgttcatcctctgtcgctctgccatgtaccgtagctatcgggagccgcgattgtgcttagtggacagcattcttcaaacatggcctcttttcaacttttgtttcgtaggctttatttttcagcgcctctttcggttcacagcaaaattgagtgaa

SEQ ID NO: 518906 - DNA, 794 bp, Homo sapiens
tcctccatttacctttttaaagggggtctcaaaatcctggggacaaattttggggccaagtggttcccattaaaaaagtcactggtatttaaaaaatctaataacttaaaactggccacacgcaacaaaagagaaaaccaaagtggggcccacaaaacattctccctttccttctggagggtgtacacagatggctattggtgtagtcattacccaggtctttcaatctactaaatcttaatgtgggccacattggaaacacaacatgttctggaaaccgttcttccacccatctggattaaagatgggggggtggcgcaggtgttatcaagggcgataataatcctttaagcgcctatctgagagctattctggggcaggatctgggtggaaccttggccagctccagcagcgccttcttggtccactggtttcggatggtaccccaccgaaatttgggtcggtccacatattcagcgaacagcaagagggacccaagagggggatagccggaagaagctctcaaccacactgtgggctgtgccaggacccatatcaccaaggggcagcatccaccaacaactctcaaagaaattacggcggcctctctctcaagcgtataaccagaaagggggggacaaaaacctttcctaacaagctcagaacaaatctgcagtgcaaggtagaagcccggttcaggaacacaaaatacagggggcaaaacccggggacaaaataggcggaggggcaggaaaacaccgagcacagtgaaaccgctgtccagcgggggcacg

SEQ ID NO: 518907 - DNA, 125 bp, Homo sapiens
tgaggaaaaacaacggtacggatcgtgtaagcggatgacagtaagcatgacgtagcttgtgaaggccggcccacgtgccatcccagggagtcaagaggccccaatgggtttttacttgtttctcg

SEQ ID NO: 518908 - DNA, 670 bp, Homo sapiens
acgctgatctccagacagatgtactcaagaacatcaggtgcattctacctattctggctatagacagagtagttagaaggcaagtaattaaccatagagcagactttgaagaaaatgagattctttgaatttgagacaaagtgctgaaaagtagctctggataatgtatttaggagacataggaaatggctcaacaggaagggtgaaatagccttaccagtctggcctctttaaatttgtttcaagcctgtttcccttcactgatacaaatcttactaactctgcaccttccacagaccctttgttatgtgcagctgtttttgtttgtttttatgaaattcacttgaaacgtcattggacttgaatttatacagtaaaaaatcaattaactagattcttaaattttctcttccactttaaatgaagacacctaacggtttgaaaccttctggctctgaggagaggaagagggtccccagatacaggtttcaattccttaccatttagtctggttccattgatcaggggttcagttttctcaccttaaaataagaggattagaacagataatttctaaaattatttttaccaccccttttctcttttctttctttaattcctgtggcgttctctgcagtttatatgtccctaattttatgaaatacttaag

SEQ ID NO: 518909 - DNA, 313 bp, Homo sapiens
atgatctagaggatccctccctcagctggaacaagagtgagactctatctcaaaaaaaaaaacaaaacaaaaaacaggggaaattaaaccccagccaaaagtgtgtggggttcatctataataagaagcggccctatagttccctccaaaaccattttaaaaacaccccctaaatatttattaatataggcgcgtgcataccttataaattattttattccaaaaagggccccttgaaattccggctaaaagggtcctgtggtaccaggggggccattcaccttcagagagacgcgcttttttttcttggacc

SEQ ID NO: 518910 - DNA, 127 bp, Homo sapiens
ataggatctaacctcaaggaagagacgtgctcccaccaggcagctccagctgttacctgagatagtgaagtgcagcgtcaggagacgattatttaaaccatgcgccttggttttaaatcgttcattc

SEQ ID NO: 518911 - DNA, 502 bp, Homo sapiens
  misc_feature (78)..(78): n is a, c, g, or t
  misc_feature (213)..(213): n is a, c, g, or t
  misc_feature (257)..(258): n is a, c, g, or t
  misc_feature (300)..(300): n is a, c, g, or t
  misc_feature (308)..(308): n is a, c, g, or t
  misc_feature (355)..(355): n is a, c, g, or t
  misc_feature (360)..(360): n is a, c, g, or t
  misc_feature (384)..(384): n is a, c, g, or t
  misc_feature (392)..(392): n is a, c, g, or t
  misc_feature (397)..(397): n is a, c, g, or t
  misc_feature (416)..(416): n is a, c, g, or t
  misc_feature (433)..(433): n is a, c, g, or t
  misc_feature (448)..(448): n is a, c, g, or t
  misc_feature (453)..(453): n is a, c, g, or t
  misc_feature (466)..(466): n is a, c, g, or t
  misc_feature (469)..(469): n is a, c, g, or t
  misc_feature (472)..(472): n is a, c, g, or t
  misc_feature (476)..(476): n is a, c, g, or t
  misc_feature (481)..(481): n is a, c, g, or t
tcagggctttttcaaatggacgccagaggccccaggactccaaaccatgggctctcacctcggcctctcctttggggntgggccctgccagtctctccttcgagctttcccggcacacgtgctttggcctccaggtccgattcctcagggtggccttcaggccattcggcaatgccaacccccccaagtgggtgggacacctaaaccccaacnacgcctatgtcatttggattttaggctcccccaacgaggacccnncggccaaggtggcagtttgttccacgggaggacagttgtttnttttccancctcctggccttcggactttgaatttgggcaggaaaagtcctcagtnccaanaccaggagggggcaatgggcccancctttttntggtnttttatgcaggaagggctncagtgggtcagaacttncaaacccaacttttnttttnagaaactggctgnccnatntttnaaaanaaagtgccctgaaggaagcca

SEQ ID NO: 518912 - DNA, 913 bp, Homo sapiens
catttttctactaaaacaaacacagtttactttaggagagactgcaactagaatcaaaatttgaaactggaagatcttgtttaaaagggttaagttgaggcaagaggaaagccctttctctctcttataaataaggcacaacctcatcggggagctaccagactaggtcatctgtcatggtgaaagaaggagaagacatcgtttttatatttcaggaaattttacataagatgataggaaagcacattctatgctatggtctgaggcaggttactgttatgggggcgatggtgttgaatcgtgaaagggctgcagctgatggtgagtactagaataattatccagttgcatgccatactctcatcatctgccagtgtaaccctgtacatagtatagaaaagcaattagacatagcactatgtggatttaatagtatataaatgtgacattcaatgcaaaacttgtattatatgatattctacaaattcgactatgcgttataccagtataagactagacatgtctggagagcctaataaatgttcagcagactgaggttagttcaccaacagtcttacacaacgcccttgggcccagagcacccatagagaagttattcaggccgggctggagtgacatcacctgtaggacgctttataaaaggtctgaagcccagttacatcctcagacctgagctacaacgcaaatctctggggctcgaaaaccgaagcatgcggaagttgggtaaaacgctacctgagggtcattgcaatgtgcggccaaaagttgagaactactggctagggattagccacgcaggacctgaacctgggcaggaaatctgaggtggtatgtaatctcaggctaaacaagtagacaaaaaacatcaattggcgtgaactaagaacagaag

SEQ ID NO: 518913 - DNA, 148 bp, Homo sapiens
gttggaaggcggttgcagtgcgcttcaatgagcaagggaccaaatgatccggtcaacccaggacgtatttactccagttgcagtggcagcctatgaaccggaggttccagcaaactctagtacctagctctgccggagagggcggatg

SEQ ID NO: 518914 - DNA, 1124 bp, Homo sapiens
  misc_feature (680)..(680): n is a, c, g, or t
  misc_feature (684)..(684): n is a, c, g, or t
gggtccaggcagccgggtcgggccgcgggcccagtgtggggatgcacgcgccgcggggtgggagctggcgccatcgccaaccaagaaacttgcacgtaggccaagtataaggagctgagggacggtcttgaggtgaggaccacgggtacggcgccaggatgtcaaagcagctgggacatgttcaagaccaaccttggaggaatttgcacagctaaacacatggcaggagatccggaaggactccatgcagttccagtgttgcagttccgaggatcactgtgtgcgaaccacttgtgcgtggcagtccagctggctcgtctggagacatgggagtgtctgcggtctggagatggctggtgcgtgggggacgttctagttagcgaactaggtgtctcaacagttactgcgacagtgtgcctgggcgctgcaagcatcgggacatggacggtcattgaatagagcatttgcgcaggacagctacagtcagagcagggtgtgtgcatacgggaatggtggcagaagtattcgcacgcgacggattgtcagctcaagagatgagcctgactcgaggagcctatcacacgaaagctaaaacggcaactgtgtgtcgaccctggggccttttctggggcgatccgagtcgcgcatgttagtgcgtcggagtccaccgtgtcacgccntcantttcgagcgttcctggggtgttcccgagacagtggaacgtcgtctagattgatttgtggagttcgaccaacccgaattgggtgtcatagctaggcgtggggcaagaaggacagaaatggtcgtaaccgatgggaactgcgttccaagggtggtaaggactacacaccaggcgccaggtacctgtcacacatgggtggaagcagcccggagacgcaaggcgacgaaaacagaggttgggctagagaaaaccactcctgcgttaagaagggaaaagggggcttggggccgttgtggtggggacctttaccatgggctcgctcgaagagggaaatggccgcgaacataacttggggtttgaccaagcatacttccttccatttgaacctccttaggatcccaagggaagacttgaccacggctggagggagcgcccgaaggac

SEQ ID NO: 518915 - DNA, 394 bp, Homo sapiens
acagccctgaatgggctaccttcgggctttatctctggcttctgttcctaccagattaaggtaatctctaaggtttcaccatatagaagggtattatctgccatgtagggaatgaaagatgcactttttctaaaatcaccaaagtctttaaacctaccttagccactggcacctaaagccacaaagccttacacatggatttcctcttcacaacttgaggttccctgtacgccatttataagacgggtctcttaaaaaggcacctgtaaaacttaatatatatcagcatcctctgtcactatctgcagtctccatctctgtccagcacacgaggtgctctataaggaaggggtctcagacagtgagcaaaggtcctcgtgccgaattcctgcag

SEQ ID NO: 518916 - DNA, 492 bp, Homo sapiens
catatgtagaaagctgaaactggatcccttccttacaccttatacaaaaatcaattcaagatggattaaaaaacgtggcggtggggggcagttccaagatggccgaattggaacagctccagtctacagctcccagtgtaagctatgcagaagacaggtgatttctgcatttccaactgaggtaccaggttcatctcactggggcttgttggacagtgggtgcagcccaccgagcgtgagccgaagcagggcgaggcatcacctcacctgggaagcacaaggggtcagggaattccctttcctagccaagggaagctgtgacagatggcacctggaaaatcgggtcactcccaccctaatactgcgcttttccaagggtcttagcaaagggcacatcaacagattatatcctgtgcatgactcggagggtaccatgtccatggagcctcgctcattgctgagatctcagacagcactaagcaacatgagtta

SEQ ID NO: 518917 - DNA, 158 bp, Homo sapiens
acagggatattgttgcttctaggttctctcagctgacagtggaagaaaatacttgacctaaagatctacaatggcttgttcaaattagaagaatgttacatgtatatgggttattcattttggcatttgtaacatgcaaaagaataggaaaacaaccc

SEQ ID NO: 518918 - DNA, 330 bp, Homo sapiens
acgcttcaaagtaactattaagagattcacatttgttgggtcctgctcagagcccagaaggacaacagccaagtgtttgggttgcacgtaagggacataaatatataggaagctcacatctctgttttcattcattcttgcttgaggctgtcatgaatcctctggatatccaccagaatgctcatataagtcagtgcatactcttacctgaggtgctttctcttgctcctggcctgagtcacattgcttggaactatggggtggggattaggaagtgagaggttcgaaccgtttctgcctcatggccaagactttgaatggcgtctccgt

SEQ ID NO: 518919 - DNA, 505 bp, Homo sapiens
  misc_feature (146)..(146): n is a, c, g, or t
  misc_feature (159)..(159): n is a, c, g, or t
  misc_feature (177)..(177): n is a, c, g, or t
  misc_feature (240)..(240): n is a, c, g, or t
  misc_feature (252)..(253): n is a, c, g, or t
  misc_feature (256)..(256): n is a, c, g, or t
  misc_feature (259)..(259): n is a, c, g, or t
tatagcaagtagctttacagtacagatcttacaattaagtttgctttgttaaagtgtgtaccattttttctgttggagtaagacaaaaatgtttgacataggttccctagggtacacttgctctagctactttaaaggccactgtngcaagtctacatnttatgctgaatctgcatnctgtcaggcacccatagaaagacctcagtacatgcttgcactctccttgctccctttttccantttcttatgcanntcnttngttgtaatacagaaagcagcatttttaaatgtccgtgttaagaattggccgctggtaccaactcacctctatttggtcagtgtcatagttggaagatttggtttgtgatttcagagaaagcagaaggtacattttgcgaaataagtgtttcagaataaagataatctcacttttaagtgatccattttaaaatttgtaattcaagtaaagttgggggtggttaaacataacgaaacagacaaaaga

SEQ ID NO: 518920 - DNA, 675 bp, Homo sapiens
cggacccccctgttctatccacttacagactttacttcgtgtttcattcttcagcactcagagttctgtgcctaccaaaactatcctcctctgaaaggtgcaaaccatattaaaattgtgctgggcattataacttgtattgaaaagccaaatgcttactacttgagcatattcagagttagtaggaagagactgcctggtgatacacatcaagtttatgtacggggttgattactgaaccctatctcaatgaaaatgaggaaatgaggagtgaccattgtttggataacgcggtgcttcccagaatgcttatagtggttcattcttcccatgaatacacgcaatcctctgaaatcctgatgtgaccttggcatgatttaccaatagcctcttttacatttattttccaagatccagatgctgttctctagtgtgtttgctgagtgtgcaataatatggatcatttattttgaagcagtacttcattacaacactttcttcacagggctttccaaaggaagaaagggctaattatagaaaagaatcttgtctaccatttgtgagggaatatttttgtctgtagatggttggattattttcacattagggaggttcaaataagaagaaagtgctgacgttttctctcctctccaagtatgtggtggtggtcctgca

SEQ ID NO: 518921 - DNA, 147 bp, Homo sapiens
ggatctccatacaagagctgtaatgttcttgtacaccggcttctccaccggcactctgttgtagtacggattgcagtccttccccaagaacgtcaaattccaccacgtgttggcaaccatcggcctccgggttgcagctggacgtgc

SEQ ID NO: 518922 - DNA, 740 bp, Homo sapiens
tagctaggtgagcctggagtaaatcggccgaggctcagcgtcctgttagccgaaggtctgtttcctgctgtgaaatgtcttcctggactggcttcggaccaaccccgacctcatcatcgtgtgtgcgcgagctctcaaagtctgtggaaccgcctgtctgtgttgctgaatctgttgcctgctgctggtgaactccaggagtctggcctggccttgtgtcctgaggtccaagatcttcttgaatggttgtgaactgcctgacctcccctctagccttcgtgctcccatgaggacatggctcttcgtaacctgcccccgctccgagctgcccacatgacgctttaactttgacacggatcggcccctgcatcagcaccttagaggagtcagtggtgcgccatctgcgtgcatccgcagacttagtgtcataatcaatcagcccgacctgacaagggcagacatacctacaggtatcaaccacagaggttggcagtcttcggtcagacattgacaccagtcgtgagcaggagagcctgctgcatcaggcccaggcacagttccgaatggcacagtgaggaagctcgtcggaacaggctcatgagagacatgtgctcagctacgacttcagctcgaagtgtctcagctggagtggcagcctagaacagccaaggcccagtcagcatgtctccctacctcgtccctgacacccaggccctctgcaccatctccctgtcatccgc

SEQ ID NO: 518923 - DNA, 385 bp, Homo sapiens
tgtttgttctgctctcttcatataactagttggcctccccttggcatccccgtaagcatcatatttgtgatcaccttactgtgatgttccatcagcccagtttatgtggcaggtgtctcaggcctattatcacccatcatcatgcttgcaattttccccatcctccatgatccatgcccaacagtatttggtttcgcccgttaagccattctgttttttgttctctatccgcggacctccccattgttacatgtatgggaggacagccagttattagcccttttcccttctttggcccagtagctgccgccttaagcttcccgtcaatcttaatcctaagccagactatctccctaattgaaaccaaaattccctaatgggccta

SEQ ID NO: 518924 - DNA, 156 bp, Homo sapiens
  misc_feature (8)..(8): n is a, c, g, or t
  misc_feature (85)..(85): n is a, c, g, or t
aacagggnctggagcaaaataggaaataacatctttctaaagttaggcttagaaggtctaatccagaactagagagtttctttgngcggaacagagctgattgatacctgggtgctagaccaccatttacaggtatagccaagaaaacagggtata

SEQ ID NO: 518925 - DNA, 393 bp, Homo sapiens
agggaccttatctatctaattcatagctgtagccctagcacctagcacaatgtctggtacataataggtgctcaattaatgtttgttgaatgaatgaaggagcatctagtgttatcactaaagaaagattagaacccagacatgatgttttctcctcactgctgatcttcaggaaattgtgtcatcagatagctgccttttgagtcaatgccagccagtacttgtaaaagagcttcaaaatgtagaacctacaggatctgacttggattcctagggaatgactccagtatacccaagagggagacaaaagaggtacttgacattaagagtttacgtggaaagcttttggaaaatattttaaaaatattaacaattttatttaaattattaaat

SEQ ID NO: 518926 - DNA, 269 bp, Homo sapiens
agcaaagcaaacgactattgtactcggtcctttcccagcttggtgggcggcatatgcctgatgcagggtgatcgtgacagggaagatgttaccagtattacatcctgggttgtgcagacacgacagtatctggaaagagttgacgccgaaaatcgggaaatcagccagaaaaaccagcgtctgactcggctttacaatgcgctcagcctgtgcaaccagtctatcgtgcgcagcagctctgagcaggagctgtttgagccagtacggcg

SEQ ID NO: 518927 - DNA, 165 bp, Homo sapiens
gagcgccagccctacccataaccacaacgtctcaactcacaagatatacggctaccgactcccacagccccgcaatatcttcttgtcctagtgcgattaaacggcgtattccatcagccaaaacttgatatcaaggctggcttcggttcttgttaacacgattgg

SEQ ID NO: 518928 - DNA, 291 bp, Homo sapiens
  misc_feature (136)..(136): n is a, c, g, or t
gaccctggccccacacccctgctccaccagccgtaactagagctttccttggacaagagactcgtttcagtaacttttccctgataagagaccctgaccatagacgggttctggctggtttacagagattgcaccntcatgtgccttcatgtcctgaaagtactttttgaggtataccacctaattgtaatacgcttacatgctgccttcaccccaaggtgaacatgggtcatatgtaacatgcatgtttatccagcacacgtgtccgaataaacatgcatgtatattccg

SEQ ID NO: 518929 - DNA, 230 bp, Homo sapiens
tgtcgtcgctagctaagagaaataaatccagtcgatttttaaagggagatgaggagtgttccagagatagtgacactgagagatatgttttaggaaataaagaccaaagcaagctacttagctaaggaaaactttgtggaacaggtggactttgagacgattgggacaagaaaaggggaagatctttggtgaagaacaaaggtcaaatgagcctgagaaagatggaggtg

SEQ ID NO: 518930 - DNA, 110 bp, Homo sapiens
tgtaagccatgcttttttccttcttttcttttctttctctctctcctctctctcaccttttttccctttctctctctctctttattatctatctgggatggagtctcacc

SEQ ID NO: 518931 - DNA, 265 bp, Homo sapiens
atttgtactaagaagtccactccaaaccatttttttaatgtgtgggcagaaagatcacttgaattttaaactggcatttctctcccgggattttcttatatacccaggataatgatgttaattaccattacagtagacatacttttgagggaagtcatagtatatacaatcttatttgtatatcatagaaattgtttctgatctatagaaactatggagcttttcctacacttcttaggcttatgcagaccactgttcttattgg

SEQ ID NO: 518932 - DNA, 890 bp, Homo sapiens
  misc_feature (50)..(50): n is a, c, g, or t
gctggcgtgcgcggagacgcagagtcttgagcagcgcggcaggcaccatngttcgctgactgcagctccgtctgtgctgcggcctgcatttccgcggtccgttctagtgtgagatcgtggtaagctaccgggctggccggcagtgttcagtgtccgttgctgcagccaagactagtaagcatgatccgctcgactggagatcgaggcggagaaccattactggctgagcatgccctacatgacccgggagcaggagctgcggctacgccgtctggtgctgcaggagggaggccttcgaggccttacacaggcgtgcgcacatttccaagttccccccgtcatagattcattggctggacgcagctcgagcatctcgaatgtcaccatgaaatggtcctaatcctgatgtcgtcagccttggacttttatggatcacggagctgaaccatctttacctggtccttggagacctgagaaaagctgtagcttgtgtgaacaatgagccttttggaccaggtctttcattaaaagacagaacgaaaccattgaagtagtctgcgaattatcggaaatattctagagctctaagatccccccaaatacttgaggagtctagattgcgtgtccttgtggttttcatttagtcctgatacggaagatagggaatttcctcgagtcacaagatgcatattttgacaggaaaagcttgcaatacgagaccacagatgaatttgaaggtcttgtgctttagagtattgagaattactttgattgggggggcgtatatcattgcaacaataaggtttggcttaacctttaagcaattggccccaataaattggaaaggagaatattgagcttttcaggttaaaacatatgtcctaaaaacg

SEQ ID NO: 518933 - DNA, 162 bp, Homo sapiens
agaaacttcaacctggactttgtataatacgttaggtttatttctaacttctaaaatatgtaccgattgggaaacacccagaaaaaatatgagttcaaatgcataaattacagacataaattatcctgtgatctgcgagcagtatccctccccgggatacag

SEQ ID NO: 518934 - DNA, 821 bp, Homo sapiens
gggcctttgtgcggtttccaacatgccggagtggacggtgaggtcgcggctcataacgggggcttctcatacaggcggattatcaagagtgtgtccatgaaagacctcccctaaaacgagtgtgttttgggacaacattacttgggccaaacccaagaagtgcccagtgtccccatttaagaggggaccgtaaagattacaccacaacaccacacgtcttgaatattaacccgcaacaacagccaacacacaacaaaagtagagccacacaacaaaccaccactgtttgtgttgggggaccagccactacggtcgccccacagtagagaagaagaggggttttttaaaaagcacgcaccactctgacggtagtggtgggaccgtcaggtggtaccccaccatgtgaaggaggtaactataggtgccgacaacaacgtgtgttgcccacaaaacaagcggtgtggtttccccaagcaggagagaagaaccaccccggggggggccaacaagtaacacaaacaatggtggcgcacggggagctatctccctcaccccacacgcagaaaataaaaaaaacgaccggccgctgtgggggggcgaggaccaaacaccgcgaggaggcgttctccacaggagacacaaaacattctccacgaagaagatgggaggaacccacagaagggagcgcgacccacaaaacaaacgaggggggggggaccatactaaacacaaccaacgaagcggggggcaaccaccccacaaaaagaagcggagaacgcgccgacagatgaattaacactaacaaaataatataagcacct

SEQ ID NO: 518935 - DNA, 284 bp, Homo sapiens
ggaaaaatacgataagtacacatcagagatcatcacattccagacaaactggagtctccatcacagatcatagagactcatggacacccatggacaatcacttgtagtgatttgtctttgatcgacaacaatcccttcagccttatgaactccatgcagtgatagtccttgtatctcacattcattttcccacaggagattctgaatacacatcttaagatgtacttcctttgcatttcctggtacttcaaatgtgattgtcacaatactctctactctggaaa

SEQ ID NO: 518936 - DNA, 365 bp, Homo sapiens
ggtagaattcttcattctttctccagttccactgcttgcttgaccagccttaaagacacacatacacatttttgtctgggcgcgctggctcacacctggtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctcaaaaaaaaa

SEQ ID NO: 518937 - DNA, 368 bp, Homo sapiens
accgcgcccagccttaaaagccaggtttttagccccttctcccacactggctaacaactgggggggtttgggccaatgcctacctttttttggaccttaatttccccaactggattttgcaagggtcgaattcaatgaattttgacctttttttcaaggttgacaatttgggaatctggactggttatttttttaaaggacaagttgaaattcaaaagggaaaaacccttttaaaatcttagatgcctgggttgaaattatgagaaaatgtaaaaaaaagaatggccctgctaaggaactgggggggcagcccatgtgcctaaaaaagaaaaattaattggggctggaaagtatttgccctgggggta

SEQ ID NO: 518938 - DNA, 255 bp, Homo sapiens
tatggactgctcagtgggttacgatccggcgttgccgtgagctgtggtgcaggtggcagacgcggcgtcggatcctgcgttgctgtggctctggtgtaggccggcagctacagctccaattagacccctagccttggaacttccatatgccgcaggtgcagccctgaagagacagaagaccaaaaaaaaaaaaggaagcagcaaatgtttcactgtaattctaggttctaaggtgacccggaagaagaaaatgat

SEQ ID NO: 518939 - DNA, 211 bp, Homo sapiens
tcaaaccacgcattgtagctcttttagagttcaaaagaagaaatgggctcgaataatcttttgaaacgctaatgtagtctccgccggatagtgcttaaaactattcctctggattcaccatctgttgacatggaaatgtgagagaaaaagtactatgtgaacattgaccaagccagcatttgttttttgcttccttatgtacaatgtgata

SEQ ID NO: 518940 - DNA, 143 bp, Homo sapiens
agagggtgtaaatctcgcgccgggccgtacccatatccgcccccacgagccggctcgtcgggtggctcgtggtggtggtgcatggcgcttggtggagcgatttgtctggttaattccgataacgcaacgagccacacgaagag

SEQ ID NO: 518941 - DNA, 215 bp, Homo sapiens
cttccccaacgaatttattggttgaggaccaaggaatcttgtcaaggaggtaaagaaggcaaacaagattaggaggttgttcctttggtaaataaagaaggtcaagaagaatttacaaataatgacctttccaccaattcagggttttattgggtatacctcaaggaatattttacctcaatgcaattttacctcttattgcctttaatgccttt

SEQ ID NO: 518942 - DNA, 445 bp, Homo sapiens
ccagactgtcacaggttgtcatgtttcattcatattcattgccacaggtctctccccatcacccaggcctttcttcagctctcctcatgtcaatgtctcctctccagtgatgaaaccgaggccaacatcattaccgcctgctatcaatcattcagcctgtactgcgtgctatatcagtctctcctgtctacttgacttatcgcatgttccatttcctattttgagatctgttttagactcaccgcgtgtgcactacctgtgccttcccctgatttatactcctcagtccgtctcagcctgacgaagttgtccatcatagtatcccactagactgagccctttcggtcacattcctgttcgaacatttcaattgaccatgctaagccacagagggagaccccgatctctacgcaattattctgttatatattagctgggggtggtg

SEQ ID NO: 518943 - DNA, 432 bp, Homo sapiens
agtagggcggaggaaacaatcagatatgcagagggatgactgagttctgtcctgtgtccctatgcagctgcagaagataagccatcaatttacattatcatggtgaacttcagcagaactgctttagggtgaagatcttggggaccacaaggaattttcttgtgggcaaaatgtgaggaagttacgtagcttttcatctttgtagctgtcttatttgggaaccaaaatgggagttaggtatgtgtaatccagtttccagcttggcttttacctttggcttagtgaatttggggtcccaagatttcttttccttatatttttgtaacaagagttacagaggtatctcatggacttcattaaaaggttgaacaaacagaccttaaaagagcagataccaggctgggtgacaagagagaaactccatctcaaaaa

SEQ ID NO: 518944 - DNA, 162 bp, Homo sapiens
cacacacatacatgctcactctccctgtacacacacattctccctgtaaacacacactctccctgttcacacaccaagcacacacacaccacacacacgctcacacacgcaaacacccaccaaaaaccaaaaaggttcaaattagaacctttcaccccacac

SEQ ID NO: 518945 - DNA, 96 bp, Homo sapiens
  misc_feature (9)..(9): n is a, c, g, or t
ggcggagancgtccagaacgccgtcaccactcttccggtgaaggcaaaatacgcgtcgacagccagccaaccgaggaggccagttgccacaccgcc

SEQ ID NO: 518946 - DNA, 202 bp, Homo sapiens
  misc_feature (164)..(164): n is a, c, g, or t
gatgtccgcgtgccatgtatgttggacgctgacaaatatttctgtgagtgttgcagagagctgctggacacagtggataactatgcctgtcctccagctggatatagttgtggttggtacttccgcctggaacagcgtggaatgccttgattgatgcagaaaanaaaattaagacttggcccaagaaattgcttttaaaaat

SEQ ID NO: 518947 - DNA, 155 bp, Homo sapiens
atgcgtctcagctcccatcaggttgatgcttctctaggtcttaggagtgatagtcatcgctgtcgaggtgtcatacaccaggttgttgcgaacatactcctagagaaacgcacggggtaccagcccacgactcgaattgaagcagcagggagatg

SEQ ID NO: 518948 - DNA, 134 bp, Homo sapiens
gggaccacacataaggaaatcacaagggtattgattgggggaagtgataagtgtccatgaatcttcacattatgtcagagctgttagtccaagaggacagctctttgcataggaaaaaccttgtagagaagtaa

SEQ ID NO: 518949 - DNA, 370 bp, Homo sapiens
tcgataaggccaacaaaagtatggcaccgtgcatttgtttctagtaaggcctcaggaagcgttccagtgatggctgaagggtgaggggagagtaagtgtgtcaccgtaggtgagacagggagcaagagggaagggaggaagtgccagacctgttaaactaccagccctcacatgaactagaagagcgaggactccctgatcaccatggggaggccaccaagccattcatgagggatccgctcccatgacccaaacaccccccaccaggccccgcctccagcattgggggttacatttcaacatgagatttggaggggacgaacatccaaactgtatgcccagaggtccaggtacctcctccctgtccttg

SEQ ID NO: 518950 - DNA, 230 bp, Homo sapiens
gacattgatggctgctgactgcttagggtggtggttgctgaaggttgggtgacagtggtaatttcagtgatttttgttttgttttgtttctttaagagacagggtctcattctgtcactcaggatggagtgcagtggtacgatcatagttcactgcagccttgacttcccgggctcaagcaatccttctgcctcagtctttccagtagctaggaatatcaagaatcggca

SEQ ID NO: 518951 - DNA, 414 bp, Homo sapiens
  misc_feature (95)..(96): n is a, c, g, or t
  misc_feature (98)..(98): n is a, c, g, or t
  misc_feature (226)..(226): n is a, c, g, or t
tgtgtcttgctggaattggcctcactgtccaagctgagtgcttgcctgtgaggaagcactgcttgggcagaaataaggatggcaggattgcctgnngntagaaatagtgatcatgggatcagaggcagcaggtgaatgtggggtgtgaatatttttgaaggcttggaatgaaatgattcttccagactttagaggatttgtgtctgcagattcttctctaaggttngtgtctcacatagtgagagaatcagccagccagggaaatgggacaggattttgtctctttccccatttcctcttctaatgaactcctacctatgctttatgactgcattaaggggtcacctcctccaggaagcattccctcatctccttacgctggttctgagtgtgtcgttcctgcttgatcccctc

SEQ ID NO: 518952 - DNA, 1439 bp, Homo sapiens
  misc_feature (769)..(769): n is a, c, g, or t
tggggtggaatgttttttaaagtatcttctatgtatgtgggtatggaggaacataattcctggtatttataatagtggtgtatcaacaaaacgtgggtggtgaaataaatggataagcttatatgggcctatgggggctatctcaccccgagggctaaagaaaccctataaataaaactattgggtgtccttttttaaaaaaatatggtagtcctataataaatattatcactatatatttatataagggtgcactatgtgtggatggtgcctaatatacacatatggcgtatgcgcgaatgtgtgtgtggtatggtactcaataccaaggggggtcatacccagggtatatatcctactcacagagtctccacacactatatgtgcggactattatctctatgtgagagtgtgtacagcagaaaccctatgtgtcgccacactaatctctctctctctctctctctacacgctctactatatgtgtgagagatagtgtgtgacacacataaaactatcacactgtgtgtgtaacactcttgggtgagtgtcactactctctctgtgtgtgtcgcccgagagacactgtgtgaggtgaagagtagtagtctctgtgagtggtgtcctcacaactctgagactcctctcacacagagaaagtgagagagcgtctgagagagagacgcccccctcccgggccgtgtggaggagcgtgtgctgtggtcaccaccacgggtcgtcttctcatcagacgggtggtggtcgaggncgcgcctctcttctgtggggaagtgtctctagggtcgccccgtcctgtggtgttggaaggagttggtgttgtcacaacgaaggatatgtggttgtggttattgcggagagagttgctatcatctactactcctcctcattctgctgtggggcggtggaggagtactctcaggggggagagcttctctgccgtggggtggtgctctcctgcgggtggagtccccattagaagaagaatcgttgtgtaaagagccctgctgtcatgcagagacgactatgctcagggtaggagaagaacagacaacggcgctggtcgtacaaaaccaaaagaagcgggcccaagattagaaaacaaggagggacacaagagaggacgaacagaagggtcctcactggtgagacgaacaacagacttatgacgagccaatgaatcgagcggaccgaaaaaccacctgagctatcaccccaaccatggatcgacgttgggtgggcgcccaccacaacgaaagaggaaggaaagacacaataccagcaccatagagagggacagaaaccccaaccaaaaagggaaccacagctatcagaagaaaaacgaaccacataggacacaacaaaacaaacgatcctcacaccacaccaaggaggggggaaagctagtacaaagaacaaac

SEQ ID NO: 518953 - DNA, 1098 bp, Homo sapiens
gtgcgttgaagccggatgaccgcgggtcggccctcagcgaggaccctccgtccccgtgatgccgccggccggagcctgctagcctcttggcggcatgcgccccgcggacaccttgttgccactccgcctcttctcgccctccgagcggagtctcgggctcggtgaccgtcctggtggccattggctcgatacaattgctagtactccaatactgtgtgcagccacgtgtcgaacaatactgagctgcggccatgactatatgcctttggcgtgcgcgtcacaacgaggcatcacctggccacactcagagctcatacccacaggattacgtacaccacgcctttttgctatcatgggtagcaaagtgcctacttaggaccaagctccaattcggaccaatttgaccgtccgtatctccggccggagacttgatgtttgcaaccttggagggaatacagatggaaatgattcacaagggactcgacacatcgtaaggaaatgacaactggagagttatcgatacccaaccacatcgtttcaataggcgatcgccatgggcaaagacaaatagacatcttaccagaaagaacacagaactcgagcggatggatactggacctaagagaaggattaagaagatgccgcgatgcgcgagtcacaccatttgcgaagacgcggagacgacgcactagaacagaggaaccgcaggggacaaagagtgaatcccacaataggggtgagaaaacgaaaaggcgaaggagaacgcacaaacagcaagagaaccgcaaagggcacaaatcacattgggggaagcgacactatgaccatatagcggtcagagttacgagataatacgccaggcgaagttgtccattccgggagatgaccatcagttaccccgctatacacaaaacctgtacacacacacagcaaagaggtaccagtaacgacgatggcaaggacagggcgaaagcttagaggatcgcccacaaccaacatatagagtaacacaaaaaaggggacacgaaaccgacaaacaatggaggagacagcaacaacaagtgtccccccaaaatggaataaacacaccataatagg

SEQ ID NO: 518954 - DNA, 496 bp, Homo sapiens
agaggatcccccggctctgaacttaggatagcagtagcaaattagtgaaagtactaaaagtctctgatagcagaaataatggtgtaagctctctctctctttctcctctctctctctgcctcggctgccagggagggaaggaccccctatccttatgatgactgatttacgttcatgaccgatcccatgctcatgatttggagccctgtgcgtcgctcagatgtgtgctgcaactttgagaagttcctcatatgggccgggggggccgagcctgcctgacgctacagtggcagcctatccgcgaaccatcgaacattgagcgctgacatcaatgcgcctccttgaaatgttgccatctagatgtgaactgctcaagacacagatctcctactccatccagtcctgaggaggcttagggatgcggcatgcctttacaggagacactgctggacctcagcattcccttgataatcagtcccctaagttcagagccagg

SEQ ID NO: 518955 - DNA, 177 bp, Homo sapiens
caaaggtggagtggtcagggcgggctgggcctgggacaggccagaagatgggtcagagtcattctccacacttccaggtctgtagcgcgacgcagtgaggctccgatcccgcccgtaatatgaagtggcagctgcagtaacagcagcagcggctgctgctgcagcagcagatgtggc

SEQ ID NO: 518956 - DNA, 324 bp, Homo sapiens
tatgactgttgcaaatacagaatctattagaaaacagggtcttggaaatgtagaattttggcgcactatgaggaaaaacaagctatctttgtaaagcataattgagtttaatgtaattgttgtaaaaaaaaaagtgtgcttgctctacttaaaattcctcacaatgttgaattttgacctgtattcagaagaattccaaaacaggtcagttaaataaggaaatatagtatttgtcaaaccagtatcagagaaaagttacattaatgtatttgattacttgatctggtatctacttattaatgaataatcaacatttttctagtg

SEQ ID NO: 518957 - DNA, 151 bp, Homo sapiens
  misc_feature (25)..(25): n is a, c, g, or t
  misc_feature (30)..(30): n is a, c, g, or t
  misc_feature (84)..(84): n is a, c, g, or t
  misc_feature (90)..(90): n is a, c, g, or t
agttctccccttggtgggagtaggnggctngtgtcctgcgggggcaactggcaccaccacccaagactgggtaagtgccatttncattgntgaagaaacatcttcccgtaacttaaggttctggaaccttggccggcccagttccagtgca

SEQ ID NO: 518958 - DNA, 373 bp, Homo sapiens
  misc_feature (17)..(17): n is a, c, g, or t
  misc_feature (70)..(70): n is a, c, g, or t
  misc_feature (78)..(78): n is a, c, g, or t
  misc_feature (89)..(89): n is a, c, g, or t
  misc_feature (95)..(95): n is a, c, g, or t
  misc_feature (99)..(99): n is a, c, g, or t
  misc_feature (133)..(133): n is a, c, g, or t
  misc_feature (146)..(146): n is a, c, g, or t
  misc_feature (266)..(266): n is a, c, g, or t
  misc_feature (291)..(291): n is a, c, g, or t
  misc_feature (354)..(354): n is a, c, g, or t
ggccctgcttccggggntcccctctacccctgctttccaacagggtctgacctccagacagtcggttcanagttacangtgctttaggncctccnttgngttcccccaggcccatcccttgcgcagatattcnggggccacctggncaaaccccttgctttttctcattcttggcatccttctttctattgctatgtttgtggatctggggacagagagtagagtctctacctgccagggggaatgggatggaaaggaattgtggntggggggtggggccaagaagggggntggtgatgaggtgccctctattggagccggtcactgcggaatgactcctccacagcaggatcnggctgcagggcacaggggg

SEQ ID NO: 518959 - DNA, 227 bp, Homo sapiens
gctacagactcagaggagggcctgacacagctagtggtggagagaatcccagaacctttcccagatgaagtgatttcaaatacgggaccttgaagttcagtagacggtgactatttccattgtttcacaaggtaggtagatacatgtgtaggctccagatgctgaacaatgcttctggtaaaggcaacagcatgtggtccaggctgtccgaggtgatcagaatatga

SEQ ID NO: 518960 - DNA, 710 bp, Homo sapiens
gccgctccgccgtcgctgtttctctgccggtcgcaatggaatgaagagatctgccgcgctggtcattgacaatgtgctccgtgcatgtgcaaagctggtttttgcttggggacgactgctccccgagccgtgtttccttccatcgtcgtgtgctgccccagacaccatgggcgtcatggtgtggcattggtgccagaaggactcctactgtggtgcgactgatggcccagagcaatgctgtggcatcctgaccctgaagtaccccattgatgcatggcatcgtcaccaacttgggactgacatggatgaagatcttggcaccacaccttctacaacagagctgctgctgtggccccgtgaggagcacccagtgctgctgacctgaggcccccctgaaccccaaggccaacagagagaagatgactcagattatgttttgagaccttcaacatccctggccatgtactgtggccatccagggccgtgctggtccctacatacgcctctgtgggcgcacacttggacataggtcattggactctgggagacggggtcacccacacggtgcccatctacgagggctacgcacctaccccatgcaatcatgcgtctggacctggatggccgggactgactgaatactcatgaagatctcatgaacgaggtaaagttacacacaaaggctaagcgggaatcgtggcgaatcatga

SEQ ID NO: 518961 - DNA, 520 bp, Homo sapiens
gaaggcggagttgtctgtgaccactatgatgacatcgatggcattcctgatgacaaggacaactgcagactggtgccctttcccgaccagaaggactctgacggcgatggtcgaggtgatgcctgcaaagatgattttgaccatgacagtgtgccagacatcgatgacatctgtcctgagaatgttgacatcagtgagaccgacttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccaccagccgcttttatgttgtgatgtggaagcaagtcacccagtcctactgggacaccaaccccacgagggctcagggatactcgggccttt

SEQ ID NO: 518962 - DNA, 188 bp, Homo sapiens
ggggggaaaaaaaaaccccctaaaaaggggggggggggggtttttgaaaaaatcccccttttttttcccggggggggggtttttttttaccccccccccccccgcttggggggggggggggggttttttttttttttgggtttcccccccccccaaaaatttttttttttttttttttttttttcaca

SEQ ID NO: 518963 - DNA, 230 bp, Homo sapiens
agccggcttaagatgaacgaagggatgctctcctggccgctagcgcaaagcctaactagcgatcctctgtaggttggctaacagcggaactaatcaactcccatgggcgatctacagtgccttggctcccacgagagccgtccagtgccggttgtgatgacactgtgtccacagttaaggccaccgccactgctaatctgtgagctccgttcacttaatgccgctagcgc

SEQ ID NO: 518964 - DNA, 910 bp, Homo sapiens
  misc_feature (14)..(15): n is a, c, g, or t
  misc_feature (67)..(67): n is a, c, g, or t
  misc_feature (82)..(82): n is a, c, g, or t
  misc_feature (105)..(105): n is a, c, g, or t
  misc_feature (158)..(158): n is a, c, g, or t
  misc_feature (190)..(190): n is a, c, g, or t
  misc_feature (262)..(263): n is a, c, g, or t
ggcctcctcctgtnncccgcagtcggcgtccagcggctcctgcttgttcgtgtgtgtgtcgttgcanggccttatttcatgnggctcaccgctgaaggttcgacngggcgggtggtacctggtccaccggcgcgggggcagtgattgggccgagcctnatgccctgggtcttttgcagaaaagaggagcngttagttcgttgtgacatgactttgggacggggaacttcaacaggagcttggtaagaggctctctttagctnngctgctaagggtttgcttgacagacaatacagacaggacgacggctggacaaacgcagttgggcccaactaattgcattcagtgcgcagacaggacgagaaggttggtgacagacagcccctcggatgcctctgtggcaagacactagcatgtggtgcgtcaaccaatgctgggaactccccttacacatgggatcctaatcttgtgctaagtctagcacggtttgtgacacagcccatattacatgggattatggtacatttcggattttctgccaggcgtgtgttacagcagtttgcagactatgatgtgtcagattcaggcagttaaggctcgtttggcaaaccagtatatccaggaccaactctacaaactgggatgtggaaggcaggcacaccgatttcttttcaaccaggtccagaacctgggacctgtcctttccatgccttgttgtcttggcccccctctggttcctcgcttagaacccctgggggggggctttaagtccctggttgggaaaggagcggcaaggttgggccccgggggcacaactcgcttcgcgttcccccgcggatgggggcatcccgcaggtgggtcgcccgcgggggccacccctaatgaggccgggcccccatttgtgggcacgc

SEQ ID NO: 518965 - DNA, 666 bp, Homo sapiens
  misc_feature (186)..(186): n is a, c, g, or t
  misc_feature (378)..(378): n is a, c, g, or t
aggctgcagatacagtgaagcaaggtgtgcgaaagcgtagtcatttcctccctacgcccggggagttcgaagtgtccgtgggctggacgagaatcggaactcggagcactgaccgtgacctggcgcatcagccagatgtggctcccacgctgccgaacgactgtagtatcgcgtttactagtgatncaccgggcatccacttgttcaatcaaggcgtgctaactcgactacgttgtgactatccacctacgtactgaactaaccttcttagtggcacaagagacgcgcggtgggtcgcgtcgtaatgtggaggctgacagggcgagcaccatgccgtgacacggagacggcttggagatagatctgttgaagctattngaaccgatgggaccccttcgatcgcgagagatcgtactagatgattccatagagatgggactaatagaccgcggtcccaaccctcgcacagagtgcaatcagtaggcatcccagcattgcagttgaagatgctgcgctgacgaattgcataggtggacttcgatttggttctgtgcttccagagagggagatcaacgactcagagttctttcctgagacatgacgtgtggaagctccggagtttgaactgctacgagcctcggttgccagccagactatctcgtggtg

SEQ ID NO: 518966 - DNA, 309 bp, Homo sapiens
accgcgcccaggctcatctattttcatattaccaatcttctagacaatgatcccggtcatagacaatgatcctggtatatttatgccatatacaatcctttgtaacatatgtattcaagacttacaaagcaagtcaatttttaaatattcagtaaatatagcagaagtggcaaaaaaatagcaaaggggtattggaatactggttttgatgccacccaggggaattataaagcaaatcagggatggttaaatgcaacatcaatccacattggttgtggactttaaggtaaggccaacccgggcccttcc

SEQ ID NO: 518967 - DNA, 92 bp, Homo sapiens
gggccaacatggccgccgccgccgctggagctgaagtgccgccgccgcgggcagccacggggaatccgcccgcatcgccgccctcgccggcc

SEQ ID NO: 518968 - DNA, 123 bp, Homo sapiens
gtcactctagcggatccctgtgctactccacaaacagctcccaaagtgtatgggataacagttgttagccactgcgacggccccagtaatatttaaactagtagacaagtcttggccctaact

SEQ ID NO: 518969 - DNA, 828 bp, Homo sapiens
ttccccaccccgggccggccgccatagccagccctccgtcgacctcttcaccgcaccctcggatgccccaaggccccgccgccgtcagcgcggcgagactacgtggctgtgccgctctcttagtcgccgccatgagaccgcgtccaccttcgcaggtgcgccagaaagtaccaccaggactcagaggccgccatcaaggccgccagatcaaccttggagcctctacgcctcctacgtttacctgtccatgtcttacatactttgaccgcgaatgaatgtgcctttgaaagacttggcaaaattagtttcttcacccaatctcatgaggagagggaaccatgctgagcaaagtgatgaacgctgcagaaaccaaggagggttgcccgcaatcttccttccaggacttattcaaacgaaacccagcaactgtgatgaccctgggagaagcgggcttgaaatgccacatggacgtgtgccttacattttggcaacaccgcactgtgatttcagtcactactgcaacctgcacaacgctgggccactggacaaaaaaatgacccccattgtgtgtgacttcattgtggagacaacatttagcctgacattgagcagtgtggaaatggccatcaacagacatcttgcggtgaccatggttgacccaatttgccgccaaagatgggaaccgcccaaatctggccttggcgggaaatatcctcttttgacacagcacaccctgggagaaccagtgattaatgacacgcttaaggctcgggctaatttccccaataagcgtgggggtgacctccctgggtcaccaaaggcagcctt

SEQ ID NO: 518970 - DNA, 171 bp, Homo sapiens
tggtctgctgagcaggagtagggaaggaggagtacgtgtatgcaaaggttctgctgccccgactgccctcagattcctcgaggctgcacctctgcgggcagctggcggtggctgcaggccaagcccctcacacccgggagatccacacgcgcggtacacacgaaaacccaa

SEQ ID NO: 518971 - DNA, 111 bp, Homo sapiens
tggacagcacaggggaggtggacagcacagaggaggtggacagcacagaggaggtggacagcacgaggagccagtaatggagaaaccctagaaaagatcaccaacagccgt

SEQ ID NO: 518972 - DNA, 108 bp, Homo sapiens
ggtatggaatctatttgccaagtactatgtgactatcattgattgccccagtgctcttggtgaggatgcgctactcagtagacagtcccaccctcacacgaatcttta

SEQ ID NO: 518973 - DNA, 1028 bp, Homo sapiens
atcggccagcttaccttactgcgtcagtagcgggttacgtgattgcaaacgagcaagtttaaaacggagtgggctttgggctgcagagccgcctggcattctgacagctgagcaggaggcagaggtgagagtccaagatggactaaaaatgtcccagcagctgggagcccaacctcggcccaacctcgttgaaaggaggaacattcggtgcagccgtcggaaccttattatttatgaaaggggacagctcacaggattacatttttctaagccaatcctgtgaccatcctccatgaaattctctattttggttgcatgtggtcaaaactgagcctcactgaaacaattgaaaacaaatactcccgacaaatcttaagaatcgttttgaaaatcaaaaggtggggaaaatgttgtggcttctgagctttcttcagcccatattctattattctctgatgttttatggtgtaaaatcatacccattccattatgtattgattgtcaagaaggaagtaggcttttattgctatttttatgtcagtttccatttactgtctcaccacatttattgggttattgcctttgcctttgactcaacaggagctggaagggtaggaatcccaaattctgttgcctaaggcagccagttgtcagaatggactttcctcattttctattatgaggcctgaggaaagacattcagttccaaaggctgtgcctatcctgttaaatagaagagagagggcccggcacggtggctcacgcctgtaatcccagcactttgggaggccgaagggggcgaatcacgaggtcaggagttccagaccagcctggccaacatagtgaaaccccgtgtctactaaagatacaaatattagccgggcgtaatggcgggcgcctgtattcccagctactcgggaggctgaggcaggagaatggcttgaatccgggaggcggaggttgcagtgaaccgaaccgagatcgcgtcgctggactccagcccgggcgacagagtgagactccgtccc

SEQ ID NO: 518974 - DNA, 1656 bp, Homo sapiens
cggctgccattatgcaccgacccccacgagcgccggccctgcctgcccgctattttggttccatctcttctgcatatttatgcttgcctgttacattccctggcctctgagtgtcctttggcagtttccaaagcatttgggcaagaaggagcttgggcagcttcacaacaggtggggacgcgcaggggaggggccgcggccggaccggcagagtttcaagggctggcgcgccggcggactttccacactgtctttcgggactggggttaggagacagcccttggccaccactgtgtccttactttgtcgctttacttggggctggacctcccctttccagctctggcgtgtgaccccgcaacgagcgtggtgtcgagaccaccaccagctggggcggtgggagcgaaggtgccccaggctcggggaaggtggaaaccttttccccgctccccaagtgattgttgcgcgctccggtgaggggacagtggtacctcgatttcccgtgtgccagcttcgggactcagctgtgcttttgtgtctctttgattagcaaaagcaaaacgaattcctccccgaacactaagcttcctggaaacttccctagacctaaacttgagaaccgcatataaatgggccttgagggttctgtcgtcagtagcgggttacgtgattgcaaacgagcaagtttaaaacggagtgggctttgggctgcagagccgcctggcattctgacagctgagcaggaggcagaggtgagagtccaagatggactaaaaatgtcccagcagctgggagcccaacctcggcccaacctcgttgaaaggaggaacattcggtgcagccgtcggaaccttattatttatgaaaggggacagctcacaggattacatttttctaagccaatcctgtgaccatcctccatgaaattctctattttggttgcatgtggtcaaaactgagcctcactgaaacaattgaaaacaaatactcccgacaaatcttaagaatcgttttgaaaatcaaaaggtggggaaaatgttgtggcttctgagctttcttcagcccatattctattattctctgatgttttatggtgtaaaatcatacccattccattatgtattgattgtcaagaaggaagtaggcttttattgctatttttatgtcagtttccatttactgtctcaccacatttattgggttattgcctttgcctttgactcaacaggagctggaagggtaggaatcccaaattctgttgcctaaggcagccagttgtcagaatggactttcctcattttctattatgaggcctgaggaaagacattcagttccaaaggctgtgcctatcctgttaaatagaagagagagggcccggcacggtggctcacgcctgtaatcccagcactttgggaggccgaagggggcgaatcacgaggtcaggagttccagaccagcctggccaacatagtgaaaccccgtgtctactaaagatacaaatattagccgggcgtaatggcgggcgcctgtattcccagctactcgggaggctgaggcaggagaatggcttgaatccgggaggcggaggttgcagtgaaccgaaccgagatcgcgtcgctggactccagcccgggcgacagagtgagactccgtccc

SEQ ID NO: 518975 - DNA, 1471 bp, Homo sapiens
ccccgcatatggcgtttccccgcataaacaacataagcttctgactcttacccccacctgaaccttcaactgcctcggctccagcgccatggcgcccatccaggcaacgttcttcgataaggcgggaaactcggacagatgaacgggccgcaagcagagctcctgggggcagcctcatcaggacactcctgaaaacagacgtgccaagggttgccggtgcccgaagacctgagcgttgagttatgttgctaccacccataacttgacccatacttactcgaacatatcgacccccgggcccagcaaagccatacgaatcacccaaagcaaattgccatgaggcgcccttgccgacccacgtaaaccttggcctacacatacaccgatcgacacctaaaccttgccgtgacgcattatttctacccatctgggtgcggaacgcacatcacacgcccacattgagaccacttcgaattcaaaaaaaggaaaaccatggcccggaggaaggacccacaacaggatagcgaagaatgaggaatccccaatgaaggaggaagcccaaaacattccaaacaaaacgcaaccgcaacacggggccccacttggattcccaatactcatcggagaggagaaaacggaattcccaagcacaaatagcaacacacccacatgggcacatacaggcggaggaccaaacacgacacaaacggactggcgcacaccacacaagatgcccccctcccatggacgccccacagcgcacagacaggcgggcaacccattccagaagtgaacagcccttaacaacgattcgggacaccccccctggccccgagacatacggggagcagagaccaagccaccaccgcccacttaaagccacacagtgcaacccacacacggtaggcgggacacaagggaaccactggggggcgcccaagattcacacaccccgttgacaaccgcccaagcaggagggcaacaacggaatcacagcgaatcccgggacacgccccaacggacaccccaataaaacagcgcggcatacacaacagtccggtaccccaacgcgcacacgcttcaacaacccagacatgcccaacaacacggggcaacacccactggacgaaaaagggacccaacacacgaggggcacatccccaggcttaccaaccacactggcacaaccccccccccataaaacagtggcaaaaaagacgccagccgccttggcgcctacgccaaacgagcacaagggatccacacaaaaccactcatgcgaggaacataacccccctcttggcaggcgccacccacacccacgcaacaaccccaatcaggcaccgcaacacacccccacaccgcccccccccccaaagcacacgcaacaggggagggacacccacccagaacggacgccaacaaaccagcgccatacaccgcaacccccgggccacaccacaaaacaagt

SEQ ID NO: 518976 - DNA, 349 bp, Homo sapiens
ctggctctgtgcagtgtatggccgagtctgtgtggatcggctgtcgcagtggtgaatgactgagagctaagtacacatacgctctgatatagtactcccatgatggcttccagtgacacatgtgctgatagaattctaaacctctggaatttccctgctggcgacttctatggccgttgactgtacagggtaacctgatgccagatgctatgggcgtgatgagacctagagcattgcagcatggaggaaactgtgaggcaccagatcctgtgcttctacaggccatattctgaaaacccctattaggaaaggttggatttggcgtgacttgctttagcaagagtcctgg

SEQ ID NO: 518977 - DNA, 207 bp, Homo sapiens
cccagggtgtgggggccccccgggcccctcccccccccctgggggcttttcccggggcttttttgggggggcccttcaccccttttggggggggggcccccaaattttcgggggcccccccccgggggggggttcctttgccttttgggttttgttgggggcccccccccccggttcctttttggggttttccccccctttttttta

SEQ ID NO: 518978 - DNA, 514 bp, Homo sapiens
taaaaaccccccccaaaaaaggggaaaattaaaaaaattttcaacccctttttaaaaagggccatttgggggggggttttaaacccaagagtgtttttgggtttaagggaaaatattgcggtggggggaaaaacgacaatcggatgagagaatgtgccccccaaatagtgactctgaagcccggggaacacccggggggctacacaaaaatgtgtcacccagaaaacccgcccaggaaagtgtggtgcaggcgacacccagaaagaccactgagcgagggctgtggagagaggagggtctaacacaaaagaaggaccccccacaacaaactgtggtaaaacaagagcaggcggcttgaaacactaaaatgggggccgacggggtggtgttgccaataataaaaacactagtgagtaggccccacagaggattaatgagaaacccccccagagaggccgagaaaaaacagcgagaactttctataaggcggggcgcccctccgagggagataacg

SEQ ID NO: 518979 - DNA, 431 bp, Homo sapiens
ccgcgtggttcttgcgacggagacagtgctgcggaggcattgcgagcgcataagcctgtgctgatgatgaacaagatggaccgcgccctgtggagctgcagtggagcccgaggagctctaacagactttccaggggcatcgtgcagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttctgcaaggcacccacg

SEQ ID NO: 518980 - DNA, 213 bp, Homo sapiens
ctgtcccgctgccactttcctcactgatattgtgaggagggcaaggctcagccgaatttccactaaaaatgccccaggagaataggcaccggctggtttcccaaagggaatgggttttagtgctttctgttttttcttttcctgacagcacaaagaagtaagggcagtttgtggacgggtgttattttaactttctattgtaattgcatgaga

SEQ ID NO: 518981 - DNA, 584 bp, Homo sapiens
tgttacatctatgcattgaaggcatgagactaacaaaacaagaagggcctttatcagacacacacaagcttctgatgacctggattgaagagcagacacaggtgcacacggtgctgtgtacctctcagcaccatgatgatcccaaagcaaaaagtgtgtttgaggtgttgaaagaaaaggctggacctggctgtgatgttggattgactgctagttctgggtggtgtaaacaattcaagaatcgttattcattacataatgggaaagtggtgagtttgtgagtgctgatgtaaaggcagcggaagaattttgggaaactctagataagctgagtctggaggaaaatcacttgccagaacaaattttcaatatggatgaaacctttctattctggaaacagatgcctgaaaggactttgatccatgaggtagaccaaagcaatgccaggcttcaagtcttttagggactggatgacagtcttgcttgggggcaatgttgcaggccacaaattgaacccctttgtgatttggcatgttgagaaccctatgggcttccagcatatcaatacacacacactttgccag

SEQ ID NO: 518982 - DNA, 307 bp, Homo sapiens
ggttggtcgttctacaggttccccccatcacccctggctcatccaccacccctggctaatttttttgtatttttatgtagcagacagtgctttcactcgtgttagccaggatggtctcaatctcctgacctcatgatccacccgtctcggcctcccaaagtgctgggattataggcgtgagctgccgcgcccggctgaagtcactttttcattaaatttttctggttttgaactcctgacctcaaatgatccacccacctctgcctcccaaagtgctgggattacaggcatgagccactgtgcccgg

SEQ ID NO: 518983 - DNA, 321 bp, Homo sapiens
agagaatggccctgggcgttcatcgtgctcaagtcggcagtaacccccgtgtctgcacctttgtctggattcttaatacagatctcaagggccgcctgcccgggtacctcatccaccagagccttcgcgcacaccgatgtttcgaatttgccgtttcaccatgcagacgacgcgagtcgagcgaagcatgggaggcccgaggcgtgaactgtggccccctcccacccctgcgggccagggtcctgtcgccaccacttccagagccagaaagggtgccagttgggcttcgagctgcccacatgggacctgggcccaggctgt

SEQ ID NO: 518984 - DNA, 422 bp, Homo sapiens
catccctcattagaactcccttccattcattcgatacgtaactgatttctattctccattcaaaaccccattctaatatcactctctctgggacgctactctgacttctctgaggcccttccaggctatcatatccttcctgataatggctccttatagcactggccacttatatggaagtggtgcatttgagtctctcccactgcaccatgggtttacaatggaagagtgtgtgtatcattcctctttgtaatcccagctctgtcatcacaagcatggacattcaagcatgtacctggtagttgctcaagctctcatattcatagagcccaaacccaaacctaaaacaagaagcaacagaagaaaataatagaggctcagtctcgaacatccatcagcacaggctaattccttcactaatc

SEQ ID NO: 518985 - DNA, 138 bp, Homo sapiens
cggaagattggactctatctctttttaacagaatttcagcattttaaaaaccaagtgcccgaatgcagagcccacttcctgagaggaccgcgtctccctcctcgaggtgatcaccactgggcaggctgggcacctcca

SEQ ID NO: 518986 - DNA, 222 bp, Homo sapiens
ccgagctcggtaccctcgatagccaataatgacgtagtccgtgggaagcctgtggtttacacttgtatgttgagacgtagatgccgtcgtgaaatggtgaatgggagactcgaagtactctgaggcttgcaggagtggtaaaatagagacccagtaaaagttgtaatgagcagtgcttgaattatttggtcatcggttgttttctatttggcccttatcgag

SEQ ID NO: 518987 - DNA, 189 bp, Homo sapiens
gtagatatggtcctccatggatcaccccagaccagtgtctctgcaatacaaaaacccattcctccctctagaaatggccagaggttgaggcaggagaatcatttgaacccgagaggcgaagtttgcagtgagccgagatggtgccaccgaattcaagcctaggcaacagggtccggagctcgaattcga

SEQ ID NO: 518988 - DNA, 389 bp, Homo sapiens
  misc_feature (128)..(129): n is a, c, g, or t
cagtctcataaaaatatgctttttcagtttttgtcttaaaatatctttatttcatctttttttttggagacagggtctccatctgtcacccaggctggagtgcagtggggcaatttcagttttctctnngcaacccccatcttgtgggtcaagcaattctcttgcctcagcctccccagtagctgggactgtaggggcccgccacccagcccgcttaatttttttgtgttttagtaaaaaggaagttttgccatgttgcccagtgtggtcttgatttcctgagctcaggcagtccccccccctcagcctcccaaagtgctgggattacagatgtgcgcccctgggcccatcttattttcattttttaatggaaatccagtccatcccca

SEQ ID NO: 518989 - DNA, 355 bp, Homo sapiens
  misc_feature (14)..(14): n is a, c, g, or t
  misc_feature (21)..(21): n is a, c, g, or t
  misc_feature (84)..(84): n is a, c, g, or t
  misc_feature (110)..(110): n is a, c, g, or t
  misc_feature (125)..(125): n is a, c, g, or t
attgaagaatgcancttggcnatgttacctacgctagtctcaaaaccccctgggctcaaagcaatcctgctgcctctttctccnaaagtgtggtattacgtgtgtgagcnagcatgcttacctcntttattttaaattattttatttcttgagacagagtcttgctctgtcacccaggctggagtgcagtggtatgatctcggcttactgcaacctccacctcccgggttcaagtgattctcctgcctcaccctcccaaatagctgggattacaggtgcccaccaccatgcctggctaatttttgtagttttaacttttagtagagaccgtgtttcaccatcttggccaggctgg

SEQ ID NO: 518990 - DNA, 888 bp, Homo sapiens
ggcggagctgaccggtggaggttcgaggctctaacggggctttctacaagggattctatcaaatgatgtacatgaaggactcccttacagttgtttctgtgagaataagttggcaaccagaacgccaggtcccatttaatgaagttagattaccagcactcacctgatatatagaaaaggaaacttagtgaaggacgatgaagtagaggtatattcaagagcaaatgaccatagagccatgtgggtggtggcttggctaaatgttcggagtgatgaaaggagaatgttatgtcacttgaatatgctgcttgtgacagctacttacaaatgacaatagtacaacaatttgaagcgtatcttcggtcctgctcgaatgcgaaatatagacaagcttgtcataaggaactaataccttctttaaatgcacagtggatgttcctgaggatttgagtagaaggcagtgtgcgtaactgatataagtgcacatacaacgagttttaagaacacgcagctaggagcatgcatgaactcttctttaaccatccatgaaacaacgacagtctaatgataactgttctgcctagtgaatggctaactgtgatagagagtaaacgatcttaagtgacatgcatttgcgaagtattcggacgaaggttgatgcttatgtccacgaaaactgaaggaggccagttaagccagtttactaattgctcagaaacaacttgcagcaagcttttcatgaggaactcgtcgtgagagaaagatttaatgggcctggcaataggaacacatggtagtaacatccaggcaagctaggaaggttcctggagttaccgccattgagctagatgaacgatactggcacctttcagaatctacgggagacac

SEQ ID NO: 518991 - DNA, 145 bp, Homo sapiens
  misc_feature (20)..(20): n is a, c, g, or t
tgatctagaggatcctcagnctgctccctcttcacatatatatatatatattttttttcaagagtataaatcctccaaaaaaaaaagggaaagtgggttgggattggggcattgtgagctcactacataagcagtgagcaccaaa

SEQ ID NO: 518992 - DNA, 1045 bp, Homo sapiens
  misc_feature (674)..(674): n is a, c, g, or t
ggaagggtgcctgtggaagaagggggcagccctcgacggtggcccttgcagggtaaacacagggacgggccaaccggggggtgagccgggaaggctcaccggacaggcggccaccacctgtctggctacagaacgaacggcaatcattggcgtccccgggtaatgcgggtgggaccccacagggcttcgtcaaggcactggccgcaccagcccccaaggactaccacccaagcccccgtcgccggcacctaggagacccctcagccttccccacaggagggagggagagtggacatcgtggaggattccagagacaaggctcccccaacagtgcgactgaccccggactcagggggccgagagaggcccactcctggtccaaagccagcatcccagctgtaccccgcacgtggacctggggccgttccatccgtggaagatcgtcactgcagatcactggactcaggacctggacagcaagcagatccccacataggacacgaggcagcataggctggggtcccaggtggggccaagaccaggaggtgcggcgtgatcggaacccggccctggcggacggagtacagggtcccaagatcccacactgtatggtcgctggacagtgattctccattctgagccgtgtattcccctctcacctccctcgtccacancgtgggacagggcaggccccatcgctttcctgctgataaccacatggacacatcctgaagtcagcccaggcgtcctgagcatacttggggcacatggacaccatcacaatagtccttcgttccattgcaggtccccatgggtgaaggctttgactgaaaccgagccccccattttgacgtcccattctgcgctcatgccccgttggatgacactgatctgggggcaggggaagagacagggcacagctggccacagggctcagcacactgagcaggctgttccgggccgatggctttagcatcctggacggggagtgtcctgtcagggacagatgtgtcatgcctcatatacagctgccgatccctaccca

SEQ ID NO: 518993 - DNA, 117 bp, Homo sapiens
gcaacacttcgtcacaacgatctgacttcaagaagtgtctggatgccggcgtgtgcagcaacaacttcgtccatcctgatttgacctcaagaagtgtgtggggtttcggcgtgtgca

SEQ ID NO: 518994 - DNA, 316 bp, Homo sapiens
gtttacacacttttactacaagggcattgaagaacaagtgggacaagagcccagacaatgacaatgagatataggagtcaaaggaattgaagagacagtagtataaatgacagataagacaagtcaagaatattcaattcattagtttcctttcaggagacacatcagattactaagacagacctcatacagtccctatggcttcacacagaggatacgttttgagaggctcctcattaggcacttctgttatcatgggcacatcatagagtgtactcacatagcccagatggtatagcctaccactcaggctagc

SEQ ID NO: 518995 - DNA, 875 bp, Homo sapiens
cagcgtgtgttctgtcgcaggtaaaatgtggcccattcgcgcattcgcttggcagtgataattgcaacaagaccgtgggaagccccgttatatgtttggacaaggagttttccctccctaaggggcctctaatactccggcatgtggttgaacggaaattctcggggcgccgccacaggtggtcccccgcggcttaataactactggccaagttcattgttgacgggcctcccgccgcctgctgtttaaaatccagaaatggccgcactttgtcaactcccccatcacggcccgcaaatggcccccctggcacacattgggggccggcgaaaattttccagggccgtatagtggggggccccccccaattgatggtgtatgacatgctggtttgccccggggaacagggtgggcccgcggggttgcatctcccccactttattgggggctgttggcgggtattattccccggatcaccccctggcctgtcgtgccaacacaacaaggccccgttctggcgaggaccgctcttccgccccggcgcgctgtttgggggtcgccgccggcgccccccaggagtgtggagtggttaccccccccccctggcgacggcgcaagcggtctgtgagcgctagttcgccaccaccaacgagtttggagagggggtgtctacgcttgatacagggtccccggggcacaatttttgccccgcaagaatcaaaaaaggggtcttttaaacccactatgccacccaagaaactcgccggtgtgcgcccacactgaacttcatctcatgtgatgttcaccattttgtagagtataaatatagcaatgagatttttccctaaaaaaacatatccagaacgccccacaaa

SEQ ID NO: 518996 - DNA, 181 bp, Homo sapiens
actagacatcgtacacacgacacgtactacgttgtagctcacttccactatgtcctatcaataggagctgtatttgccatcatacggaagcttgcattcactgatttccccatattctcagtgctacatccctacatcaaacctacgctcaaaatccatttcacttatcatattcatccgg

SEQ ID NO: 518997 - DNA, 143 bp, Homo sapiens
  misc_feature (79)..(79): n is a, c, g, or t
gaactcttgtcacatggacttcttgtcatttctcggccgtccgcgcacacaggagacagggcagtgatgctgagcagtngagcaggcctctcgggggtgttccaggtgctcccttctcacttgtattgttaagcatactattt

SEQ ID NO: 518998 - DNA, 377 bp, Homo sapiens
tcccgacgcggactcgacaaacagcagtgagaggcagtcgcgattatagggaacaaaaaaacctaaagtagctaggactgacgaccacaagtcccccacttctctccgacagtcctctgtaagggccaatctgagatttttgtaggctggtatatcactcagtcaacactgggaatacgtgtatcttaagtgcctattatatgtctagcactcagaaggtatattattcgctgtattttacacgctgtattttacttcatcatcacaaggctgatatcatacatgggaaatgtttgacacatgaggaaactgaggccaggcgttggcatgtgctgctctgtgttaccatgtccaatgagctgtcagtggaggtagca

SEQ ID NO: 518999 - DNA, 107 bp, Homo sapiens
atgaagagaggtagggactcatctagaaactcttccctgtcatcttataccgaggcataaatgaactccaccagaggccctgagatcaaagatctcagattctatca

SEQ ID NO: 519000 - DNA, 349 bp, Homo sapiens
tcccattaggtcgcgttctgcgtttttgtgttgctgcttgcagacctggtagctggtttagaattatgtgatgtgcattagagtagattttcgtttagagctgctacatgctacctttgaaaaattacctgcaagctccgactgatctttcaactttcaaagtgattaattacttcaggaacttcttgtggtttctttgtcatttagtgagagcccagccagtctactgtggaaggccatacctccctgaaggttgcctactaagggcaatgttccagtttgttttctctttcagtgtgcttcagtcgcacagttcttcctgtttattctatcatcttttttaccactt

SEQ ID NO: 519001 - DNA, 321 bp, Homo sapiens
  misc_feature (1)..(1): n is a, c, g, or t
  misc_feature (151)..(151): n is a, c, g, or t
nttttttttttcttggttgatttttttattttatttttttagggacagaatctctctatgttgcccaggctggtctccaactcgtgggttcaagcgatcctcctgcctcagtctcccaaagtgctgggatgacaggtgtgggcaaccaccnacgccaaggatctggtttttgaaacgataaataaatttaacaaacctccagcaagaccttgatcccaggaggtcaaggctgcagtgagccgtgcttgtaccactgcactccagcctacggcaacagagcaagacccgcggacagctggagaggccgaggcgctctcgctt

SEQ ID NO: 519002 - DNA, 353 bp, Homo sapiens
gagaatcacttgaacccaggaggcagaggttgcaatgagctgagatcatgccattgcactccagcctgggccacagagtgggaccccgtctccaaaaaagaaaaaaaaaaaaaaggtaaaagatttgcacagtttaagggatgttaaataaataagggtaaaaaaaatgatggggtatatttaattataaacagattttttagctgcccaaaaattactgaaaaaagggaataataaaaaaggctagttggtcccttttaattattttcttgctatagggaagaatgtggatgtgaaacccaagtatttaaagctttttgttcattgcaaaacacctgttcattcaaactttt

SEQ ID NO: 519003 - DNA, 280 bp, Homo sapiens
agcaagagcaggaggattacttgagggtaggagttcaagaccagcttgagcaagacagccagaccctttctctccaaaatcctgtttaaaaaattactgagacatggtggcctttggtcctagatacttgggaggctgaggcaggaggattgcttgagcccaggagctcaagtctacagtgttgtgatcatgcctcagtgcagcgatcatggctcagtgcagcctcaaactcttggggctcaagcagtgctccaaccttcagcctcctggagtagctagg

SEQ ID NO: 519004 - DNA, 555 bp, Homo sapiens
gggacgagcatcctttacattcgtgtaatagaaatacccccaggggtctacatccatgggtcattagcgtcattgtgcagcatttcaggtaccatatcaaccagagcaacatacatgattaagccagcagtaagtgcaaatatccacatagaaacatttgcagcataatgaccaatgaaaattcctgttgccattccaagatacgccagcatggctgagaatgcattataagggagcagccggcttaagggtcatgccagcctttagtagaacagcaaagtcacctaatccatgaggcaactcatgacagaacacagcaacagaagtacttaaaccagttgataagccttcaggtaaaagcagcaccaatggctaggccatcgctgacatggtgcaggccatcacccataagtggcgacgccggcatctttcagctcctcccgagagtagcgctggctgtgactgtgaggatggcggaactggtggtggtgatgatggagaatctcgactgtagccatgatggtggtgattgagatcgtctgactggccgagtgt

SEQ ID NO: 519005 - DNA, 982 bp, Homo sapiens
tgttttattatgattcatcttcagctaatttttagcacagcaagcacagcaacagccatagtgtcctctacaattcaacaacaacttatctctgatatacaaagggatataacatatatacacttaaatagagaaaaagaggttgattgaattggtgcctttgagtgaacccagtttttaaataccgcatgtgtttggttatcgccagtggctttcaagggatgctactatggcatcttgcaccttttactcctctgctttatgaagtttgagttgtatttgtgcatcttaaagtaggttgaggcttgaggctgggctttcagggtttatatagtaaaataggtatggtaatggtataggtaatggtatttctggtacttaaacctgcttgcttcctaccacagattctttattgttcccaaagactacaagaaaaacttttaaaacttggccatttcatctgtttacactcttggccactgattagcagtatttaaatcttgcaagaatatgtggtgctttctttagaaagagaagagtatagcattttctcactgaaaaagtgagagttacgcaatgaagccatgaagggatgctaggatcacttatgggcagtactattataccactactggttctggagccagatgtctactatagtaaggggttccactttaggaatactgggagtgtagggccacttacccgtgtgccctaaataggtagtccaccaatggaaagcacgacgcaaaggagcacatagccactaggttgggggagattacatataacaaagtggaaagtgaattggcaacaatgtgacgattatttgtagacccagtgggatgggtacatgagaatagagaggaacaattttagaatagtaggagatccaagtataacataaatatagaggtggagaacaaaagtatgtgtggggcaaatatagcggaaggagatatgtgcagaagaagaacatatg

SEQ ID NO: 519006 - DNA, 761 bp, Homo sapiens
taaaccccggtcctggggggggtgggggtttaatactaagtggaaatgatttcatttacgggggaaggcccttggtaaattaggccttatttctctgtgtccttccgtacggggaggaatttggaagtgtagatagaacccggaccgggattaccccgggtctggaactcagatcacggtaggactttaatcgttggacacaaacagaacctttaatagcgggctggccaccattggggatgtcctgatccacacatcgaggtctgtaaaccctatggttgatatgggactctagaataggatggccgctgttacccctagggtaactggtcccgtgggccaagtttatgggatcaatggagtatagaagtccgcttggacgggtgaagtctaagcatgtactggctcggaggtggggttctgccccgaggtcgccccaaccgaaattttaaatgcaggttgggaagttaggacctgggggtttggtaggtacggtggcataaagtacatttaaacgcccacagggagtcctccgtcgaccatggcgtgatgctcaagtgcaccagcctactttaacggggacagggtcaatattcacgtggttcaaagtgtcagaagaaaggctgacccctcggggacgccatccaaacaaggtcccaactataagggacaaggagatatgctaccttgaaccggacaggaacccgggcgtaacactggttcctgggccagggagcccaaaagggtcccagaaccgcaaa

SEQ ID NO: 519007 - DNA, 228 bp, Homo sapiens
  misc_feature (36)..(36): n is a, c, g, or t
cttagaggatccggtgttcctttgtctacaaacttntaggagcagtttctgccatgggtcagaagcctggctctcagcaacacagtggctggcacaactatcatggcttccagcttccccccgcccccgatcttcacttcccaatgatggaaactggcccagctgcggaggcttgcttagaaccccttccctgtttagcgtggcactttttttttttttttctttttg

SEQ ID NO: 519008 - DNA, 169 bp, Homo sapiens
acataggatgcaggaactggataaagaaaacacaatcacgtgctagtatgcatacacatatacacacacacccctgagcatcagctcagactgtacatgaatagtatcactgcgcatactcatcataatggaaaaactaccgtgtgtacaccaaggcctgggattaggg

SEQ ID NO: 519009 - DNA, 398 bp, Homo sapiens
  misc_feature (398)..(398): n is a, c, g, or t
tgtaggtgggatgctcgtaaggtgtgtctacgactttgagataatggactcctggccacgccaacccatggcgacattatcaggtttgcgcctctcgctgttgatcaaggaggatgagcttcgagagagcattgagattattaacacagaccatcttggctttctgagggtagccacgctgttttcagtggtccctgggagccagctggagacacggtggcctgggctttattcctaatgtgggcacattccacttccatgagtcttcatatgaacctggcggttgctttgtaacgcaactaaataatgtgatggcatctatattcagttgaagtggtttgatgtgcatgtgtacttcctaaggtgaaatgcatctatatacacgacggctcttcgtn

SEQ ID NO: 519010 - DNA, 988 bp, Homo sapiens
  misc_feature (517)..(517): n is a, c, g, or t
gaacacaaaagtagctgaaagccaggtacaacatacgttagcattggatatatgtagagttcctgtagtagtcacaacaagataaattggtcatgaaagtttgcctagatctatagacttgattacgttaagcgatgttagggtatcgcgatactgcaaatggtagacaatagtgagccccagagtaaatcttcgtgattgttacactggtttatcaagaggatggacttcaaattatggacgagagacggagtctggctctggtcacccaggctggagtgcagtgggcgcaatctcgggtcactgcaagctctgcctcccaagttcatgccattctcctgcctcagcctcccaagtagctggggactacaggcacctggccaccatggcccagctaattctcctattcctttccagtaaagcacgggggtctcaccatggttcacgccaggagggcctcggactctggacctcgggatccggccgacctgggcctcccaaagtggcgtggcacatnaccaggccgtgaagccacgtgcgcccgggcccaagacacgtggaccatctcctccaacaacaaccactcaggcaccatccataccaagtgtgtgcactgagcctctacaggccccggaaactcaccagacaacgcatacggcgagaaattccggacactgaagcgggacactcaaactcagggtggccaatactacgcgtcacattaaagcaaacgggttatattcgccatattcgctcaccgtggagggcggcctctcccgctaacattacggcacattgcctcactcaaaatcgcgggggaacacttgctgtaagggtcccccaagccgttggacaaccacttcaaaacacccctctaaatcaagttgtgaacgcaaaaaacttgctgggatacagagggcaccggtggcatacaacaccgcctcccacaacgcggtccctactttgtcaaccggcggcatatacaggg

SEQ ID NO: 519011 - DNA, 162 bp, Homo sapiens
ctagacccccgttttgcagtgcaagaaacaccgcagagtagcagaatcttccccctcagtgcttgggatctggggtgcagactccactcgctcaggccatggcgaagtagaagccagctgtacagtaccatttccacagcagtcacggcctcttgcttgctt

SEQ ID NO: 519012 - DNA, 1170 bp, Homo sapiens
agtggaggccggagcaggaacaggttgaacagatctaccctcccattagcagagaactactcccaccctggagaccatccgatagaccataaacaatcattcatacaatatacaccatagacaggatgatctccatcataatcttaggggccatcaaatttcagtcacaaaaaaataaatcaaataataaaaaaaccccatgaccaataaccacaataaccaaacaacccctcattcgatctgatccgatccataatacacagaagatcacaaaataaattcactatactacatcccagtcctagctggctggcatcactatactacctaacagaccgacaaacatcaaaacaacaacacatatacttacgaaaccaagaaaagaaagaaaaaagaaacccagtactataccaacacataatcatgaataaattgaggtacaatgaaaagataaaataatcataaataaaatacaagagaatatagaaaataaataatacaaataataaggtaaatataaataaaataagagaaaaaaaagaaaaaaatatgagaaataaaataaggaataggaaaaggagaataaaaaaaaaaaaaaatagagaataaaataagaaataaatgaagaacacaaaaacaacataatataaaaacagcatcggactagacgcatagaaaaagagactactttaaatcagatcctctcttgctctctccaaaacggcgataagatattttagatgaattgcaaagaactaaaacaggacagaacttacttgaacctgttctagattgacagaatatgagcaaataagggtaaattattatcattaacggcaaggctggcactgaacatggacctgactctacaagcaccctattaaaaagaattaattattgaaagacgaaaaaaagaagaaaaaaaaaaaaaaaaaaatgcaaaataataggaagtgatattaggcaaaaaaaaagaaagaaaccattcatgattcccctaatctcaggcattcacccttgacaaactaggccataatcagtcatatatattcatcgggtacttaatttttcccaaacgttatggaacaaaagaaaaagaaaaaaaatagataaccaatataaccacatgaactctatagcgtgggccacatccgtacgcaacttaaatag

SEQ ID NO: 519013 - DNA, 84 bp, Homo sapiens
aacccggcccaattttggttcggtcccaccggggagaaaaaattttttccatgtttttcccttaaaaaccgggggccccctgga

SEQ ID NO: 519014 - DNA, 307 bp, Homo sapiens
  misc_feature (76)..(76): n is a, c, g, or t
  misc_feature (82)..(82): n is a, c, g, or t
  misc_feature (86)..(86): n is a, c, g, or t
  misc_feature (88)..(88): n is a, c, g, or t
  misc_feature (114)..(114): n is a, c, g, or t
  misc_feature (133)..(133): n is a, c, g, or t
  misc_feature (146)..(146): n is a, c, g, or t
  misc_feature (152)..(152): n is a, c, g, or t
  misc_feature (157)..(158): n is a, c, g, or t
  misc_feature (185)..(185): n is a, c, g, or t
  misc_feature (197)..(197): n is a, c, g, or t
  misc_feature (208)..(208): n is a, c, g, or t
  misc_feature (214)..(214): n is a, c, g, or t
  misc_feature (227)..(227): n is a, c, g, or t
  misc_feature (249)..(249): n is a, c, g, or t
  misc_feature (259)..(259): n is a, c, g, or t
ctagtcttcattttataaaagttgttgcctttttaacggagtgtcactttcaaccggcctcccctacccctgctgnccgggnatgnanacatgtcatttgtaaaagcagaaaangttgcatttgttcactttngtaatattgtccngggccntgttnngggtttttggggaaagctgggcatcantgccacatggcntcagggctgcnccacanagaccccacaggncagtgagctctgtcttcccccncctgctagcncatcatctatctaaccggtccttgatttaatcagctctatatatagtt

SEQ ID NO: 519015 - DNA, 80 bp, Homo sapiens
agctcttattgcagacagggccaagcatgtgatactttgtaccgatatgagattgatatgaaataaagttttttaaagat

SEQ ID NO: 519016 - DNA, 625 bp, Homo sapiens
cccgggctgttcccggcttcttccccggtgaggggacccgctttcccccgggcctcggaccagggcccccaggggagactcgccacgctctggaggccccgttgtccccctggcggtcggtttaagtttttggaccaccgcgatgtttatgtgtctctcaaaaagctcgttctctggtctctgtgattaaaccggggccaaaccgaatggtccgcccccagccaacccaccccggtttgccattcttttcggaacatccaaaagtgcccgatccagatgggagtccagttatcggagcctgaccccccgccatagcccaggaacgccagagtgaagtgccccgcgctggaggtcgcacgcgtgcccacgaggaggcccggttggtgcttccctcctcgggctgtgggcaaccatggggcccccccaggttccttggaaggaggccctgagctgggaaggcacccaaaggctgacctatccgagcctcccggaggcccccctgctgggtacccggactcacctctgaccacccggagaaggtaagggccccggtcagcccccaggagcgcgctccacgcgcgtgcaccccgcttccctggtaataaagagctggcatcctttctta

SEQ ID NO: 519017 - DNA, 206 bp, Homo sapiens
tagcatggcacatgaagacgcaaagctagagtctacaagaacgctactatccccatatcatagaagagcttatcaccaatggtactgaacctacgagtacaccgactacggcgagactaatcttcaaactcctacatacttcccccattattcctagaaccaggcgaactgcgactccttgaacgttgacaatcgagctagtactc

SEQ ID NO: 519018 - DNA, 875 bp, Homo sapiens
  misc_feature (97)..(97): n is a, c, g, or t
  misc_feature (115)..(115): n is a, c, g, or t
  misc_feature (148)..(148): n is a, c, g, or t
  misc_feature (157)..(157): n is a, c, g, or t
  misc_feature (255)..(256): n is a, c, g, or t
  misc_feature (297)..(298): n is a, c, g, or t
  misc_feature (318)..(318): n is a, c, g, or t
  misc_feature (322)..(322): n is a, c, g, or t
  misc_feature (332)..(332): n is a, c, g, or t
  misc_feature (363)..(363): n is a, c, g, or t
gagacgcagaggcggacaagatggcggcggcagctgtacagggcgggagaagcggtggtagcggaggctgtagtggggctggtggtgcttccaactncgggacaggaagtggccntagcggcttgttggataagtggcaagatagatnataagcctntaaaaattgacaagtgggatggatcagctgtgaaaaactctttggatgattctgccaaaaaggtacttctggaaaaaatacaaatatgtggagaattnntggtctaattgatggtcgcctcacatctgtacaatctcctnntttctttgccatagtggttngatncgggattatntgcacccctttccagagtccaaaccgttggnctcgtgtgtcatatcctaattggtgatgatggggattctgaccattttatacctcatactaaggagaagacgcctctttctcgttgggccacaaggacgatcctacaggaatggatcctgccgacactgtgacagctgtcctcagtcttacacaggttggactgacaaataaaaccttgaaaggtgaccttcatcaggtggggagcaccaatgcagaagtgcccagcgcgtcccacaggtccacgctaaggttcgaccacaggggcaactggccaggatgacttttgagccgaatatccaggctcctgcaagctgcctcgcagagcaactaggtcaattttacagcaccccttcccggcctggcgacacacaggcgcgcgcgcgcgcgcacaaacgccacagggccccacaaccacaagcctcgcgccggggcccaccacgcggcaaccgtgccaccacagccgccaacccccaccgagccaccgcgcgcccgccgcccagcacatacaccc

SEQ ID NO: 519019 - DNA, 148 bp, Homo sapiens
  misc_feature (5)..(5): n is a, c, g, or t
ctccnatttgctcacagcgcggagcgacgtcttagtctagttgaagtacgcactgggagcaggacgtctaagtctaggaagtgaccgcagtgggcagcaggactgtctgagtctacggaagttgaccgcttgtggggttggagcattt

SEQ ID NO: 519020 - DNA, 903 bp, Homo sapiens
ggtcgtgctgttctacggcaaggcctttcccagtgtccccacgcgaaggcatctgcctgagaggcgcgggtcgaccgcccagagggctgaggaagccggcgccagttcgtgtggctcgggcgccactcagagctatgagctacggcgccccctcccgatgtggacgggtatgacctctctcaatggtggacaagctgacctaccgcaacctcgcccgacacgctgaggcgcgtcttcgagaagtacgggccgcgtcggcgacgtgtacttcccgcggacccgtaaccaaggagtcccgcggcttcgccttcgttcgctttcacgaaagcgcgacgctgaagggaccgctatggatgccactggacgggggccaggtgcttgggacggagcagcagagcttgcggggtgcaaaatggggcgcagctaacggccggcccccgtggagttcgaaaccactagccgcagggggaaccgcacacgcccgacgttacggggggcgtttgatacgagacggccagagagccgaagcccctaggcagaggtaagccagaaggcccgaatccccgaagccgaagccagttcacaaggtctcgacagaccgtatctcgctgtgcaggcccgtctcggaaggttctcgggccccgggacctcgtcctcgaatcatcgggtcggaacctccagggtccagattccgacggagggtccacgtccaggtcctcgtcgggcctccagaactcctcgtccgcggtcacaggccccggtctcgggccagggagtcctcccccatgtgttcagagggatccagtccacgtcggattgagagtcccccgaagttctgaagaggacgagggggcccttacaaaatgtttttggccacgtggtaggggcctggaagggccttgc

SEQ ID NO: 519021 - DNA, 395 bp, Homo sapiens
  misc_feature (1)..(1): n is a, c, g, or t
  misc_feature (393)..(393): n is a, c, g, or t
natgaaatgctttgctacactggatccttttcaacttagcacttacaaatataggtagcttttgcaacactaaactgcattctaataaacagcattcagctaaatgacatgttagttacccccttcctcttccccagttgatgcctcctaagagccgactgctattcttgagaacaaattcctggatactggcattagtgacaaagaagtgtcaggacagtttgccaagaatgttgtttcttcttgtacaacacaaagcaaggaaacctctgtattttatggctttgaggttttaaaaaatgttctgcagtttgattgatatgggcttttaaattcagtgaatcactttcatgaatactgaagtaggtattaatctttcagaactagttaatnca

SEQ ID NO: 519022 - DNA, 158 bp, Homo sapiens
aatcagctcggtccagatatgcagagaacccatcacttcagctactacggggctcatggcatcatcgtggtgtatgacgtcactgaccaggaatcctacgccaacgtgaagcagtggctgcaggagattgaccgctatgccagcgagaacgtcaataa

SEQ ID NO: 519023 - DNA, 339 bp, Homo sapiens
  misc_feature (12)..(12): n is a, c, g, or t
ggcaggagaccngtaggcagaagttgcagtgagctgaaattaaaaaatgccacatgaaataatacagacacaaaaggactgttgctttgggaggctgagatgggaggattgcccgaggccaggagcctgagatcagtgtgggcaacacagcgagataacatctctactcccctctttatgtatttgtttatttatttacatatatatctctatctatctatctatctatcttttttttttttgaggcagaatctcactctgtcacccaggctagagtgcagtggcgcgatctcagctcactgcgctctgcctcctgggttcacaccattctcctgcctc

SEQ ID NO: 519024 - DNA, 118 bp, Homo sapiens
aaaaaagtaaaatgctgcactgcccagcagcccgggttagacgtcctggagccaccttacgacagggctgctcactacctctgctgcggcacttcagctggcagagaggctttcccag

SEQ ID NO: 519025 - DNA, 996 bp, Homo sapiens
gggccccattggcctcagcctttaccatagacatccacaagctggtcctgtctccatccctagtcttccactctggagtctatagccaggtttgtatgtgggggattcagtgtatgcggtacgagtgctcctgaagatagagaagaaaaccccttcttctggtcataagcagagtggcactggagtgaccccgtcaatgagtggacatacattgctgtgtcagtactctgaaccaaaccgatgggtcccagtagcttgttgattcccggttctgagttctccctcctcattccttggttctccgtcagccattgcggttatgggctcggttctgccgtccacgatgatccaggctgatgatggccccggcgctcgaatactgtccctgggtggaggcctctcgtctgatccacgccttgtcttctttgtccctttgtcctccccaggtggtagctcaactctccagacaagttagtatcaaaggcacagcatgtgtgtgcgcttgcgatgcacagcacccaggcatgtgtctagcgtgtcgtcgtgggcgtggccatagaagtgtgccctgctggccaatgtgtaccctgtatgtgccatactgtcgtgcatgtgggaggttacaggttcgaatcctccctggcgtcaacacctggatgctgtggtgaagacatggtacgtacaaaacaaatctgacgcgtgatgtagcacctgaaagagtatcacatctcccggagtgctgtgcaaaattcgcgcttacacaataaaccccttctagtgtgattcgtcatggacataccaaggcctagcgtatgacccaatggactgacaagcaggagttccagactcaacagcgtgggccctatacgcaagagagtacacgcggctatactactcggtcgccgtcaattgtcttatgccatgtctgcacatgagcaatgaacactcgcccccaacagcgagattcggccggctagactcaaccccataccagac

SEQ ID NO: 519026 - DNA, 108 bp, Homo sapiens
  misc_feature (23)..(23): n is a, c, g, or t
  misc_feature (79)..(79): n is a, c, g, or t
cttaggagtggggtggctggaanataagcttcaggtccaggaagatgggtttggagcttatgcttccagccacccactnctgagctgaataaagatgatttaagctta

SEQ ID NO: 519027 - DNA, 154 bp, Homo sapiens
  misc_feature (9)..(9): n is a, c, g, or t
  misc_feature (18)..(18): n is a, c, g, or t
  misc_feature (27)..(27): n is a, c, g, or t
tacccttangaagaacanaggaactcnggaatgaaaaaatactacaaaaattacctaatacattatgaagcattaacaacagaatagtccaagccaaggaaagaatctggagctgaagacagaatcttataatcaacttagacaaagggaaaca

SEQ ID NO: 519028 - DNA, 221 bp, Homo sapiens
cttcgtctaccggactttacggctttttcactccgcagggactgggctactacggactactgctttgtttactacacacggtggtgactgacacggttaccactaacgactggaacttgccacacacgcctcttgaccacattaccgacacgtcctactacgacaagacctgacttactcactgaccggaacgtgtacagacctggacggacactacgaca

SEQ ID NO: 519029 - DNA, 1111 bp, Homo sapiens
tctcagctctcggcgcacggcccagcttccttcgaaagatgtctacgtgttcacgacaactcctggtgcagagcgtcacgcttgcgacgggtgatcacatcttacactcctcgcaatgtgcatagtgggtcgtggtcaaagccttatactaactttgatgctgcagcgggcatgcttgtgagacattggagaacgagccgatcaaggacctagagaggctgtggcatgcaggtcacccattgctcgaacgatcttatgagcgcaaacgcggcagcctaactgtcagcacgcagaccacgggcactagttgggcactatcgacccttaccgagtagtacagggatcgcatgtgccacgacgggaaatcctttgccagtcaggtcagcttgctacacgtcagcacctactcactctgggtcgctaccctgtgcacgtatccggcccgaactctcttcgggtgccccctactttcgcacagcgccaccatcccgtgggtcctccacgcttaattgcatcggcctctctggtagctcttaaacaggcctttcccactgccccgcggcgcctggggaaaccggagctgagtgtactttcgttctctatttggacgtactccattccttgtcttctcaggaccccccacccctcgtgcgcccccttagcccacggcgcatcctattttaagctcgtgcacgcttctccaccccctcgcgccacaagtagtttcttccaatgaccccggccagagcctcgcgtctcgcaagcagtggcaccattctcacttttcgcctgtgcaccaaccacttccttgttgtttgggactttttctccggcgcctcgcccttcgccctttggcctttggccccctgtggcccaatgacgcgcccttcatacacacgcactggtcgtgttcatcggtactttgtgcgcgtccctggggtccgctgtggggccttttcaccttgtacccctgcgttttggagtccccaaagcagcttggccttcccggcgtacttccctcctttagtggagacggcccctcgcgcccgtctgtccccacccgcgtcaccccgcgcccactccgtccgcgcgctttcccccctacgcttgg

SEQ ID NO: 519030 - DNA, 195 bp, Homo sapiens
  misc_feature (48)..(48): n is a, c, g, or t
  misc_feature (141)..(141): n is a, c, g, or t
ctcctggactgccctccagaaggagctctttccctttgagcagagcanagcgggctggggggagaaaagcagctcacactgggtgcctggggtgggggggcaagctgacactgaaaagggttttgcactgttttttttggnttttttggtcttttttggttttttcctttaaaataaaaacaaagaaaagctctg

SEQ ID NO: 519031 - DNA, 165 bp, Homo sapiens
ccccccttgggttcccttccagttttttccccctttttttcccaacccccaaaaaaaaagttaacacccccccctgggaacccaaaaacccccctaaaacccccccgtaaaagggggcccccttatttttcccccccaaacaaaaaaaaatttggttgcccccca

SEQ ID NO: 519032 - DNA, 328 bp, Homo sapiens
  misc_feature (8)..(8): n is a, c, g, or t
  misc_feature (38)..(38): n is a, c, g, or t
  misc_feature (44)..(44): n is a, c, g, or t
  misc_feature (181)..(181): n is a, c, g, or t
  misc_feature (227)..(227): n is a, c, g, or t
  misc_feature (271)..(271): n is a, c, g, or t
cagtatanctgtagagagcacttaccatgaatggagcntgcagnagtagaagttgctctggatgagtcagtgagtgagtggggagtgactgtgaaggtctaagacattactgtacaccactgtagactgccatagccttcacaaatactgaactaaggatatacacagtttataaaaatantattctttcttcaaaaataaattaacctggctgggggtagtggctnacatatggaatcctagcactttgggaggctgaggcgggaggatngcttgagcccgggagttcaagaccagcctgggcaatatagtgagaccctgtctctac

SEQ ID NO: 519033 - DNA, 118 bp, Homo sapiens
attccgggcagcgatggggcaccaaaaatcgccccggtccgacacgaccaaggaaaaccctaccccttcgcctaccaaggaaggccaggggaggttttgccccgccaagccccccaag

SEQ ID NO: 519034 - DNA, 147 bp, Homo sapiens
acgacgggctggtggatgcatctggattgagaacataacacggtgctggatacaacaagaagctgtgcctcagctctggggagatcatcaaggtcacagaggcaatgaccatgatgttcgaggtgcaaagacctggcggtggcttca

SEQ ID NO: 519035 - DNA, 702 bp, Homo sapiens
ctgcagcagtagttcgctcatgtacaccaacgcgttcggagtgttcgcgcacacgcacgctctcatggctgtcacttcccgccccacaaacagtctcgcagcgagagaattcggggggcattcatacaacagcgcgcacagcagagtccccaccccccatgcgtgcttcccgcggcgccctactagattaggcgatggtccacccctccttgtaatacgactggtaaatacacacatcacaaaagatgcgttgggtggtgcctgttactatataagagagcaaatgtttcctggcgtgtgccacagctaacatatagggtagtctgtgctgggggcaaagatatatagtgtggtgtgcagcacagctgagacgcgctcatagatcttaatgaagattatacgcccgtgttttgtgtgagcaaagatatatctttttttgaggaaaggtctctgtctatatttccgtccgccgcatcgtcgcctcgcgtatagacacacaccgctgtgtgatagtgtggccctctcttgaatacgactgtgagagagggtctcttataaactccccaccgggtggagagttgctacctgttccctctctcttgggaaaagtgaggggcgatcatatacaggatgttctcttagaggtctcccactcgtggagggagttagcgagcgccccaccaattagacagaaacagacac

SEQ ID NO: 519036 - DNA, 989 bp, Homo sapiens
gggacgggcggtgctccgccgcggtgccggttgttatcgcttcgcataacctactcaggcagcagctgagaagaagttgagggaaagtgctgctgtggggtctgcagacgcgatcggataacgtgcagccttatagatataacatcgcccccttctgcttcagtgtgagacggccacgttgaagatgctgcgcgcagtgagaaatggttcgaactcgtagcgaaagccaagagggttgcatgtgagcgtgagatcaccaccacttgacacttccatgcctgagcgaacagcacgcagggactgcttgtcaaaaaaaaacacagactctggggggaaaactgcttgctcgcatatcccgcggacgaaatggtgggctgctgttggctcacgccatagggagggacctcaccgtggagaatccagtgtgaacatagcagagatggacctaaaacaccgggccacgccggactagtcgcggggcagaaaggctaaaagccctcactgatgggaacgtattaggcccctttaaccattatcacaagattcttgcgtcgtgaaaaaaggaggctcctcaaaaacgcggggcagttcctcttttcaaccttcatgtgatctgtgggcgcccctttttggggacgggaacctgccgtttgaatgattcctccctggagacagattattgttgaaaaaaccccgctgagacatacgtggccaggaatctggttaggcttgtgaaaaaaaccccacattctgcatgtgtgccaatatatcagcaaaggatgttcaattgagaaatccccaataatagtgccaagggctgtatcttggggaagattgcccaccatatcggtggcagaatagaggctgtaaatgctcgacaggcgcatggtgcaaccacctgagacgagggatgtgtaatataaggtaaaaggaccgctctgggtaaacactggaccactcttggaatgtactagggcctcgacagggat

SEQ ID NO: 519037 - DNA, 251 bp, Homo sapiens
aaatccaatccaaggtttcccaaatcgcccgcacatccaaaggggccttctcccacctacaaaaccaaagagggcttccccaagggggatcaagcaccggaagacacaaacctaaaatgcctaacgctaaaagacccaccaacagagtctaatgcggccccgtccctagaaggagccccgagcctccgacgcctagacccccaaaaccgcgacctaactcgactagatcgagaaacctaaccccccggaat

SEQ ID NO: 519038 - DNA, 190 bp, Homo sapiens
tcgtgagcggttcttaagtctatgtcagtagttcggcagagcaacttcacatagtgctcttcccttcccagccacagcactatcatgtttgtgagcttgagcacgtgtgtgctcgctgccatgtagtcatacacgccagcagcagtgccctttgaccaccaccgtcaaggagagcccgcttcgacagtgc

SEQ ID NO: 519039 - DNA, 371 bp, Homo sapiens
cccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctgtaagggctccaccctgaagccagtaatccaatgaagaaacttaaaaattgaaagataaaaaaatcatataactaccggatccccttctgtctgtgtatttatatgtgttgggtgtgtgatgtttatataaaacatgttaatgttcctatttagtga

SEQ ID NO: 519040 - DNA, 395 bp, Homo sapiens
  misc_feature (33)..(33): n is a, c, g, or t
tggcctcctgagtacctcgcttcgggcggtttnatcttcacttcctcatactttcccccatttttcctagaaccgggggacctgggattccttgaggttgccaatggggtagttttcccgtttgaggcccccttttgtttaataattacatcacaaggggtttggcattcatggggtgtccccccattagggttaaaaacagatgcaattccggggggttttaaccaaacccttttccccgctaaccgcccgggggtatattcgggtcaatgttttgaaatttggggggcaaaccccagttttatgcccttggtcctagaattaattcccctaaaaatttttgaaatgggggcggtttttaccctatagccccccctttcccccctttagggcca

SEQ ID NO: 519041 - DNA, 204 bp, Homo sapiens
tagagagtcggcgggaagctggctgcagtgtggagacgcgttggtcatgttggacagccccagcccaggccccgtcaccagttcatgatgcagttacggttcatgagtcatgaagtaaacttggcttgctgccccacagagcgtgactgactggcaaacacacacctttgtcattcctgctcacacatggaacttgatgcctct

SEQ ID NO: 519042 - DNA, 379 bp, Homo sapiens
tgaaacacccccagcgtactgtctaatcaccattctactctctacttctgtgagtatgacttcgttagattccaaatatagtgagtctcagacacctctgacatactgatttcaattcctttggatatatactcagtaatgggattgctggatcatatagtaattctatttttagttttgtgaggagcctctacactgttttacaaaatggctgtatttatagtttcaccagcagtgtataagtgttccatttctctgtgaccttgctaacacttatctttcacctttttgataatagccagtctaacaggtgtgaggtgataccttattgtggctttaatttgcatttctcttatgattagagatgttcagcattctt

SEQ ID NO: 519043 - DNA, 424 bp, Homo sapiens
  misc_feature (66)..(66): n is a, c, g, or t
ctaccaatgaaaatataataaataattattcactacatatgttgaaatgacagataatacaggaanagcaagaagagcagaggcacttagagcctgactatgaggtctgcctagctgcttggcagatagaattctctcatctggccaggcacagtggctcactcctataattccagcactttgggaggccgaggtgggtggactgcttgaactcaggagtttgagactaacctgggcaacatggtgaaaccccatctctaccaaaaatacaaaagttagccgggcatggttgtgcatgcctgtagtcccagcttctcaggaggctgaggtgggaggatggcttgagcccaggaagcagaggttgcagtgaactgagattgcaccactgcatgccttcctgggtgatagagtgagagcttgtcca

SEQ ID NO: 519044 - DNA, 398 bp, Homo sapiens
ggctgatgcatcagagagtggaactgccagcagctaggcctatgtgtctcagaacggctgattaggataagggactagaagtactcccaggtcctttataggtgagggatactttacaggactgggtatgggtcagccagtcgagaaagtagccttcctaggagctttacattggacagctgctgccccaccgatacatcttggcacacaagagttaggccactgtatctgtcctgtcccacacacttgctccagatgatctttaccacatgacacatgaacatacactgtgtacacctggagcccacctgacatggagctttggactgctccacaagtctccagcatgcctttggaagcccttctttatagggaactaaatacagagttaaacaggt

SEQ ID NO: 519045 - DNA, 798 bp, Homo sapiens
  misc_feature (738)..(738): n is a, c, g, or t
  misc_feature (750)..(750): n is a, c, g, or t
agcggggggtgtggtatgcatccgaccgagtcggaccggccagttgggcgcgcttccaggtgtcatcctccacggagggcgccaggctgcgagatggccgccctcagcagtcgcaaggtccggcagcgctagcgcggaggtccggcaccgacgtcagccacctagcgcagccagcgcaatgaaatggcgctgtggtctgccagtcagcgtcacgccgaggaccaacgcgtccacagcttggtaggcagagcaatgattagtgcgccgctgggaacggggctatatcgtgtgctggcttggggtatttctcctggtcagagatacgctacgaaaggaactggagacacgagtgggtccgtacatatgattcttacatacgctgtgtgtgagtgtagcaggagtgatgagtgcggcaagccatctggtcgcaagcatgtgtgatggacgatagatcgagtcacgagtattctgctgtgtctagcctacgattttagcgctctcagtgatgtcctgcatatggtgagactaagcgctgaatctctcctactcgtatgcctaatgcccgatcgtgaacgcctagggcaggtaccgggcttcataccatacaatgcgtgtccctggatgcaaggcttggggtaacatatcattatcgtggctctgcgagcttgttctaccagattggcaatgttttgtggccctaccattgcggcgggttgcacattcagcaatggattgggncctgtgaccatnagagctggaaatcgccaagctcccggacaactgctaaccttctgaccc

SEQ ID NO: 519046 - DNA, 388 bp, Homo sapiens
tagagatggagtctctctattgcccaggttggagggcagtggcacaatctcagctcactgcaacctccacctcccgggttcaagtgattctcctgcttcagcctcccgagtagctgggattacaggtgtgtgccaccatgcccagctatttttgtatttttagtagagtcggggttttaccatgttggccaggctagtctcgaactcctgacctcagctgatccacccactttgggaggtttttataatttaataatattatatttaggtttatttaatattgaataaatgattttatctaatatttgtaataatgaattttgttgaaaaatggaagatagttatgttaaatagggatttaaaaattgatgtgtttttatatgacgtt

SEQ ID NO: 519047 - DNA, 228 bp, Homo sapiens
tgagacaatatatccatcgagcctcttttacaactagtcggacttgtacctgtgggcttcagtgatgggatagtacacttcactcagaggcatttgcatctatacataatttcttaacaagcctctcaaaagtgcatcagtgccttgatgccacctaaggaaattagttaagattgaatctctgaaggctctatgaaaggaatagcatgatgtgctgttagaatcaga

SEQ ID NO: 519048 - DNA, 182 bp, Homo sapiens
tatgagtatctccagtaacttttccaccttttccgaatgtatgtagcaccagcagaattttcaagagctctcaacatctactgtttagagactctactagcctgacgatggcaagtgtggactatagatctttggcgtttctcatggatctacaagtgagtaagcagaagtaagctgtagtc

SEQ ID NO: 519049 - DNA, 199 bp, Homo sapiens
aaggggcatctcggtcatgtagcgtcaccttctgtgttccagcgatccttccttagcctcccgggtagctgggattgaggcatgcgcaccatgccgggctaattttgtattttcagtggagacggggtttcatcatgctggccaggctgttctcaaactcctgacctcaggcgatctgcctgcctccgcctcctaaagt

SEQ ID NO: 519050 - DNA, 138 bp, Homo sapiens
tcatgagtccagccgtacgagacattcctactgtagaatagtgtcagtgttttcctataagctcggtgtaagctattcattatatttgtgcttaaagatgttccttcattcatcaacgtaggggaagtccagagtgcg

SEQ ID NO: 519051 - DNA, 301 bp, Homo sapiens
acacagctataccaacttttccagaagatattggggttcggtgaggtgtaaagaaaaagtgttcatgtaaattctggtaattaaagctgttcagtgtggtatagttgggttgcatctgtagcccttctaaaaattggctatcgattttcttttagcctaaagactttaatatacttcctcctcattctaccctcaggatttggatctttgccccttatgggtatccatcccctttgaaacttcagaaaggcatgttactatactgtaatgttcaactctaaagacatttcctataaggggc

SEQ ID NO: 519052 - DNA, 126 bp, Homo sapiens
gggtcgttttctgagcgcgagtcggctgacacgagagacggtcagtgagcgaggcgcatgctgcgagggaagccagcagtcatcccgggcattgtgaggtacgagctcgaatagaatcatgtctag

SEQ ID NO: 519053 - DNA, 138 bp, Homo sapiens
gatctatgaatgaggaggaaaatagattcgagcgatgttttatctttggtgcagtttgggcacttaaaatgagatctttgtttactggatttgcagcgagaggtgtcagaacaagttaccacagggtcttggtgacgg

SEQ ID NO: 519054 - DNA, 4707 bp, Homo sapiens
  misc_feature (836)..(836): n is a, c, g, or t
  misc_feature (2250)..(2250): n is a, c, g, or t
  misc_feature (3569)..(3569): n is a, c, g, or t
cgacactcttgggtagggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatngggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgctaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacagcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccantgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgtgggccaccagggccttccattccaggcccaccaggaccccgaggcccaccaggggagggtttgccaggcccaccaggcccaccaggatcgttcctgtccaactcagaaaccttcctcttcggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggaccaaaaggtgacaaaggtgatccgggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacatcctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctggnatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctcca

SEQ ID NO: 519055 - DNA, 692 bp, Homo sapiens
cgacactcttgggtagggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagatggagcaggtgagtgaccctcctgtaactagggtgagcatgcctcgtgtgctccagtgagttatgtacgctgctccatgagtcagcttgttctcaccgctcatcccc

SEQ ID NO: 519056 - DNA, 183 bp, Homo sapiens
acaaacacaaaagaacaaacaaaaacaaaaatgaaagacaggattacaagtggagaagatggctcattctccatctgcctgccaatctaggaggttaacctatatgttttcttccctatctctactttttctcattcccccccacatatccctgtacatccttcttctcatcttttctacttt

SEQ ID NO: 519057 - DNA, 393 bp, Homo sapiens
agaggatacactctcgctactgtatcctacaaggagacttgatagaagcacgatgaccaaatctattgactaccttggtagcactgtgtacatatggaagagaatgaattgaattaaaattataatgtttgaattatttctagaaacaactctggaatgcctactatgggttggtgatatataaaatgatggtaaatactgataagaacaatggtgactaacatttgcttgaactatgtatcaagcaccacagtaaactcacatggtgctcacagtgttatgataagaatccccattttatccccattttatggatggggaagcagacacagagtttaagtggcctgcttgagggcatgcagataggatacagtacggagagggtacccagct

SEQ ID NO: 519058 - DNA, 403 bp, Homo sapiens
cgactctagagaccgcgtatcgtacagtattgcatagattagcattcatcgttggttgattactccaattttttatccacagaagcttcatctaataggatctgcaattctctagttctgataatatgaattggctccaggttgccagagcctttcagtctgagaactggttctacagctaactttgtaaagggcttggtgatgagtaagaagttttgggataatgttgtgcccgccatattcattaaatcttgacggatttaacttcatcggaacatgatcaactgcagaactcaacagcgctctcttgcagccttcgtggcttctctccaacccgctatgatggtctgtggatgaatcttttttgcaattaaagattctgcttcccttaataattctgctg

SEQ ID NO: 519059 - DNA, 1418 bp, Homo sapiens
tgctgtgagtctggctgcgtggtgctggcgccatgtgatgtgcctgagcgtgggtcccgatgcgccggcactgcggagctgtagcagccctgggccagactgccggaggagtggctgcgcagtgccttgtgcctgagttctgcggctgctgcactgtgccctgtgcgctgcgctgcttcgggggtccccgaactgttacttgggtgcctgcctcctgcacaatgctggagcacgagtgtttttccgacgcttggcggaacgctgttctggcgatcacttgcaagcttggcacggagggctacacacgacgggcacgcgacgggaccgagcgcacgccccgtgcacgcgctgccgctgcccgccagccacgcccaagctccgtggtcccaccgcgaagctgctgctacaaaggctcgatcagctagagccacgtggacgacggccggggcatccaagggcagcctctaacccccacaaccacgccattcttttcccttctattctgaactcacggtcccttgggaactggttgccccgctcgcttgcggaagcactgccctctgcgcaatgtccagctgccttggcgagcgtcgaatgagagtgcgccgcctgggggccttgcgcctttggcggatcccctggcgctctttgtggccctaagagcgccctcggcacttcgctggaccagccttctcgggaagcgtttcctccagctgtggcttgcaaggccattgtgacctctagggcttcatcgacgtaatggtggtctttggttggcgcccccctttgctgacctttgtccgtttggcgtaaatggccgtgaacggccaacctttggctctgggcgcaacacacggctttccaccacacacacgcgctagtcgcgtaacagtcctccgttaaaccacgatgaacgatcacttcggtgcccccaccgcaactatccgtgcggcggcagacatcctagctgtgccccttcgacaccgtgcgcaacgtgcaaaggccgagacttcggcgcacactggcggcctagtagatttggtcgtctaacacttacactctccaccctgggggacaactcagtcgctacagcgttccaccgacgagctcaatcaccaacatcagtactcaacactttatctcaacatctatcaactaccaggccacctggcatcaaacatcattactgacacacactcacttcctcccatcatcctcaccaccaccatacagatgctcaccaaccacccacccactatcataccatttctcgccgttcatcccatacttcagacgccccgacccacatatcactcaccactgcaatacgacagtctccacctgcataaccaacaccctgcaccatgctcatcattaacatctaccctacaccccgtcaattataacggacctgaact

SEQ ID NO: 519060 - DNA, 1049 bp, Homo sapiens
  misc_feature (1049)..(1049): n is a, c, g, or t
agtggagagagggaaggggagggagaaagtggagggggagggcggagataccaccaccaccaccatcaccaggatgccagacgtgaaagagagggcggcccggaaggagcccggcgcggcagagagcgcctcccgtgaatcccgcgggggaaacacccgggagagcgcgagcagcgcccaggggcaccgatcgtgtaggttcaaccgtcgcccgagcacggccgccctcaccccagggtccgcgcaggggcgcggggtaaagacggcgccacgaggtcccgtgggccacggaggactgcggactggcccgacctcccggtgtccccagccctccgcccgagcgaagctcccctcggtcacgcgtggggcaccgcttccgccatccccgggaaagggccacctcggcgggaccccgagctcgcacaggctaggtatgacggagagagtccatgacgcttccaagcttgattgtcagttggcaagaaaggagtttatcttcaagcagcctgaaaggcaaggtcaaggacaccatgcccagcgacttctgggagcatctgaatgagcagctgtcagccgtgcccccgacttcagctgtgctcttgagcttctgaaggagatcaagagatcctgttggtcctgttggtgcaagggataagccgctggaagaatgagatcgaggaagcttctggacctgggagttccttcaggcagcaggccgaccgggggaacctgaatgtgttcttactctcccagtattatcctcaactgaagggcttgtgtgtggaccaaaacgaaaaacaggcctgtgaccaagactgggaacctttccaaacccgcggacggagacgacaaagggggagatcccaggggttgtgaccaacagaacatgggaacgtggggaatacacaacacaaaaagccccagccccgcgaacgagaaactcgccacaaagaagggggcacaccacagaggccacaaaaacgccaagacgatacaacccagagggtgcaacacgacagaagcacaaatacgctccagacatggaagan

SEQ ID NO: 519061 - DNA, 292 bp, Homo sapiens
gcatacctttcagacagttctttttgatgaattcgcaacgcgccaaagtaaagactaggtaaagtttgtaccccgttcgtcacttaacatcgaaaccgaattaaacacctgctttgggcagttccatgaatacgaaaataagcccgcaaatgaatggcttccgccctccccgtctcaacttttgacacgtttatatgtatataaaaccatacccggcggcgacgacttcgatgcgctgacggcggaacgctatggctggctcaatcgtgcgttaccggatgtcgagctggat

SEQ ID NO: 519062 - DNA, 449 bp, Homo sapiens
  misc_feature (27)..(27): n is a, c, g, or t
  misc_feature (49)..(49): n is a, c, g, or t
  misc_feature (104)..(104): n is a, c, g, or t
ttcactgggagccactttttatgtagnctttggtgaaatccaccaattnggaatttagatgtcacctgagggaatcatccaaatatttttcctcctgatagaanggataaattagacacattctaaatcaatgcatgttcaagcgaattgtttgatttttcaaactcatgtatcaacttaaatgacaaatcggactagataccttcaatatattctggttgtctttcgcttttccaaagtctggatgggagagagtggtaacgtggaggaaaaagttcagaagctgaatgtctttgtgttggggatgtgggtgggtgagcacatttgtgtgtgcaacaaataataagaaattaagataagggaacaacatagtgtacttacaatgtgattaagaaagctggagcttggctttgaagatttgcaaataaaaataaaaggggatggaaaat

SEQ ID NO: 519063 - DNA, 248 bp, Homo sapiens
  misc_feature (147)..(147): n is a, c, g, or t
ggggggggggttttttttttccccccccccccccccccccccggggggggggaaaaattttttgggccccccccccccccttttttttaaaggggggttttttttcctaaggggggggggttgggggggggggggggtttctccccngggggggggtgtttttccttttttggttttttttaaaaaaaatttggggggggggcccggggccctttaaaaccggggggggttttttttttcccccccca

SEQ ID NO: 519064 - DNA, 731 bp, Homo sapiens
  misc_feature (707)..(707): n is a, c, g, or t
ttcgttggtgatcctctcttgtcctcctgttctttcggtttatgcgttattgttggtatgcagcgccattttagaggctaactttcaagcagttggtggtaggtcgctggacaagttcctgtttggctcgtctctgaggagtatcctcgacctccgcttgacacttcggaccctattccccactctggtggggacgccagcagcacctgctcactctcagcgattctgtcttcagccacgacccctctgccatttgggtatccagctccttccccttcgggtctggggtgcagacatgagcaaggctcaaggtctgtgcaggcacataggctggtggccattgggccttggggctcagccacagcatgacacagtgctcagacaattgatagcaatggggcaccaatggcccagagttgctgtgccgtgtcacaagggcagtgcaccattgcaccattggagcatgccagtgcactgtggtccatgatggcccaaatgtcagggttctgctcggcattcttggaccattggcgcattagtccccatcccagggttggacatgagcaaggcatggagagccatgcatatgctaaacctcctgccgtcacacaataccagcaggaggttcagggccatctgaaccccctattccccacaccatcacaacaatgcatgcatgcatgccccagcagtcatgacgggagcantggcacctgaaacccagaggagat

SEQ ID NO: 519065 - DNA, 327 bp, Homo sapiens
ccgcgaatgtgatcctcccggtacgttaatccaagcagctgaatagcccagccttcaattatcaagcgggaagattcgtcgggatgtaagagctcactctcgagcttgcccacactttccacaatcactggatcattaaagccaaactgcaatgaggaagaccttagtgtgtctacgattgtcggctcttgatcgatgatcccgtcatctattagcgtcacgaaatatgaatagtcccctgtgatttttacaaagccatctatttcggagtttgcgggaatgaaaaaaagcctgtctttgaattcaaggctgcggcgcgattgccgg

SEQ ID NO: 519066 - DNA, 372 bp, Homo sapiens
  misc_feature (321)..(321): n is a, c, g, or t
caaatattcagtgtagagaaaacacccggccaagatttacgttgttgttttttttttaattttactctttaattttttttggagacaaggtcttgttctgtcacccaggctagagtgcagtggcttgatcatagcccacagcagcctcaaactcccaggctcaagccatcctcccacctcagcctcccaaatagctgggactatagttgtgcaccattatgcacagctaatttatttttatttttttagagatggggtcttgctatgttggccaggctggtctcaaattccctggcttcaagcaatcctcccacctcaagnctccccaaagcactgggattacaaagcatgagccaccacatctaagtgaga

SEQ ID NO: 519067 - DNA, 393 bp, Homo sapiens
ccgtgctaatcttatatgtgtttttcccatttcagcatgtgtgcaaccaaagtgagcatattggtactgctttaaggattggtgtctctacactatagtacatgttatagcaagtttaattctgttttatcctttcaggaaacagtcttttcagtttctgaagctttaaaaacaactttcttcccactaggtccttgaggctcccaaatgtgcagctcagacttttggtggctttctccaggaaagcacgttccctgacatgaagagttctgaaggctcaattcctctttctagcttcttctgatcctatctaaattgccacctggttatgccctactatctcactagttcattgatgctattaataaaaacataaaaaagaaacaaagaaaa

SEQ ID NO: 519068 - DNA, 268 bp, Homo sapiens
tagctgcattgacatcaacagcgcgagcagcatcagcagcagtagggtaccagttctggcatgtgattcaacggctagtagaggctttcatcgtagtatctctggaagcactgagactgtcccctgggtaggaggttcctctgtagcgagcagctacggtcaggtatcttgagagccctcatggccaacatgctacatggcctgacatcccaaatagtcacagtgccctgggaactcttgtgtatatctctcagacacaggctcatgc

SEQ ID NO: 519069 - DNA, 3231 bp, Homo sapiens
gagagagataggctttccatccatggcagccatttacttttgctctgggagacgtttgtaatagaaaaggcacaactggggtatttattcattccccccgttcctctagtgtttggtggcgttgccgttgcaagtgcgcagggctaaaatgaactggttatcttaggatcatggaaaacctggaatcaaggctcaagaatgccccctattttcgttgtgagaagggaaccgattccaaccctctatgccggaagtgtgagacgtgtgtcttagcctggaagatcttctctaccaaagagtggttctgcaggatcaatgacatatcacagaggaggtttctagttggcattctgaagcagttaaatagcttatatttgttacactatttccaaaatatccttcagaccacacagggaaaggatttcatctataacaggtcccggatcaacctcagcaagaaagaggggaaagttgtgaagtcctccttgaaccaaatgttggataaaacagtagaacagaagatgaaagagatcttgtactggtttgcgaacagcacccagtggaccaaggcgaattatactctcttactgctgcagatgtgcaaccccaaattactgctcactgctgccaatgtgatcagagtcctgtttctgagagaggagaacaatatctcagggctcaatcaagacatcacagatgtgtgtttttcccctgagaaagaccacagctccaagtctgcgacctcacaagtctattggacagccaaaactcagcacacatcccttcctttgtccaaagccccagaaaatgaacacttgcttggggcagcatctaaccctgaggaaccatggaggaattcactccggtgtatatccaaaatgaataggctgttttctggaaaaggagacataaccaagccagggtacgatccctgcaatctattggttgacctggatgacatcagagacctgtcttctgggttcagcaaataccgagacttcatccgttacctgcccatccacctctccaagtacattctaagaatgctggatagacacaccctgaacaagtgcgcctctgtgagccagcactgggccgccatggctcaacaggtcaagatggacttgtcagcgcacggcttcattcagaaccagattaccttcttgcaggggtcctacacaagaggaattgatcctaattatgccaataaggtttctatcccagttcctaaaatggtagatgacgggaagagcatgcgtgtgaaacatccgaagtggaagctgagaacgaagaatgagtacaacctgtggactgcataccagaacgaggaaacgcagcaggtcctgatagaggagagaaatgttttctgtgggacctacaatgttcgcattctctctgacacgtgggttcaaaaccgagtcatccactattccgggggagatctgatagctgtgtcatctaatcgaaagatccatcttctggacatcatacaagtgaaagcgatacccgttgaattccgaggccatgctgggagtgtccgggccctcttcctgtgtgaggaggaaaactttctcctaagcgggagctatgacctaagtatcagatactgggatctgaaaagtggggtttgcacacgaatcttcggtggtcaccaggggactatcacttgcatggacttgtgtaagaacaggctcgtatctggaggaagagattgccaggtaaaagtatgggatgtagacacagggaagtgcctgaagacgtttagacacaaagaccccatcttggccaccaggatcaatgatacctacattgtgagcagctgtgagcgagggctggtgaaagtgtggcacattgccatggcccagttggtaaagactctcagtggccatgagggagccgtgaaatgcctgttctttgaccagtggcatctcctctcaggaagtactgatggcctggtcatggcctggagcatggtggggaagtacgagcgctgcctgatggccttcaagcatcccaagatggtggtcaacacagagagcaatgttctcatgttccagtttgagcacataaagtggcagtatgccgtggaaaaaacgaaacaaaagaagaataaggagaaagaggaggaaaaagaagaaaatagtctcatggaaattctctctaagtgtaatattcaggttcacagcccaagagagtctgtatccagtaaacaaactgtgatccaagagctcctaccaggcaaacctcccaagtcccgagtactcctgaagccggccaagttctcttcagcagtgttaatagaggaacttcaaagtcaaggaaagtcaaaatcaccccgaagagatgcagatgatgtggagaaagcacaaaaacaaggacaattggaaactcctggaaaactgcccagtcacccaaagaaaaagtcttggaaaatccctatgtcacctgaccaattcctcctgactgttagcaccctgcagcacgcccataattccggggaatttgcctatccctgtaggccccaaacagaaattactgatgtctggggaccttcaatttcatacccaaggaaggtcttgaatttcaaaggaaaatcaatccaacgtgcagttgatcggttgagattgagcaatcctcctatagatgtgaaacgaaccagtattccccttgaaatccagaaactgcagcccaacttgaagatctctttgcacagtcctagagtccagtccaccataccccagcccatgattatccgctccaggttctctggcagcttaaagggtggagaccaagtgaccagttcaattgaaagggctgtgtgcagtacgggtcccctgaccagtatgcaggtcattaaaccaaaccgcatgctagctccacaagtgggcacagccaccctgtctcttaagaaagaacggcctcgcatctatacagcccttgatccttttagagtgaacactgagttcgtgctgttgaccgtgaaggaggagaaggagcaccaggaagccaagatgaaggaatatcaggccagggagtccactggagtggttgatccaggaaaagtcagcaaagctgcatggatcaggaagatcaaaggcctgcctattgataatttcacgaagcaagggaaaacagcggcccctgaacttggacaaaatgtatttatctaaaccagccttgggaaattacaatgttttacaataaacagaaagccaagcggaaaaaaaaaaa

SEQ ID NO: 519070 - DNA, 190 bp, Homo sapiens
ttatagaggatccctcgaaagagaagggtggcttggtgatgtctagacccaagagcaggaggtgatgctactgactcaagtcaacacagctcttgataataaagcttcattgctccatatcaatgcctactcactcctcttcgacgctcttcgagactataattcccatataactagttcagataagcat

SEQ ID NO: 519071 - DNA, 180 bp, Homo sapiens
cggacctgcaattagtagtaccaatgcggaggctgacaggtagcgtttatccatgggctccaaatagacgtcagtgctgttggacgtgggagtgccagagtggtacatgtaacgtcaacggaggttggctgaatggaataccacatccatggccatggcaacaaggcttgcccagtggct

SEQ ID NO: 519072 - DNA, 117 bp, Homo sapiens
aaactggattagctgacgtcagctgaccacagacactgaggatgcactgttacatctaaagtcacagtgaccagagagggcgcagtccccactgaacatctggtataatactgaggg

SEQ ID NO: 519073 - DNA, 208 bp, Homo sapiens
tcgtctctacacggatcccctctaaatgctacccgccgggacactgtagctgggttcacgaccgtcgtgacacaggtctagttttacccctacctgatgatgtgttcttgccattgctatcctgctcagttcgacaggaaccgccggttctgacatttggtgtatgtgtcttcgctgaggagccacggggcgaagctaccatctgtgg

SEQ ID NO: 519074 - DNA, 85 bp, Homo sapiens
cgggaccctttttttttccccttaaagaatacccaggaaagaaatataactaaagggaggaaagggcccggtttttttcccccca

SEQ ID NO: 519075 - DNA, 988 bp, Homo sapiens
  misc_feature (600)..(600): n is a, c, g, or t
  misc_feature (619)..(619): n is a, c, g, or t
agcggggggggctgacggtccgcgggcgtaagcggactgcagccgcgatctcctggaggcggcgggatggaggcggcggccgagcctggaaacctggccggcgtcaggcacatcatcctgggtcctctcaggacaaggggggcgttgggaaaagcacgcaatcatccacggagacgtggccctggctacttgctgcctatgctaggctaagtaaggtgggaatcctggatgtggtacctgtgtggccccagttatcccctcgcatgctctggggtcgcatgggacaggggcatgttggctagccagattgcgagctcgcgcgcgtggagcaacccgttgcgttcctgagtaccgtggcagtcagagcaatctcggctctatggtctgtaggcgcgttccctgctggtaggaagtgcggatcgatggccgtgagtgttggatgaggaccctaatgaagaaacgttgcttggagtaaagacgaagtttgtgatccagacctgtgtgccatgggtgggtacgctggaatctacctggttgggtgtgaccacggccgccccgtggggcaacctcccgatgtacgcacaattgggcccatctcantatgaaagctccatgcagntctcgcttaactcatgccacacttgcggggagcctctccgttcggtttcagcactactggctcaccaagagactgagtggtacctggtgtgtggggaaccgttgtaggagcgactgaagtctagtaaccttacatgtaatggcaagacggggcattgctggagttgaatggtgaattcgttggagaaagtatgagcgaggttttcatctggccactacaccttgcaacggaggtgcacccatgcgttctttctccagtggggcgggcggacagagtgaagcttggaccccaggactccgccgtggagtgcccctttcgttatggctcgccgtagccccctgggacctctgcgctccattggaggaaccc

SEQ ID NO: 519076 - DNA, 354 bp, Homo sapiens
gttgagtcacaaatatcacttgtgtccggagtgtgtaggttgcactggtccgagatagtgccactgaactccagcctgggtgacaggtctgttttgagacggagtcttgctctgtcgcccaggctggcacaatctcagctgactacaacctctgcctccaggttcaaacaattctgcttcagcctcccaagtagaggggattacaggcatgcaccaccacgcccggctaatttttgtatttttagtagacacagggtttcaccatgttgcccagtctggtgtcgaactcctgacctcaaatgatccacaaagtgctgggattacaggtatgagccatcacgactagtcctcgtg

SEQ ID NO: 519077 - DNA, 594 bp, Homo sapiens
  misc_feature (573)..(573): n is a, c, g, or t
tctttttttttgggggggagaaaaaaaaaaaccccccccccccccccttgtttgttgtggcccccccccaaaaaaaaaaaaaagaccccccccccccgtctttttttttttttttggggaaaaaaaaaaaaccgcccggttggttttggtttttcccccccaaaaaaaaaaaaaaataaaagtttttttttataataaaaggggcgcccccccccccccggaggtgtttttttttcccccccctggggggaaaaaaaataaaaagggggggcccccccccccccccccctttaggggggggtttttttttttggggggggccccccccaccccccccaaaaaaaaaaaaaagaatcctttttttttatttaaaaaaaacgcgccgggggaaacccttcttcgcaagaaaaatttttggaaaaacctcctcctttttcaaaaaaacccgcgttataaagggggatgtgggggggttttttttttttccctttgggaaaacgagggggtttttcccaaaaaggttttttccacgcatcccttcagtttctgggagaccgatcttgattttccagnaaactgggcacgtcccgcctg

SEQ ID NO: 519078 - DNA, 380 bp, Homo sapiens
gccttggctgactactcgcggagcttaatatggggcactactcgtatcattcaagattaagtcttgggttatttctttgataagaactgaatgtggccgggcgcagtggctcactgcctgtaatcccagcactttgggaggccgaggtggtgtggatcagaaggtcaggagatcgagcacatcctggttaacacggtgaaaccctgtctctactaaaaatacaaaaaattagccgggcgtggttgctgggtgccctgtaatcccagctactcgggaggctgaggcaggagaatggcgtgacaccgggaggtggatgttgcattgagccgagcattggccactgcatccagcctgggcgcaagagcgagatgtctcaaaaa

SEQ ID NO: 519079 - DNA, 300 bp, Homo sapiens
ttttgagacagggtctcaccgtgtttcccgggccagagtgcagaggtacaatcagggatcaatggaacctccatctcccaggtccaagcaaacctcccacctcagcctcccgagtagctgggactaccagtaagcaccaccatgccctgcaaattttttaaacttttatagagaaaaggtcttgctatgttcctcaggctggtcttgaactcctaggctcaagtgatccccttgccttggcctcccaaagcactgggattatagtcacgagccaccatgcccagcctcatcatgtttttt

SEQ ID NO: 519080 - DNA, 425 bp, Homo sapiens
  misc_feature (343)..(343): n is a, c, g, or t
  misc_feature (395)..(395): n is a, c, g, or t
  misc_feature (414)..(414): n is a, c, g, or t
attcggcatgaggggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccagggaggcagaggttgcagtgagccaaggtcacgtcactgcactcttagcctggggcaacagagtaaggacaaaaaaatatatatatatttgaaantcaaaggagggcaaatttttgacatgggaaggaagttaacttgccaaaacantagggttttagttaggtantttttattaaa

SEQ ID NO: 519081 - DNA, 203 bp, Homo sapiens
tgatacacctgcatgaaacagaatgttatgatagatcaaattcaaaaaaaattaatatctgtctcaagcagaacgaatggtcagtgttacccagtacactgaagcctgaaggatgatgaagctggtgctctgaaatgatcacggatcaagggcttttttttccaccgtccaagcttctccattatccatttagctaccctaga

SEQ ID NO: 519082 - DNA, 963 bp, Homo sapiens
  misc_feature (76)..(76): n is a, c, g, or t
  misc_feature (156)..(158): n is a, c, g, or t
  misc_feature (163)..(163): n is a, c, g, or t
  misc_feature (165)..(165): n is a, c, g, or t
  misc_feature (171)..(171): n is a, c, g, or t
tagctcgtacccacaccacctgagtctcaccagacgcctcaaccgccttttcatcaatcgcccacaccacctgagncgtaaattatggctgaatcatccgctaccttcacgccaatggcgcctcaatattctttatctgcctcttcctacacatcnnncgagncntatatnacggatcatgactctactcagaaacctgaagacatcggtcattatcctccgtgccttgcaaccatagcaacaggccgttcataggctatgtcctccgcgtgaggccaaatatcattctgaggggccacagtaattacaaacttactatccggcatgcccatacatgggacagacctagattcaagtgaatctgaggaggctactcagtagacagtcccacgcctgcacagcgattctttacctttcacttcagtctatgcccttcattattgcgaggcctagcagacactccacctcctattcttgcgacgaaacgggatcaaagcaacgcccgctaggaatcagcgtcccatggccgataagagatcgaaccgtgtccacccttagctagacaaatcaagagacgccctcgggttacttcgtcttcctggctctccttaatgacattaacgactaattctcaccagagctccgtaggcgaccagacaaattataccctagccaacccttaaaaaccctccccacatcaagcccgagtgatatttcctatgcgctaccacaaattctcgatccgtcctagacaaactaggagggtcctgccctattatatcatctcatctaagaagaatccccatgctcatatattcaacacaagcttatatttcggccataagcatcacttgttgatgctagcgaaaactcccagttactgattgggcaacatttgctaccttcccctgggagtgatccgaatctcaatctatctatcaagttcctggaaaatggggtgac

SEQ ID NO: 519083 - DNA, 817 bp, Homo sapiens
gcggtcgcgttttcccattcagggtttgcaaagtgggccttatatctcgtatactaatttcggctataaccacttatcagtgagtaccaatcatttggagttcttttgtgattgtgttagctcactcaggatgatttcatcttgtaaaaatgtctatcttccaactaaagaaaagtaattgttgcttcttgttatttttgttgttagagttgggattctggtttcttacagctgacttctgttaggtttgttgaaggattactttcttgctttttttagggtgtagtttccatccttgtgttggtgttttccctttattatcctttgaagggctagattcatggaaagatattgtgtgaatttggttttgtcgtggaatactttggtttctccatctatggtaattgagagttttgctgggtatagtagcatttgtcttcccttagtttctctacaacatctgtccaggatcttctggctttcatagtctctggtgagaagtctggagtaattctaataggctggcctttttatattacttgactttttttttccattactgaaagatccggaaccagcaacagacacagaagccctgaaattggcaagatagacgtcagtgttagcagaactagcttcactgatttaaaaaaatagaggtgcacaatgctttggccactccttgaacctgtgtgtctgccaatgttctgaccaggtgtgtgcccattgctgcaccttcattagactctttccttgtacccctcccatacccatttcttgaaaatagacattgtttagatctaataagtcccacctc

SEQ ID NO: 519084 - DNA, 120 bp, Homo sapiens
atacatatacgaacttgagctggtacccccacttcgcgcgtgcggtcttgccggcgtgacgcaccatctctttcagcatcggcacagcgcgtcgccgccttccagcgagaagcgttggcg

SEQ ID NO: 519085 - DNA, 805 bp, Homo sapiens
gcggtcgcgttttcccattcagggtttgcaaagtgggccttatatctcgtatactaatttcggctataaccacttatcagtgagtaccaatcatttggagttcttttgtgattgtgttagctcactcaggatgatttcatcttgtaaaaatgtctatcttccaactaaagaaaagtaattgttgcttcttgttatttttgttgttagagttgggattctggtttcttacagctgacttctgttaggtttgttgaaggattactttcttgctttttttagggtgtagtttccatccttgtgttggtgttttccctttattatcctttgaagggctagattcatggaaagatattgtgtgaatttggttttgtcgtggaatactttggtttctccatctatggtaattgagagttttgctgggtatagtagcatttgtcttcccttagtttctctacaacatctgtccaggatcttctggctttcatagtctctggtgagaagtctggagtaattctaataggctggcctttttatattacttgactttttttttccattactgaaagatccggaaccagcaacagacacagaagccctgaaattggcaagatagacgtcagtgttagcagaactagcttcactgatttaaaaaaatagaggtgcacaatgctttggccactccttgaacctgtgtgtctgccaatgttctgaccattcctttacccgtgtgtgtgcccactgatgaagcccattgccaggtgtttgtgatattggttgctgagaaagagtcagaaaatctccccag

SEQ ID NO: 519086 - DNA, 290 bp, Homo sapiens
cctccttggcagagctcagatgtgctctctctgcatagccctctccctcctagccctcttctttgtgaactccagctgccctgcctcctggactcccagcttctaatcctcaactcttgggactgttgagctctacctgggttctcccttcctgtgctctaggctggaaactcaggacttcggtgggtatttgtaggacttcccttatttgttacctctttctctggagtcactgtctttggccgcctgaggtccagtacctgaaaatcattgttttatatggttagtcc

SEQ ID NO: 519087 - DNA, 934 bp, Homo sapiens
gagaagtggtctatactcgaggagccaggcctcgtctctcatcagccaggccccgaggctcctgccctcccaaagacatgcggtcagctcaagaaagaggcaaagaaacgggagaagcgtagagaaattccaagcagaagcagaagatccaaggagcagcagccacctccaggggagaagaagaccaaaaccagagaagagggagaaacagggatccgtggtggtcagttaccatatgacactcaccgaaccccatcccggggagaaacgaacagatgtcaagtggtccgcatgctcgacgtcgctacagacctcggtatgtcggaggctcgctgtgtaccgcttggctgggatgcatgcagggacttcttcaatgccagagatatgggcgtcctaaatgtgtcagcaggcaaatgccccgacggttgtcttcactgaatgtgcagtgccacccaccaatgtgagcagggctccctgaagctgggccatgctagcgtctaccaatggccagtccgagggactccgcgtgactcgatggcgaccgcatgcgtggggagacctacctgtggggaacccgtggttgtgaccattgcaaggtattgccaaccctaggtggtggtggagaagaagctatggcagtgagcagggtactgtagccggcaccagctgggtccgcgaggcctttctacaggaacgtctgcaatcgtggaaggtggcagaaaggtgaccggatttaccaccagttgaagaacgcttggcagcgtccttggattgggatcggagcctgtgtcactcgtgggaccctgaactctcagcagctgtgacgagaggcctttgtccggcttcaggaggaaggcatcatttatcgcgagtacccgcttgttaactgtggtcctggcaccctcaactccggccatctttgacattgaagtga

SEQ ID NO: 519088 - DNA, 1007 bp, Homo sapiens
  misc_feature (228)..(228): n is a, c, g, or t
atgtcttatcatatagtaaatagcgcatgaccgactgggatgccctgaagcagggcgcggcctcgtcaaacctccgcgtaatgaagcctccgggctcctagctcactgctgatctactgctctacgcgacgtcactaactaacgctacacttcatacttatggccttacaaaaccaacacactaatcgtataccacatagatcgggccgctgattgttagacgacgangtagagcaacaagtgaaccaaggtccaactcaacaagccatccactctggtaacgcgaacatatagggccatatcagactgactgggggataacattctccttagttgatccagcctccatcatatgtgtatgcatcctttccgagaagaatatttgcctagaagcctttattaacaatacgcaagatcatagacactcgcgtacacacctgccatccatagaggaggatcaaccggaccacctctatctgggacatcaacgcacacagtatcaggtctcctccatagtaaagatcctcagctacctcaagactgcatcccagttgtatcatatccgcaatttccatggagataatcgtattggaccctcggaggacatctcccaattaggatctttaagttatgaaattgacaaatacagcaaatgtcgaagaatacaatctcgaaagtgagtgacgtggactatacgaaattcatcagcatgtgtgctcatcaattattcagctcttcctatatccacgaacttccttgacgctacttgtctgaacgtgtcccctatttagacaaattttccagacggtatggtaaccggtatcacactattttgatgtgccacctactgagactgtctgaggtccttttgtcgtcgttactttggcgacctcattatctcgcgtaatctgcttcgctctcgccaacctaaatgatttaggtttattctcaaaaaattcctttgggtttctaaagcagcgacttggtactggcatttcgaccctccg

SEQ ID NO: 519089 - DNA, 1404 bp, Homo sapiens
caggagtttgagaccagcctgaccaacatggtgaaaccccgtctctactaaaaatacaaaaattagcttggcatggtggcgggtacctgtaatcccagctgcttgggagtgtgaggcaggagaatcgcttgaacctgggagaccgaggttgcagtgagctgaaaccgtgccattgcactccagcttaggcaacaagagtgaaactctgtctcaatcaagtccatcaatcaatcaataaaatagaggtcatgctgaaaacaagaaaaaaaaaagaaaacaacggggggaacctagttctctcttcccgaggtggacccataagagaccgggggaaacccggggcaccgctaggagggagacacggactggaatggaccggcccgcgccacgagggggtcgccaaaacattgggagagaaaccgcgggcacaggcacagggtgcgacccaaggggagcccccgcgggatactactcaacacaaatgccgtgttcaccgagaccggaacataaagagtaaccgtgcaaaaacggtggccacatatccccagggtggggagaaataagaagaaggcacctcaatcaccactcccaaacgacaataagggggcaccggacaacatactctcccgcgggcgagcagcggccacaaagggcaggctggacacaaggacattcacccgggaggcgcacactcctgaacagcctacagaagaggccctacagagcgacagattgtggcgcaagaatactccgacacgtggcgaacgacgcccacacgaggaatgtgactcccaccgaggggcataaaaacgccccgcagaaaaacacgggtgagcacccggggggaaagaccccctggtgaacacagagtgggtgggaccacaaggggggacacacagcgccttcacacagcggacatataaacccgagggcaaggaagggtgtacccaacggggtcgagcacgaagagcgacatgagcgacccccgggagaaactggtagttaccaggcaacagaaaaacgcccccacacatactaccctagtgagtaacacaccgggtattatattacgaggcgggcgagacaacactcgtcgcgaaaacgaatgaactccgcccacgagtcccgtagcagaggaaaaccccgccgttaacttcacccagctcccgtctcaccaagggtgagaaatccacacgctgaacacatcgagatagggaacacacgcgtccttgtggccggaaaaatcaccacgagcagtgggtgagagctgggaagcccccaaaaacacccacatcgcgaagaaggcgccacaagaaagaacagagcagggatagtcaccaccgcacctagacgacagcccccaacagggcgagcaagaccacaagggagcacgccaaaaacgag

SEQ ID NO: 519090 - DNA, 315 bp, Homo sapiens
caccactcatacaccgggaggtcctcaaaagaatctggcagccaggatgcatgtggctcatgcctgtaattccatgcacttctgaaggctgaggtgggcggatcacatgaagtcaggagttcaagaccagcctgactaacatggtgaacgcccgtctctactaaaaatacaaaaattagctgggcgtggtggcgggcacatgtaatcccagctaactcaggaggctgaggcaggagaattgcttgaacctgggaggtggaggtagcagttgagctgaggtcgcgccgctacactgcagcctgggtaacagtgaga

SEQ ID NO: 519091 - DNA, 171 bp, Homo sapiens
ccgcgaatttagttagtagtagagatggggtttctccatgttggtcaggctggtcttgaactcctgacctccggtgatccgcccgcctcggcctcccaaagtgctgggattacaggtaagagccactgcacctggctatgcaaagtttttgtcgacgcggccgcgaattta

SEQ ID NO: 519092 - DNA, 760 bp, Homo sapiens
aggaccaggatggctgcatactttggagggctgattctgcacgcctggctggtcgcctgtaccaaggaccgcttctctagttgtcatttaaacatccgagatggataccaccatgcatgatcctacttacaaccataagtttaacccacgaccatattcccataaatagatggtggcatgagcagccactatatcacgttgataaccagagcgcacccttgttgtgtaatacaaaggcataggattttgtccagctttcactagcctagagggtggtcatcactaaccatactgactcggattacatgtgattatgaccactgtgtaccctggacaaggtgccgctgactatatgcatggaaatgccgtgcctaaagctggcaaggcagggcttttggcactttcagctttatcctttgctgctcttccctatccaactatcacgatgcgggcatatgcatagctgcgccatgctaggtagttgtgaccttttcgattaatactttgaagacatgtgaatgcccgtttgtctcagctttgtcatgcgattaagctcacactatggcaaacttaacagctttgcccattgttcgacatgtctcatctgttaacacacgattatgctcagacttaatctttgacgaacaggtttgagagcattatatcataggtaatagactgcgttctatattctgtagagtcatgtgaatgcctgccagctcctatatactcaccacatactaacatggtatatagcctt

SEQ ID NO: 519093 - DNA, 363 bp, Homo sapiens
tgtgagtggaatgtaaccgatgcaggtgcttagacacacagtataggaatacctccaaaattaatatagaaaaccatatgacccaggaataccagtaatgggtgtccacccaaaagaaaggaaagccggctcctgggacagatatttgtacgccctgcacacagcagtgtaatgataaccaaaaggtagaagcaacagaagtgttcatcgactgggtgacttctactaagcagtgtggtccatccatagaatggaatactattcagccttgaaacggaaggaaattctgatgctacaaaatgactgaaccttaagcacattctgctgagtcacatactgtgtgagtccacctagttcaggtcc

SEQ ID NO: 519094 - DNA, 919 bp, Homo sapiens
  misc_feature (231)..(231): n is a, c, g, or t
  misc_feature (237)..(237): n is a, c, g, or t
  misc_feature (239)..(239): n is a, c, g, or t
  misc_feature (243)..(243): n is a, c, g, or t
  misc_feature (249)..(249): n is a, c, g, or t
  misc_feature (253)..(254): n is a, c, g, or t
  misc_feature (259)..(259): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (308)..(308): n is a, c, g, or t
  misc_feature (330)..(330): n is a, c, g, or t
  misc_feature (334)..(334): n is a, c, g, or t
  misc_feature (336)..(336): n is a, c, g, or t
  misc_feature (354)..(354): n is a, c, g, or t
  misc_feature (362)..(362): n is a, c, g, or t
  misc_feature (375)..(375): n is a, c, g, or t
  misc_feature (380)..(381): n is a, c, g, or t
  misc_feature (545)..(545): n is a, c, g, or t
gaatttgggaaatgaacgaaaacaattcaccagggaacactaggccagtttcgattaattgaccccataaaggaatttgcctcaagccaagaatcggcaaaggcgtcccaggccccggcaaggttacagcttaatcagccaagaagtgccctatggttaacccaccaaccaccaccaacacaggtgccagcttgaagggcggggccttgccacaacaaggacgggtccctnaagcancncttnttccantttnnctggngctggcctcactcangtnatnatnacgtcnccnantggtcnagnccggntagacccgaagatgatcagcangtgncncgccgtgtggtgaagatnttgccagntgggcagggctgntcctnnacctgtggaccctggtagccccactcctcctgcgcaaccgcgacttcagctgaggcagcctcacagcctgccatctggtgcctcctgtcacctgggcgtctcggctcggtgacagccaacctggcccctccccacaaccaatcagccagggtagccccccaccnctgccccagctccaggacctgcccctgagccgggccttctagtcgtagtgccttcagggtccgaggagcatcaggctcctgcagagccccatcccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtaccatgaaa

SEQ ID NO: 519095 - DNA, 747 bp, Homo sapiens
  misc_feature (231)..(231): n is a, c, g, or t
  misc_feature (237)..(237): n is a, c, g, or t
  misc_feature (239)..(239): n is a, c, g, or t
  misc_feature (243)..(243): n is a, c, g, or t
  misc_feature (249)..(249): n is a, c, g, or t
  misc_feature (253)..(254): n is a, c, g, or t
  misc_feature (259)..(259): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (308)..(308): n is a, c, g, or t
  misc_feature (330)..(330): n is a, c, g, or t
  misc_feature (334)..(334): n is a, c, g, or t
  misc_feature (336)..(336): n is a, c, g, or t
  misc_feature (354)..(354): n is a, c, g, or t
  misc_feature (362)..(362): n is a, c, g, or t
  misc_feature (375)..(375): n is a, c, g, or t
  misc_feature (380)..(381): n is a, c, g, or t
gaatttgggaaatgaacgaaaacaattcaccagggaacactaggccagtttcgattaattgaccccataaaggaatttgcctcaagccaagaatcggcaaaggcgtcccaggccccggcaaggttacagcttaatcagccaagaagtgccctatggttaacccaccaaccaccaccaacacaggtgccagcttgaagggcggggccttgccacaacaaggacgggtccctnaagcancncttnttccantttnnctggngctggcctcactcangtnatnatnacgtcnccnantggtcnagnccggntagacccgaagatgatcagcangtgncncgccgtgtggtgaagatnttgccagntgggcagggctgntcctnnacctgtggacctgcccctgagccgggccttctagtcgtagtgccttcagggtccgaggagcatcaggctcctgcagagccccatcccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtaccatgaaa

SEQ ID NO: 519096 - DNA, 883 bp, Homo sapiens
gctccggacagtatgcttgtggacagctgcaactatgcctgacgctgagctatggccgtggtgtgcatgggtcacgagtgccatgatgtgtcagcctgctgtgcgcatcccgtgattgactcacaggatatcccaaggtggcccgtgatcatattaccgatgagatgtattgttgtcgccgggaattaagtgtggggtccagaggtcctctttgacagggtcactgacgtactgatgggcctcatgtaattagtaagcagaagtgtgttggagctgatgctcgtggtcgataggaagatctcagatggggcagggtaaattaggcctgacctaaggcaaatactgcttggcgtgtagcgtatgcagaatttcctaggctgtacaattgtctcgaggcaaggaagtcagtctatatctactctcaagtacttatgtaggacatttttggtacagcacagctctaattttaaattattggtataaccagttctggggtgtgacctagtttatgttgagaattacgtgttgaaaacccttgtagattctggtaaatgtctgtataaatgtgtagaaataataccgacgcggtgagatatagaaaagaccttagttgtaggtgattaatagaggtctaatgtaacttgtgaagcatggaagtggtttaaatggttaactaagcgggggggtcagaacattgaagtagttatacttttttaaccaatgtttgacattcacatggtaagacatggactggtctactgaaacaagtgttctgagtcaaattcttatatgggggaagtatgaaggacgggatgggaagggaacaatttaaccaagaagggtaagattttatttgagagggttaaaaagagattatcggaag

SEQ ID NO: 519097 - DNA, 759 bp, Homo sapiens
  misc_feature (231)..(231): n is a, c, g, or t
  misc_feature (237)..(237): n is a, c, g, or t
  misc_feature (239)..(239): n is a, c, g, or t
  misc_feature (243)..(243): n is a, c, g, or t
  misc_feature (249)..(249): n is a, c, g, or t
  misc_feature (253)..(254): n is a, c, g, or t
  misc_feature (259)..(259): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (308)..(308): n is a, c, g, or t
  misc_feature (330)..(330): n is a, c, g, or t
  misc_feature (334)..(334): n is a, c, g, or t
  misc_feature (336)..(336): n is a, c, g, or t
  misc_feature (354)..(354): n is a, c, g, or t
  misc_feature (362)..(362): n is a, c, g, or t
  misc_feature (375)..(375): n is a, c, g, or t
  misc_feature (380)..(381): n is a, c, g, or t
gaatttgggaaatgaacgaaaacaattcaccagggaacactaggccagtttcgattaattgaccccataaaggaatttgcctcaagccaagaatcggcaaaggcgtcccaggccccggcaaggttacagcttaatcagccaagaagtgccctatggttaacccaccaaccaccaccaacacaggtgccagcttgaagggcggggccttgccacaacaaggacgggtccctnaagcancncttnttccantttnnctggngctggcctcactcangtnatnatnacgtcnccnantggtcnagnccggntagacccgaagatgatcagcangtgncncgccgtgtggtgaagatnttgccagntgggcagggctgntcctnnacctgtggaccctggtagccccactcctcctgcgcaaccgcgacttcagctgaggcagcctcacagcctgccatctggtgcctcctgtcacctgggcgtctcggctcggtgacagccaacctgctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccccttcctggacttcgtgccttactgagtctctaagactttttctaataaacaagccagtgcgtgtaccatgaaa

SEQ ID NO: 519098 - DNA, 892 bp, Homo sapiens
  misc_feature (16)..(16): n is a, c, g, or t
  misc_feature (91)..(91): n is a, c, g, or t
  misc_feature (139)..(139): n is a, c, g, or t
  misc_feature (431)..(431): n is a, c, g, or t
  misc_feature (518)..(518): n is a, c, g, or t
  misc_feature (524)..(524): n is a, c, g, or t
  misc_feature (555)..(555): n is a, c, g, or t
  misc_feature (563)..(564): n is a, c, g, or t
  misc_feature (575)..(575): n is a, c, g, or t
  misc_feature (628)..(628): n is a, c, g, or t
  misc_feature (632)..(632): n is a, c, g, or t
  misc_feature (642)..(642): n is a, c, g, or t
  misc_feature (644)..(644): n is a, c, g, or t
  misc_feature (663)..(663): n is a, c, g, or t
  misc_feature (704)..(704): n is a, c, g, or t
  misc_feature (707)..(708): n is a, c, g, or t
  misc_feature (742)..(742): n is a, c, g, or t
  misc_feature (746)..(746): n is a, c, g, or t
  misc_feature (846)..(846): n is a, c, g, or t
ggagtaagaatggctnggaagggatgagcaaaggaagagaaagagaagtgtccaggagggagagaatcctgagagggtcggggagtccgcngaagactacaggcttggacaggtcgccagtagcttatttcgcggcgancaccattccagaggtggcaccggtcggctggcgtccctcttcagttctctggagccccagattcaacccgtgtacgtgcctgtgcctaaacaaaccatcaaaaaaacgaaacggaatgaggaggaagaaagtacatcccagattgaaagaccactttcgcaagaacctgccaaaaaagtgaaagcgaagaagaaacacactaacgcagaaaaaagttggcagacagggaaagcgctctagcgagtgctgatttagaagaagaaattcaccagaaacaagggcagaaacaggnaaacaattctcaacctggtgttaacagtagcacgatagacaaaaatacttgatgacacagaagacacagttgtcagtcaacagaaangacacnattcaaatcaaccaagaagaagagagattcnaagaatgnngagaactgtgnttgtcgggaattctgcctgttaccatgtattaagaagaagctgaagtcgtctnttanagagtatggncnaatagaatctgtacgaatncgtctctgattccagccagagggaacgctatccaaaaagtnggnngcaataaaacgtaaaatcatcctgatcagaaaantatnatgcctatgttgtggttaaggagggagaatgttgccacgccaggcattgaaaagaatggggccccatgcagaaggaattccgattaaaggtgactcgctntgagaactctctaagacaaagacggtttgggaacatccccataaga

SEQ ID NO: 519099 - DNA, 346 bp, Homo sapiens
gaattcccccccccccccccccccccaatttttttatgtgttattaaggagtgatgaaatttcatcctttgggatgtggacatccaattttcctggaaccattgggggaaaagactgttctttcctctattccattagattggaaccctggtcaaaaatcacttgaccctagctacactggtttaatttttcactcagctctattccatagatgaatatatctatccatattccgcgccccacagtcttgattattgtggcttcatagccagtcctgaatttgggaaatatcagttcttccagcttggtctttgggttgattcttgttgtaaagccatatgaatct

SEQ ID NO: 519100 - DNA, 369 bp, Homo sapiens
taaaaagcagcctcctatatttatctagagcactagtacagtcagttgctccatatctgcatccatggattcaagcaaccacagatgaaaaatattcccaaaattaaaaaataaaaatataccaattaaaaaatacaaataaaaaatacagtgtaaacaactatttacatagcattaacattatattaggtattataagcaatctggagagtacttaaagtatacaggaagatgtgtgtaggtcatatgtaaatactacaccattttatagaaagaatctgaggacaggcatagtggcttacacctctttatttagaggcagattctcgctctagtcgcccaggctggagtgcaatggcacaatctcag

SEQ ID NO: 519101 - DNA, 144 bp, Homo sapiens
ctttagggaggagagtgtgaggcagtaggagggccacacccattgttaggcaggagtagggcgatgatgacagaggggggacgatactgcagattcaggataagttcagaggtgaatggcaagacgtgggatcagttggatttg

SEQ ID NO: 519102 - DNA, 253 bp, Homo sapiens
agaagaaggaggttcctgctgtgccagacacccttaagacaaagcgaaggaatttcgcagagctgaagatcaagcgcctcacacagaagtttgcccaaaagatgcttcgcaaggcaaggaggaagcttatctatcacaaagcaaagcactatcacaaggattataggcagatgtacagcactcaaattgcgagtggcgaggatggcaagacaagctggcaacttctatgtacctgcagacccaagtgggcgtt

SEQ ID NO: 519103 - DNA, 1535 bp, Homo sapiens
gaggcactgaggcagccagcgcaaagggctatctgcatgagggggcagcgcggagcttgaggaaaccgcagataacgtcccctcctctattgaaacgatagacgattaatacaactacttaaaaaactattagtcaaatacggtatactaacgatactcgcttagccgctaaacgtacatcaaccagtaactcttacatacgctcaacgatcatcaacgacgaaaactactgacaagactatacgaacgacgctacgcactgacgcgaacggaaaacagactaaccacgcgtacactaaacaccactgaccggacgcgctcagaccactgacacgctcacctacacctggaggtacacaacaaatcgtaacttcaaagacacgacacaattcgacgaagaacagggacactaccacggaccgctccacgaaaaatatacacgtagcacaacaactaccacaccgcgcgacaacactgccatatagcagacgacaatcaaccaacctgacacgcgtagacatagtaaaaacacgagacaacccaagatacaagcataccaaacaaagcatatgataacggactgcacttacaaaagtaaactcagcaagggcagcatcttcctacacacacagcaggactcacacaacacccgaaagaggctgaacaacaacacgaaccccagagaaaacacccacgtgcacgccaagagggaaggacaactcaggcgctgccgcataacaacaacagccccaaagaatataacacagaccaacaataccgatcaaacacgcgccaagacacgcaccaacatcgggacagcaggactacacttaggggacgcccggacacagaaactgaacaccccaacgggcacgcaagcacatcgacacagatacgagcaccgcgtggcaagccacacgctagagcaccaacaacacaccgacaagtctcacacggacaatcggccaacaacacaaaacgaacctacaaccgacaggcacaagcgggcaacacacgtagcacacgccaacccacacaccaaaccatatacagccacaccacaccacaaccagccgcaacagtaaaccccctgacgacgaccagcagccgccgacgccaacaagacacacgacgcacaacaccaacatatccgggcaccagtgacacaccaaaaccaaacacgcagagcgacagcagacgcacacgcaggcaaaatactaggaaacgcataacgcaccacggacaacaagagcaccaggcgaaaacgaagcacaacaaaacacacacacatcgcagcaagaaaacaagagcagtcacgaagcaaacatagccagcacggcaccaacagacgcagtacacaactcaccagacacgaacaacaacaaagccaggcgatcgacgtaatataacagcaacccaaggcaacgaagacgacagccagacaccgaagcaacctacagcagcgacaaatcgcaagcaccgagacctgacgacagcacatcagacaccaacagaactgaagtcgcacacagaat

SEQ ID NO: 519104 - DNA, 200 bp, Homo sapiens
gtgccagaggaaaaggtacaaatatacagcattgaggtgtgagaatcatagaagctactagacaattaagatatctagacacatacagtatcaaattagcaaaagatgcaagggaaagacattgcttttgtattgagacgcatcacatagaaatcactaggtgtccctcaaacaaatttggcggtgcaactactacatag

SEQ ID NO: 519105 - DNA, 857 bp, Homo sapiens
gtatagggtttccttttggagtgatgaaaattttctagaattagatagtggggaaggttactctgcatataccaaaaaccactgacttgtaaattttattctttttaaaaaaactcttatctcatgacagattactgacttgtaagctttaaaagggcatattttatatgaattatgtttcaacaaaaatgtaattaacaaattccatttacaatactcacagacttcattacactcaatatcactcaggttcttgacactgcaaaacctctgtagttcagagttgtaatataagttggtgaaagccatccccaggcagtgccctggaagtattaggaatgtataatccaaggattttgagattgttgcatagcctagctatgcgaagagaatagaaaatattaactctgcttgcaggaagaaaagggcatatcttctattatctatcctaacccacgttattgtatatccatcattacaacatcagactcccaggcctccagaccagaaaactggttctccctgactcctcttcctctatagtcattcaaactctaagacctaagtatctttcttctgtatgctcctcgaatctgtcactttacttctttccaatgttcacgcggggaggatctgcaagaacacggtgtgtgtggtcaaatcaggagcacagccgcagcatgggctgcatctgcggaggtgggggagctgaaggccgaggaatgacgttaccggggatctgcgtcagatagccggggtggatgccggctccagtgttgaggtcactcagaaaaaagagagaaccgcccaagtgggggaaaaatcaaatcctagaaaaagagccataaaaaggatgg

SEQ ID NO: 519106 - DNA, 136 bp, Homo sapiens
  misc_feature (42)..(42): n is a, c, g, or t
caaaccgttaagaaaggatcggatctgcagaagaaacttttnacgctctcatcgagtggacaccttttatcaaagatattatggaggatgctattccgataactagattagattcaaaagaatggccatattgctt

SEQ ID NO: 519107 - DNA, 1324 bp, Homo sapiens
  misc_feature (720)..(720): n is a, c, g, or t
ctgcgcaagggtcggtggcgcacgtgtgaaaccggggaactccatggaagccgagtccggcgactacgaatgttcctgaggtgcccggtccacaggtctactctgccgcgggcggggagtccgctcggatacgcgaaagggggcagcgacgctgcgtcgatgcgacctgatggaggcctaatgtgcgtcgtaccacgggaagcgcagatctgggtgccccgcggtgtactcatgcgtatggacattagtccggggatcacctgtgtgaaacagagcggaccagagcttcctcttacaccttaaccttggtgttgctgggacccagggctgagaggcgcccagagcaacggactgtgatgatgctgtcggatgcacaatctggcttgggacaaagccccgacccttcagagtggcacgttgatgcacgaacgaagaggacggacagatgaaggaggatgacagaagagcggaagatcctcagctggcacgctggccattggttgcccacattgatggctggcttcaaccggaggttcggggtgtcatggctggggtgcaggacgccctgtggttggcgcgtgtgggtcagagaaaggggccaggtgggcggtggtgtgcgctagaggccggtcttctgcagcgtggttggatggagcccccaagggcctggggaggccttgcctccgggattgacgcatggccccaaattggcgcgcccangtgttagtcccttgcggcggggacacaaatagtggcgagggcgctttttgcccttgacatgtgttcacgccccgagtttacctcggttctggcctgctcgaccccgggatgctgcgcagcacgaggctatcgtagccttttgggcaccgctaataggaggaggcgtcctcccatgaggcacgtgtttagtcacccgagggagacaattgatggtggcccaccaacaacgccccgtctggtaggaaaccacatcactgtgtgtgtacccccgaagtgtggaaaaaacagagagtgttttgcttcacatctcctgcgaaaaaaggcgctcgcacctaacgaccaatggtgagaatgactacgtggggtgggcaccacacacacaagaggacggtgtgttgctgtactaaacataacacaccgaagcccaatactaggtgcagaggcaaaagcaaactcaacctctactatcgatggatgaggagaccaccccacatcagtagacgagtacagtaggcgaacttagaataacacattcaagtctaagaagtatataaattgacgtatgactaacagttaatcagcagcacgctgttgttcataacag

SEQ ID NO: 519108 - DNA, 685 bp, Homo sapiens
ttggagggggaatgctggagatggtaaggggtatggagacttatcatataagtaatgctagggtgagtggtaggaagtttttccataggaggtgtatgagtgggccgtagcggaatcgggggtatgctgtccgaatccataaaaccagggaggttaaaagtagggtctgggtgacaaaatatgtggtgtagagttcaggggagagtgcgtcatatgtggtccctaggaagatggtaggggtgagggtgtttattataataagtgttggtgtatcggctatgaagaatagggcgaaggggcctgcggcgtatcgatgttgaagccgtgagactagttcggactcccctttcggcaaggtcgaagggggtccggtggagtctcggctagtggtgggagataacatcatattattggcgccaagggtcatgatgggcaggagtaatcagaggtgtcctggtggtcggcggatacagggtggcgcacgaggtccaaaggacgccacttattagcaatggtcggatcagtcaaaatggatcgcgctagggtcgactcccatatgagcattggtctgggggctactagctcgcagttgccgccgatcagggcgtaatatggacgtttgatggcccaccctgatcagaggattagagcaaacggcgctaggctaacaggtgggcacacatca

SEQ ID NO: 519109 - DNA, 467 bp, Homo sapiens
gaacggacgcgcgacgctggtagacggcgccggcacagcagcgtcaggcccagtgtttcgatgatcatgcaggcgatggcggcggtgaacccgccgaaaccggctgatggctgagatcaacaccaggcgcgagagaataaagcacacaccaaataccgtcaggcaatacgccgcaccggcccagccacgattcaggtaatacagggtgataaaggtcgtcaacgtgccgtagccaatcgaagccaggcgcaggctggcgccgaacggtgcgatacgcccgaacaccgcccaggacggcagccgctcgccacgtacaccggcaccgacggtttattgcggatcagcaccagtcccaacgacgccaacaccgccagggcaagaccgaggctggtgtagccgtaatcagccaccatcaccacgccaagtggcgcaccaatcgcaatcgcgccgtagggcgtccgtagcgg

SEQ ID NO: 519110 - DNA, 291 bp, Homo sapiens
tgacaaattatacttgtacatatttagggggtacaaagtgatgttacgatttatggatacaataaataataaaatcaagttaacataattcatcacttcaaatactttaagttttttgtggtgaaagcatatgaaattaccgtcagcacttttgaaatcgacattattatttactatattcaccgtgctgtacaatatatctcataaaagaaaaccacattcctcctgtctaattgatgttttgtaccctttggtttttcattttctttctggaagttattctcaagtttg

SEQ ID NO: 519111 - DNA, 897 bp, Homo sapiens
gtcacgcttctgaaccaatgactgaatgtcaagatgttcgttaattgctagatgttggtgtcaagaccagctgtcttcagatctattaatgtagggaatttttccctaagatggacaattcctatattgtgactgtggtgaagatccacgtaatctgtgatagggagtgttttctcttgccttatagttgagcgtattgggtttgacagaaagcctcagcagaagagcgttggatgtgagaaatctacgattttcttctacattcattgatgccccgttgtaatgtttgcatacactagaaaatgccttcaatttgtgtttgaccagaatttcgatactggtcagaaattttatactgccaagcgaagaagactcaatttctcagatctataaatgggatacatttgtcatcctctagcaactcctatatagagagttttaactgaatatgttacatataagaattaaattcttctcaaataattcttaagctcagtaatgagcctaacatttactctgcttgggtctctacacatgggatctcagggtataagatgtagcatttcaatgtgtaagatatatgtactaaagcatatgtgtttgctatcttcagtcattaacatccttctttctatgctggtgtagttttgtaagataatatatgcggaatggggcggagataatggtccgaagcaggatcttcatttggtgggcttgggaatttacaggtgtccgttttccaagaggaaaaaactaaacgggttgatgagttaaatgtgaaagggcgcgttgggggtgcaccttttaaaaatgaatccaagaagagaaaaaaattgtgcggccgcaaataaaaggggggcgaaaaaaatgggcagggaaaatttaaacaggggaaag

SEQ ID NO: 519112 - DNA, 953 bp, Homo sapiens
  misc_feature (315)..(315): n is a, c, g, or t
  misc_feature (946)..(946): n is a, c, g, or t
attaatcccctggcccaagccgtcatctactctaccatcttgcgggcacactcatcacagacgctaagctcgcactgatgttgtacctgagtaggcctagaaataaacatgctgtgcttagatgtccagtccgtaagccaaagagagaagtgcaaccccatcgtaccttgcagaaagcatgctcaattctaggaggctatttccgtgcacgcaaggcaagcctgcaggccactaagtgccttcttatatagctagtccgttcttcaacgaatatacgtgctctcggacgaggaagccagtataccaagacttacncaatcaaggactcattcacttaataatttcataactggcatataaggcaatgaacactagtgaatagcccccatttcacttctgaagtgcccagagtgttacccataggtcatccccatctgacaatccggcgctgtcgttcttctgcacatggacaataaactagcccccatctcgaaatcagtataccagaatctctcactcagttaaagtaagccttctcctcatctctcaatcttatccatcagtagcgaggcgagttgaggtggatgtaaggcaaacccagtagcaaaatcttaggatacgcctcaattaccacataggatgaatgtagcagttctaccggtacaacctaacataagcattcctagtttactattatattatctaataatacgattctaatgatcaattaaactcaggagcagagctattatatttgactggagaagtaaatgggaagactttattgcttcagccccttcctagagggggccggaacggtttgccaggcctcggagatcaaaaagttttccccgtggcaacctgttttttaggaatacccacacctttagaaaggggggaacccctctcacttttaaaaacggggccgggggcgcgacggagaaanagcaaaa

SEQ ID NO: 519113 - DNA, 1253 bp, Homo sapiens
gacagcgatgagtcctggaccacagagagtgccatcagctccgaagccatcctcaggctccagtgtgcatgaatggaggggagatgagaagccttattgcctgcccagttcctggatgtaaaaagatgatacaagaatgtgaatggcataaagtatcgatcgctaagaatggtcacaggaacacgatgattcgtgtccgcaaagccattacacaagtgtcggtctgtgggaagagttacaagacttagctccaagggacctgcggatccgacagcaatcaactttccatcccccggctgtcggacgtgacgcattatcatggaagatgcgtgcaactaactagtgctggtcattagagctgatgtcctagaggaaaagtccgctcgaacccgaggcagattggctggaattgttgacaagacagtcacatcactttattatatgcagaggggaagcgaattgcagcgaatccctcttgagaagacaaacaacagaacttgaaatgcagtgctttaaaattctatactagtaattctggacagtgatgtatcttggtagagttaatgatttggtacattggcacgatgctaaatcatcatactccatatttcatggagcttgtgactatacaggtggctagagaagagaaaagctctagagtactatcaggcacattttgccccagaacaaaaattctacactggatggggcactgttgcgcaaatagataacactaagcatagaaagaagactaagcaaactaatagaaaagcacggcaaaatagaccaaaaagacaaaggtcgacaaacaaccacaacaaggaagcagaagagaacagagagaaaacaccgaatacagagagaagaggatcaatagccgaaacgggacactccacggaaagcgcgaaacgaggaacagttcacaccgaaggcaaggaagagggacagaaaaaagagagaacgagcgacacacaaaggaagacacacataaaaaagcagaaagcagaaacacccaggaagtgggggaacacaaagttttaggtgaggagcaagggatagtagtgggaaacaaaaagaggattaagccaaggaagaagaggcagggtataattggagggaagaagagataaatagaaagaaaaaacagaataatgtggaggagtggggacaagacaagaaagaagaaagaaaatgaacggaatgaagtagtgaaagagaaagagggagataaaagatggtggaggggaaataaa

SEQ ID NO: 519114 - DNA, 484 bp, Homo sapiens
  misc_feature (28)..(28): n is a, c, g, or t
  misc_feature (54)..(55): n is a, c, g, or t
  misc_feature (67)..(68): n is a, c, g, or t
  misc_feature (352)..(352): n is a, c, g, or t
  misc_feature (380)..(380): n is a, c, g, or t
  misc_feature (390)..(390): n is a, c, g, or t
  misc_feature (416)..(416): n is a, c, g, or t
  misc_feature (422)..(422): n is a, c, g, or t
  misc_feature (425)..(425): n is a, c, g, or t
  misc_feature (429)..(429): n is a, c, g, or t
  misc_feature (442)..(443): n is a, c, g, or t
  misc_feature (447)..(447): n is a, c, g, or t
gagaatatcccgagggggaaaacgcccnctgatagtaactcatgggactcacgnnacctcctgagtnnccattcactgttatctggctctgagttggtgatcttttatcttgtaggtttggtcgaacgcttctaaaaccttttgctgcaagagaggaatatgtagcatctccgttcagtgtctcctgattgccatcattgtaagatctccaagctgagtctggtgactgagaatcacgccctgcagccaataggtttggagaactttgcactctcttcacagatgttagcgtaacagacatggcggcacgtttgcgagcacacccaccgctatctgtgttcattttcacctnggagagtttgttattaaagtcttcagtnttcctacagncagctgagttcaacagttgctctatncagagnaantagnagtcagtgccctnntacngtaagagaatggtttatgtacccctgtgtgtaaaagt

SEQ ID NO: 519115 - DNA, 140 bp, Homo sapiens
ttacatgatacaatcgagctctgtaccagcagcttgggcccagatttaagattcacaaagctaaagaataaagatggccggacacggtggctcatgcctgtattcccagaactttgggaagctgaggcaggtggatcacc

SEQ ID NO: 519116 - DNA, 385 bp, Homo sapiens
gttgcacagattccttgtagaacaggcgaccatgctgatcagctctggaagtggatgaaacagacgttcccaaagagtataatgctggaacatgcaccttccatgcagatatatgcacactaagctgagaaggagagacgattctagaaacatactgcactagttgagctcgagaaacacatgctcaaggcaacataggagcagctgaaagctgctatggatgattcggcagctttgtgatagaagtgctgcatggctgacaataatgagacctgctttgctcgtgagggtgaaccacttggtgctgaaagtcaagctgacttaggctgatgacatcacattcagcatctcagtctaccatgagaataagagatggagaatggtc

SEQ ID NO: 519117 - DNA, 415 bp, Homo sapiens
  misc_feature (28)..(28): n is a, c, g, or t
  misc_feature (54)..(55): n is a, c, g, or t
  misc_feature (67)..(68): n is a, c, g, or t
  misc_feature (283)..(283): n is a, c, g, or t
  misc_feature (311)..(311): n is a, c, g, or t
  misc_feature (321)..(321): n is a, c, g, or t
  misc_feature (347)..(347): n is a, c, g, or t
  misc_feature (353)..(353): n is a, c, g, or t
  misc_feature (356)..(356): n is a, c, g, or t
  misc_feature (360)..(360): n is a, c, g, or t
  misc_feature (373)..(374): n is a, c, g, or t
  misc_feature (378)..(378): n is a, c, g, or t
gagaatatcccgagggggaaaacgcccnctgatagtaactcatgggactcacgnnacctcctgagtnnccattcactgttatctggctctgagttggtgatcttttatcttgtaggtttggtcgaacgcttctaaaaccttttgctgagtctggtgactgagaatcacgccctgcagccaataggtttggagaactttgcactctcttcacagatgttagcgtaacagacatggcggcacgtttgcgagcacacccaccgctatctgtgttcattttcacctnggagagtttgttattaaagtcttcagtnttcctacagncagctgagttcaacagttgctctatncagagnaantagnagtcagtgccctnntacngtaagagaatggtttatgtacccctgtgtgtaaaagt

SEQ ID NO: 519118 - DNA, 514 bp, Homo sapiens
  misc_feature (328)..(328): n is a, c, g, or t
ctgaacaaagaaaacctgagccggctggtgaattgctcacgggagagggcgaggcacacggcttagtgcgttttagattaaacagcttatcgcaacgtgtaacaacttaacaggccttggaacgggaaggaacaatttgggctttggccttaaactttcccttttccagattctggaggagttttacatttacaaggatggaaccatcaaccttttttagtttcagcacgttattttccgtttttcaaaatttgccaggtcctttaaaattgttctttgacaacaaccccagggtgtgttctggcaccctgtccaaaaaccttttttntggttaactgtggccaaagtcaaacctttttttccaattcgggccaaaatggcccaacctggaaatggggctgttcaaccttaccccgggcaggggggggccttgttgttagggccttttctccctgctgttgttattggtccgtttgtgttttttctaatcagtaataaaggttttaaagtttta

SEQ ID NO: 519119 - DNA, 270 bp, Homo sapiens
taatcttaaacatactatttctaataaatatttatatttttatgaaataaagaggtatgtggaaattaatattggggaaggtggaccgggggaaaggtatccaggggttttacccgccctaactgaaattctcttggaaactgagctaaacctctaatagctgttccccttctattctgaacaactgtctccatttttcaagtgtgagagataagggctaatgatgacatctcatttattttgagtaaacattaaaattgttttacaagt

SEQ ID NO: 519120 - DNA, 118 bp, Homo sapiens
cagcatccttacacagtgtcagcttacataagtacaccggctccggaaacacggtacagaaatggaacttatataaattaaatatcatcagtggttagcaaacctcttatttataagg

SEQ ID NO: 519121 - DNA, 285 bp, Homo sapiens
aagaggcctacagcataccacgcctctttaaacctcgattctttcctaaagacaacttgagccctgccactcagggggagaatcagcagaacctgtaggacctcattcgaaactgacattctccatggtaataaggctcctgtttatttttaaaatttctttttgtttcactggaaaggaaagatgatgctcagatctaaacgttaaaagtgtacaagttgctttgctacaatcaaactaaatctgtacacaaaggatttgatgctttcagaggggggatcctgt

SEQ ID NO: 519122 - DNA, 151 bp, Homo sapiens
gcgtcgacggagagtctcacacacgtatacaagtcctatgtcctggagaaggggtacttagctgtgatagggaaacatttgggtaggagccaggctgaggctggtgataggcgggagcaaggatggggcaaagaactgagaggtggtgttc

SEQ ID NO: 519123 - DNA, 681 bp, Homo sapiens
tcacgccccgctagttttttgtatttttagtagagggagttttgcctgttggccaggctgttctcgaactcctgacctcaagtgatctgcctgccttagcttcccgtgttaagattacatgcgtgagccactgtgcccagccagtacatgatttatagaagacaacttggcaatatctatcaagagtctttaggcagggcgccgcgtgtcaaccctgcatcccagcccttcggctgccctatctggttgagtgctccctccctcgatgacgctcaccttcccccccccgcgctcctcgatccggctatctcctcgcaccgactgctgcacgcccgcagcctcgcccttcctacttccccctacttcccgggcatttgttcgccgccccctaccgcccgcaccgaacctccagcagccttcttcatggtcggcccctctcctccaacatctgcttcgtgctatgcttccactcccttcttcctccacctcttcccctcctctcccacccagctttgctcccccatctctctgtaatgttcactcccccccccaccctcgcacgtcttcgccgcccctcctgcccacactttccgccccacggctgacgcgtccacctcgtgccgccttcctcacagcctctccgtccaccttcgtttcactccgcacgccgcctcccctccc

SEQ ID NO: 519124 - DNA, 125 bp, Homo sapiens
actgttgtttttacccatacaggcttgcacaggagttggatagatggtgagctcagggactgggtgaacatgccccatgtaatacacgggtggtaatagtccctcccatatactcctagccccaa

SEQ ID NO: 519125 - DNA, 742 bp, Homo sapiens
atctcttggggtcagtcgaagattatcagatctcgaaaagaggctgaagatctggagtccggtaaaagctagatgtttattcccatgaaggcattgaagggtaagccgatgggcgcaagtatcacttgctgtgcaatgttatgtcgtgttgtagtatagagctgcacgcgagtgcctataataaaaagcaaggctagtgtgagctgtgacacaactaaagttaactggactagatagggtgataggttgggggggtattaagacatatagcgttggtaataccagtggaaggtgggatgtggcgcaaattttgggcgctaaggttcttcatttaggtgggatgttgatctcgtgtgtgggacttgagaaagccttgggaaaaaactataacgctgaaagattatggagcttaggttgtaggacaagtgtggggcgcatagaaaaaatatccacaggatttttggaatctataaaattactttagtggtattgggacagagaccttagaggtcagtgataatcttgttaaaattctctatcaaacgcgcagtcttgtattggaagcggccttgtgaaaaaaggaataaggaggggtctttgggggattatttggggagttaacaccaagttcaagacgaggaacattatgtcttttgcccaaagtgagtcgaaagaatggaatcgcttaagtttgagttgaaaatccctgtgttggggataattcctggtggaattattccag

SEQ ID NO: 519126 - DNA, 436 bp, Homo sapiens
  misc_feature (382)..(382): n is a, c, g, or t
cacgaaagtaccttcaactccatcatgaagtgtgatgtggacatccgcaaagaccagtacgccaacacagtggggcctggcgtcaccaccatgtaccttgtcattgccgacaggatgcataaggttatcactgccctggcacccagcccaatgaagatcaagatcattgttccttctgagcgcaaaaactccgtgaggatcggtggctccatcctggccatcctgtacaccttccagcagatgtgaattagcaagcagaactatgacgagtccggccccttcattgtccaccgaaaatgtttctaggcggactatgactaatttgcattacaccctttcttgacaaaacctaacttgcgcagcaagatgagattggcatggnttttgttctttttgctttgttacggttttttttttttatggcttgacttgattt

SEQ ID NO: 519127 - DNA, 205 bp, Homo sapiens
gattaaccccctaataaaattaattaaccgctcattcatcgacctccccaccccatccaacatcttcgcatgatgattcttcggctcactccttggcgccttgccttgattcctccaaatctaccacagggctttttccttaggcattgcactacttaccaagacggctcaacccgcctttttcatcaatctgcccacatcactt

SEQ ID NO: 519128 - DNA, 215 bp, Homo sapiens
atccttctcaatctgccataacatgtgcccacacatcttcaactcggaaatgtagcatttcaagctttagtcagggtagattattccttctttactttaacaattctacgttgctgccagaagtcttctcagcatttgttttgaattctgtcttcagtgcatctctcactgcttttgacagatctgggagtctcggatgtagctgagtccagcct

SEQ ID NO: 519129 - DNA, 945 bp, Homo sapiens
tggcaaactctgcctcgcaagcagctgggactacaggcatgctccacggtgcccagttaattttttttgtgttcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggcggctcacctgaggtcaggagttggagaccagcctggccaacatgctgaaaccctgtctgtacaaaaatacaaaaatggctgggcatggtggcgcatgcctgtagtcccagctactagagcgactgaggcaggagagttgcttgggcctgggaggcggaggttgcacgggagccaagatggcgccaccgcactccagcctgggtgatagagtgagactccctctcaaaaacaaaacaaaacaaaaaaattagcacaaatgctacattaatgtttgggtggtcagattctactttgcaatctgacagtttgcagatttgcctattagattttgcgggagttttacccactttcttatcctgtgtcattcactgtactaatttctcccttcgctatcttttctccactcatctcggccactttcagtccagcacactttgcgctctctggtttggagggtcacaggcgcttactgtctttctgttccgcttgtgggttttctgcatgccgctcatttctcaccgttcgtgctggattagtgctgtcgcttgcgctacctcgtctccgttgcgccagcgcccttttcgtgcctttccctccgctgttccggacgtttcttgcaccgccatggcctgtctcacgcgcctggcctgcgcgctttcgtgccgctcgcgcttctgcttcgcgcg

SEQ ID NO: 519130 - DNA, 679 bp, Homo sapiens
  misc_feature (472)..(472): n is a, c, g, or t
  misc_feature (515)..(515): n is a, c, g, or t
  misc_feature (526)..(526): n is a, c, g, or t
  misc_feature (528)..(528): n is a, c, g, or t
  misc_feature (531)..(531): n is a, c, g, or t
  misc_feature (645)..(645): n is a, c, g, or t
tttttttttgcttattaacctaagaactgcacaggtattttgcagttcgacttatcaaacctgcccagcgaataccgtcaactgacggattccctttactgcccataaaatcctacgtgcatgagaagaaatcatcttcaggaagcactgggaacaaacgcattcacagtcaaccgaactttcgctgtaaattcactccaaaagcaggtgaaccaaatgctcagaagctgcgagtgaacaaaactgccaatcgtgcaaactttaataaacttttttttttttgaaaagaaaaatccctcccaaattccttcacggggtttcagaagcttcttggagccctttccaccggacaggcactaaccgctatcctacttcaactcggaaagttcttctttccaagtgactaggaagaggtttgtcctggtacttcgctcagcgttactttcaagaaagccggggtctcgggcaagtntcgccggcgcgagctggttccaccgttaccctgacacccgcgnacgcccgtggntntcnttttttcactgtcgacactttgatctttcaggccctgggtctaggtttcccccagaaaaatgaggggcccatgtgacggaaaccaccagatacacttgtttggaagacacatgnccaatgattcacctgttttcccgaatttaaaact

SEQ ID NO: 519131 - DNA, 662 bp, Homo sapiens
  misc_feature (1)..(1): n is a, c, g, or t
  misc_feature (122)..(122): n is a, c, g, or t
  misc_feature (138)..(138): n is a, c, g, or t
  misc_feature (293)..(293): n is a, c, g, or t
ngagttccaccgcggttgcggacggttaaagcccgggcgattccccgggtttcaagaattgcgccacaagggaaatttaagcttagggaacttgggccagggaccgccaaccggtgctggcntttcaagtcgcgggcncaaaaggctgctcgtgattgacccagcttaatttaaaggggtaaaaaggttgggttcaatccaaatgcttctgaaccgtcaaaatggtcttctttgaaaagaaccatcccttctttgggttcaaaaggccaaaattagggcgcaatgatgagagnatgtggtgttctactctgatgtcattcttaagggctaggtatgtccaagatctcttattactgctgttaatgatgattctaatagctaccatttgtcgagtacttattgcatgccagacattgcacaaagcaggttacaccaggtgaagaaatctaggcactgacataaataacttgggatcacactgctaggaagtactggggaagggaattcaaaccatggtttatctgaactatataactgttacatctatttagaagtctgcctttgataaatttgcccaacctttttttagaattcacttacagtttatacctgtgtgaaccctttcattcttttttggtatatgcataatacaagttcattcc

SEQ ID NO: 519132 - DNA, 942 bp, Homo sapiens
gagtcggaaaacatggctgcgagtacctccatggtcccgtgtggctgtgacggggggtgtgacgcctgtcctgtccatcgagacagacgatttctcagtattcgcgagggagaatctaaaaagctaactgtcatgcattattgtcggagccattaccacgggagcaggggcctcactacaaccagctagtcaaatgtgtcgagcgtgcagattggcgtttcgtctcttctccttgacattgccgtctggtccagagctgtcaaccgcactccgtcctattacatgtaggacagaatgcccaggactattggattgcctatagcgcctgagccagaggtcgctactgttgagcgttaataggagtatgatcgggcactcgaacattttcctgtcataggtcctcgctatattaggcaatggaaagaagtcccctaatggtctcttgtcatattgtcatccacaggatcattcttagtcctggtacgagagtaccacaagaaatggcaccgtagtgaaaaacaagttccgagtaagcattgatggctcccccatggggtgaccctagggacttagggtgataggcattttgagagccggcctatccagggggacatcttcgaagcaaggtgagacggcctccacggccccagaaaaagaaccacccaactgcttccgaagcaaactttgggagtagtaactgttgggacccttgtattccctggcatggggtagttggtcgcttgtcgaggaaagctgggtacctttgggtttgaaacaagacgggccaatatgatggtgattatggttgtgagaagcttacctccattgcttttcggtgccattgccatttggcggaagcccatggcttaaaaacctctgagaaccctggcatcactaggaccaaccgaagaattgccgaaggttccctggttctttgggcca

SEQ ID NO: 519133 - DNA, 641 bp, Homo sapiens
  misc_feature (75)..(75): n is a, c, g, or t
ctgctatagaggatccccatgctgtcttcaggatgttgctttacttggaccaaactctggattcacagagatcantgttctcaggacattttgggattgggtggacccatagattcaacttattcaagtatataaaaggttctgctgacattaaattcaaacagggaatctttcccctgtggacttcagtgtgtcaccattttaattggggtctatgacatacagacaggggttcccctgatgggagtcatcaatcaaccttttgtgccacgagatccaaacaccctcaggtggaaaggacagtgctattggggcctttcttacatggggaccaacatgcattcactacagctcaccatctctagaagaaacggcagtgaaacacacactggaaacaccggctctgaggcagcattctcccccagtttttcagccgtaattagtacaagtgaaaaggagactatcaaagctgcattgtcacgtgtgtgtggagatcgcataatttggggcagctggggctggttataagagcctatgtgttgtccaagggctcgttgacatttacatcttttcagaagataccacattcaaatgggactcttgtggtgctcatgccatcctgaagaacagcatgggggtac

SEQ ID NO: 519134 - DNA, 690 bp, Homo sapiens
  misc_feature (46)..(46): n is a, c, g, or t
  misc_feature (70)..(70): n is a, c, g, or t
  misc_feature (80)..(80): n is a, c, g, or t
  misc_feature (103)..(103): n is a, c, g, or t
  misc_feature (121)..(121): n is a, c, g, or t
  misc_feature (124)..(125): n is a, c, g, or t
  misc_feature (132)..(133): n is a, c, g, or t
  misc_feature (219)..(219): n is a, c, g, or t
  misc_feature (229)..(229): n is a, c, g, or t
  misc_feature (279)..(279): n is a, c, g, or t
  misc_feature (284)..(284): n is a, c, g, or t
  misc_feature (294)..(294): n is a, c, g, or t
  misc_feature (377)..(377): n is a, c, g, or t
  misc_feature (405)..(405): n is a, c, g, or t
  misc_feature (416)..(416): n is a, c, g, or t
  misc_feature (461)..(462): n is a, c, g, or t
  misc_feature (567)..(567): n is a, c, g, or t
  misc_feature (612)..(613): n is a, c, g, or t
  misc_feature (617)..(617): n is a, c, g, or t
  misc_feature (630)..(630): n is a, c, g, or t
  misc_feature (688)..(688): n is a, c, g, or t
caaaaatcacaatcacctttaattaaaaagatgaaaacaatcaaanacaaaaaaaaataataaagaaaanaaaaaaactncccgcccctaccacaccccaatnaaaaactaaaaaaaaatnttnnttcaatnncctacgatgtcatggtagtctagaactcctccagtggcactgcagctctggagtggccagctcaccaaagcaccctccacttcacnttggggagangagggatgctggtggttaaggaggttaaaaccattagttccagtaatgcnagttnttaaacatgnacttccttcctttcccccaaggtctgggaccaaggagaaagggaccgaaatgagcccagccatgaggagcaaatcgaggaganaaaatatagcccaaggaggttagaaganttccaatatanctcctccctccacccacctcaaaaaagaaaaaaaggcagtttagnntatttatcacaccaaaaatggttccccctcaggcctgagaaaaagaccaagatgtccagtcttgagggagttctgagaaactcagagctcatctatccttgaaantccattaatttcatctccagggcaatggctaaactaggtaaattnnaatnaaaaaaaaaaatntaaaaactggagatggagagatacagggcgaggacatcaggagggcacccaggcccangg

SEQ ID NO: 519135 - DNA, 195 bp, Homo sapiens
tcaggcatcacgccagtcattttatctccatcatcatccttgtgaagcaatggaagtctggagaggtagaaatgatgaaggcaatctggccacatatcttccttctggatcctgctcatcagggcatgcatctcccatgctgaaggttaccatgggggtcatttgccaacaaattggggagtccgctatctccct

SEQ ID NO: 519136 - DNA, 209 bp, Homo sapiens
catcgcaaatatcgttgcgcttctactcgccgccggaaaaaccaacgtgtaccgaacgggttaataaatcttccggcatcttcaggagagcgattttctcttccatcaatatcctgaaaatcaaagcggtcgagcgtttcctggccgcgatagctgcgcaccgcattaagtgccgtttgcaggaaaaactggttactgacacctggaat

SEQ ID NO: 519137 - DNA, 1067 bp, Homo sapiens
gccgaactggggaggaggcaacgaaatgtggggtgtgtcagaagacggtttactttgccgaagagcgttcagttgcgaaggcaagcagcttccataaatcctgcttcctgtgcatggtctgcgaagaagaatctggacagataccactgtggccgtgcatggtgaggagatttactgcaagtcctgctacggcgaacgaagtatgggccctagaatggctatggctacggcgcagggcgcagtgcaccctcagcagctgacaacgggggagtcgctgcggtatcaagcactgaggaagcccctggccagcaggtcgcaacaacaagcccaatgcactccaatatttgcccatgaagattggtggctccgacgcgctgcccccgatgcagccaggctagtctatgctgcgtgagaaggtgattggtgctgcggaatgtcctggccagtaaggcctgcttctcgatgtgccaagtgtgtgcaatagagccttgacgctcaaccaccctggccaagacaaggcatggcgcatgatttactgcaaaggcactgtcactgctacaaaacttcgggcccaagggctccggcttgtcggtgcaaggagctggggcccttggatccactctgagtgaggccaccatcaccacaccatagccctgaccactcctgcgcttttcatcgccatctcccattcccaccagctttcggagacctcccaggatcatcactctgctcacccctgccaacattatcactaatgactagaacctcggggccatctggctccccaaaggaaaggagaggtcagccagaagtcccacccccacctacacggacacccacaagacctgggaatcccggacaaccacgaagcaagttagcgaaaacctccaagaagataagggagtccaaaagcgaagaaagcaaagcccccctcaccaacacccaggacccacaagaacctccgaacactcaagcacaccacggcaagactgacacagacaaccacctgaaccaaagaaacactgccagacacaaacatagagacacacaagacaaggcagcacaaa

SEQ ID NO: 519138 - DNA, 250 bp, Homo sapiens
gaaaaaaggctacgcgaaagcaggctcttagcgcccatttaggagagggggacaaaagggggaacactacttgatcaatgccaggcgatggagtggaagggcggacggacaaaatttgcagggagacttgcgatggcttgtctaacgcaccaggcgggcaagtacgagatatgaacactggaccagaagatagcagagcggttagaggcaagggttacgtgggaatgcgatggttggtacccgtctcgtt

SEQ ID NO: 519139 - DNA, 110 bp, Homo sapiens
gtatgcataagcgattttaggtctgttgtcgtatgcagatggagcttggtataattatgcctcatagggatagtacaagggaaggggtaggctatgtgttttgtcaggag

SEQ ID NO: 519140 - DNA, 956 bp, Homo sapiens
  misc_feature (624)..(624): n is a, c, g, or t
acgtttaagaagcttcggtatgcgtgatttaacaactatccaaggtgatgagcctgtgggacaaagaccataccaacctctaccagaagcaaaaaaagaaagagttgaaccagcccccagtgaatcatgctaggttatggagattccagctgaaaggacggagatgataaaacagatgaagaagcggaggggccatattcagataatgagtatgttaacgacacaaagggtcttcgaagaatcgctgaagcatgaaatctgtgtaaaaccaccaagaggccggcaaagaggtgcggtacgggtcactaaaatacaaagtgagtgaaacgaccacaagtgtatcaaggagtcatctacacgtcgaaatatcccaagacagattatgctaaatagcatcgagaattcattcggtgctagacgagtgatagtattcaggatttagcgtgagttaacgatgatgatttaagattgtgggccagggatggggtttactttcatgaatttaaattgttttgatttctgtaacaatttggtttcccaaagtattgacgtacgtaaaggcaggttctgcaagatgtactaagatatgtagtattgagaacttcgtcggagctcatcattgtncgtcccggcgtctcaaagtgtccatccaaccaagggccttggagaggttgccctggaagaataatatagaagtggaattgcagctaaaattcgacggggaaatacctttgaaaaggggacgcccttttttaccgggctcacgggataaaactccaagccacttggtcgatgaacccggggttaacccatcccatatagggggtcggaatcccgggaacattagagatcggcctcaaaagtacacgggatgaaataacgacgggcacccacgtgcaaaaaaaaaacggctcacaaacacagacagtcgacataaaaggacacatattgccacg

SEQ ID NO: 519141 - DNA, 348 bp, Homo sapiens
catatgggcaatttcccttggttcctgtggagcatttggctacagacacagaagcaaaagcatttaatcaaagtgtttaagaactgggtttttggctgggtgtggtggctcacacctgtaatgtcagcacttttgggaggtcaaggtagggggatcacttgagcccaggagtttgagactagcctgagcaacatagggaggccctgtctctacaagtaataaaaagcattagacaggtgtgatggcacatgcctgtggtcccagctacttgggaggctgaggcaggagaaccgtctgagtttgggggtcatggctgcagtaagccatggttgtttcactgcactccag

SEQ ID NO: 519142 - DNA, 2087 bp, Homo sapiens
tcgcccgcgcgtgtgtgttttgtgactaatattctacagactcaaatcatcactcatattagctctactttctggtaccattcatgtgttggtatccgtgttgcatgcgctcgtaggtcattacgcctgcttctgctgtctggtcatcaactgcgttgtttttgttcgcgtcctacaccattctctatctgcttgtacttgcatcctaccttttgtcgtctgatctgctcgttgcactgtctgtctgtgtcagtgctgtcttgtgtttgtgtgatgtgtccgccctcattgtcctggcgcacccctcaccaccctgcgtgccgcgctcagcgagttgtgtgcgttgtgagagaattgggtgatcgtacccctatttcgtggggttggtttcaatgtacgttttagtttgcagtatctcttatggctcggtcgtgtctctcagtggcttgttgtgcttgtgttgttggttgcgtcgcgccgtagtgttagtagaattcagtgatcactctggctgttcgttgcttgctatcggttgtgtgctgagtatcggatcgttgctggccgaccgtcgttgtgttgtgtgtctcgtctgctcatcaacttgaggtgggtatggagcgaaactactcaactagttcttcgtttggtagcgtatctactcctcggtcaattgttgtttggggtggtggccgaccagtcgaccttcggctgtggtggtgcgtgttgtagtacattctgagtagagagtgttgtatgtctttttagttattggtattgttcctctttttgtcgcttagtcgatggatcctggcgctcgcacattgctgttttgttgtggtgggtttggtggctagctctccttggttttactacctacacaacggttctgtttgtatgtgttttcttcgttctgcttctttgtgtcgttactcatgcatgtactatcagtgtgtgctggggagtaagttgcgtgtgttgcggtgtggggcagttgtcggcgcgttgcgtggcgtagtctatcactgtgtgccgtcggactgctccccgcacacgtcgctgttggcgctgccttgcctcgtcggccgtcgttagggtgttgttagtgtggctggtgatggttgcctctcgcgtcggatggcggagtgtgtgcggtgttgttcgtactcgtctcttcttctgctgtctgttgtgtgtgcgtgctgcaccctctcgtctccgtcttctgagtcgtcttctgcatcttctgctacggctgtctctgagttttctgtgtgctttgctccttctctgctcgctgctcgcttctcgctgcggtgtgtggtgtgcgtctccctcctctcgctctgcgcccttctctgctgcgctgctgcggtgtgtggtgttatgtgttctgtgtgagatcctgcttctctcgcgtgccgggggtggtgttgtgttttgtttgctctctctcttctcctcgctgtttgttgtgctgtttcgctcctctctctgctcgagtcgtcacgctactcctctgctctctctcgctgtgtgtgggaggcaaccgcgcagagtgtgtgtgtgtgtggtgtgatatacagtagaagataatcaatgagtgggtggcggttctcgcacgctatgacagtgtgagtggtgagaggttgtgagtgaggagttgcgtggtgtgtgtgtacatgggtgagtgttgtgtgtgtgggagtgtgtgttgtttgtgacatcacaccacaccacgcgcgtgcgtggggtgtgtggttgtgtagtatgtgtgtgtgttgtgtgtaatataagtgataaagagagtggatataaataataatagagtctcgctcactccctcatatataaataaacgtgagttgtatataaagagaaccacatgaatgttgacagttgggtcgcatcatcgatacactcgaaggacacccacaccccctgttgtgttgctccacccatgcttgttgcacacacgcacagtgtgtgtgtgtgtcctcccctcgatcttattttgtgtgtgctgtgtgtgtgtgtgtgtgtgtatgctataataaagaggtgtgtgtgttgtgtgtgtctataaatta

SEQ ID NO: 519143 - DNA, 204 bp, Homo sapiens
actcaaccccacattttggccttttctatcccactgggaaagggaggggggggccctgtcccccccttttaaggtcccccaacctgggggggcaaagggattaaatcaaccagggccacttgtaattaaccagccccagggtttccatgttttttaatgggtcctcttttcaagggcgggattaaaaaaagaacgtttgtttta

SEQ ID NO: 519144 - DNA, 700 bp, Homo sapiens
  misc_feature (595)..(595): n is a, c, g, or t
ccgggctgcaggaattgggaccggagggtttgtgggttctttgttacggtatcccgactgtgctctctcgccgttcagggagagatctaaggcgcactggcctaagtgcttagatgtgaaatgcagggacaaggtgagtccaactgtcaacactaaactgaccttctactctgaggcgttgataccttgtcggagagtatgagacatgcctgagccagacacaccaggtgtcttgagaggacatagcctgttaagggagtaaagagagaagccgaggtagtgacacttaacgagaatgaccggttttcatggactctgctccgccatttattgagaccctgacgagtgctggtatttgtcccaacgtcttgtcacggcttatgatgtgcagaacacgctctgatgtgccaacgcaatgcgaagaccttgacagagctcatcaaggatgtctacagtacgtacagcaagattcctgcccacaggaagggtcacatgccctgctaaggcctaaagccggatctagatgatgatgaacatgactatgtacgaatacttgcgcaatttcagcatctaagcgctggagtgaccacgcttnctaactgctgcttctcaggggatacggcaccagtcaaccattttagcctctataagacctcggcaagttcacagctgagcttcagacgggagtagcttgtggcct

SEQ ID NO: 519145 - DNA, 301 bp, Homo sapiens
cgacatgtgatctgggggcgggtaccactacagaagtggaatcgttcaaaggcgctgcgctattgagggcagccagagggtctagggattaactttccgaggtgtcatttagctgggtgagcgaacacagtatgggggaaacacggcacgaaataaaggttgaacgcattaactctggtcgtcaaagtgcttttaggtttggtggtgatctggtgatctaaggatggttgacctggcgacaccaattatattaatgcacttggcatgcaaaccaatgggggtaattttgggcttccaaatt

SEQ ID NO: 519146 - DNA, 977 bp, Homo sapiens
actctcactatttcatatgccaggtgcacgatggggacatatctgcagtcgcagcgacagagggacagaaataatagtgagcaacccaagaagtgtgcctcgctcatggatacttgacaagcagaggccagtatcagtcatggaactgaacattcatcgaggggctccatgtatgcatgtattgactggtacattacaaagtatgtatgtggaatatcgtgtgtcaagctagcagagaaatagagatgtgccgcttagggaattgaattcacctagtcttgagccataagagtagattatcagctcgggtgcagttttgtttctgccatcatgttaggtgatggtgtgtgatgcagagatggctgaatttctattcttgagcttatgtgtgacgtgtatccagatctatgttaggggaacacgattagcaggccagttgtcttctgtgctgatcagcgtggcctggctgtatgcttgggatccctctgttccagagtccatgcgcagagacgctctgacttcgttgaggaatgcaaggaaagagcaccgcagaaagggccttgaatgatcctcatagggcactgcgttccaaatacgatcaacgcagagatgggatgagagggcctggggtctgtctctgacttaagataggcctatcagttgactgtgtcaactcgcttcatgtccgttgcgtcacgattaaaaaccgatagcatggagttctaatgtccgcatggaactgatgtcttgttggcacgacatgttcactacgtccaggtcttgcctttccctcattctggaggccggggttgggccaaggcgtgcccgggaatccgggaaccagctccggtgcgcattcgttcactccacgggtcctgggtaacggcggatcaggggggggcacgggaccgaaggcggactcgggggggcagacacaccggggcgcaaggtgggcggcggtcccaaactccaaaggg

SEQ ID NO: 519147 - DNA, 748 bp, Homo sapiens
aggcacaatgaccatttcctttatattagtaaatttttaagtgaaagcacccttcactatctcttagcctggcaaccttcctccttattgattgacccctgtgcgtttcttcctcttagctacctttgtgttggatgaatttaagcgcgaagtactccaatgcagtgacacactctctgtgcgcactgtccactatttctgggagctctttgataaggacggctggtccctgtgctactcagagtatcgcttccctgaatgaagctcatctcataccttcatgagctgcaactctcatcactggcaatgttccatgcgcaatctggcacagagctgatggaagattgcctgttcgccggtgtcagtcctttttggaacccagatcaatagcggctgccacttctctggccgtctgggtcttccgcggccacgcacgcttgcctttccgctgagctccacgattggcgcgtggatctcaccagtcatacacagtggcggacctctgcctcctggcagcgaggagacccagaccgctggttcgagcagtctttgccttggcagggggccttccagccatgtgggcacgccttcagatcccgggccgatctccccgtgacctctcttgccgtcatcttactggctgcacttgcccttcaaggcgctggcggtccccccagggtgactgtcccttgggctccatgctgcctctgccctctggcccccccccccccgagttggttccctcccg

SEQ ID NO: 519148 - DNA, 250 bp, Homo sapiens
gaccgcgtccgcgcccgcgagcacagaagcctcgtcgctttgccgatacctgcacgtgccgtccacgagccgccgtgcagcctcaccatggtatgatgatatcagtccgggcatacgtcgtgcgacaactggctaccgggacagtgtgcaagggtccaggctgtcgaagtgggcgagcagaatgtcgccaccccggaggcgtactactcccactaaccagttccgtagtggtgtcgtccccaagtgtcac

SEQ ID NO: 519149 - DNA, 440 bp, Homo sapiens
  misc_feature (7)..(7): n is a, c, g, or t
cggaagngcagcgacggaatttgtaggagaggtgcgggctattgatacaaatgtttaagtagagaaagtgtccaaacacctcagcgtttgtgagatcatagagggaagattgagaggaggagtcagaagaccgcgccctaggcctaggggtgtagcaggcagaacatggaccttttcttccccagaagccatggaaggagtaccaacagagatcagggtgaaccgagaagcaggtggttggcagtccacgttagaaagtgcttcaggagtgaccactgtgaccactgctactcaaaggaagatgaggatgagggctaagctggggagttggcaccacggaggccactgatgacccaactgagggccatgttgatgaaatgctgggagctgaagcccgatttaagaaatagtagtggaggctgtacacagtggctcatgcc

SEQ ID NO: 519150 - DNA, 322 bp, Homo sapiens
atgatatggggtactgaacgggtatagggaaggtaggtcatgtctctaagaggggatggcattgatagcaagacccgtagacagagcatgaaaatgttatgtcacttgataatacttagtgcaatttactgttatgaagtgtctgtttgaagttgaaacaagttctaggtaagccctttgttaagcaaccagaaaatagacagggagaaagcagttagactggaatgctgattagagtcattaattagtaccatgaaagtcccgcagagttaccttccattggaaacctagatgactgcagaattaaaggctttggtggggg

SEQ ID NO: 519151 - DNA, 252 bp, Homo sapiens
  misc_feature (18)..(18): n is a, c, g, or t
  misc_feature (40)..(40): n is a, c, g, or t
  misc_feature (50)..(51): n is a, c, g, or t
  misc_feature (132)..(133): n is a, c, g, or t
  misc_feature (139)..(140): n is a, c, g, or t
  misc_feature (165)..(165): n is a, c, g, or t
  misc_feature (175)..(175): n is a, c, g, or t
  misc_feature (186)..(186): n is a, c, g, or t
  misc_feature (188)..(188): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (201)..(201): n is a, c, g, or t
  misc_feature (209)..(209): n is a, c, g, or t
  misc_feature (222)..(222): n is a, c, g, or t
ctcttcctctataaacangtgaccaattagacgtttccgnaattccatgnnttatgtatagtacactctataaatgtaaatgtaatgcttgtctaaaaggtgcaatttattgtacattgtcccaacaaatgnntactcnnataatcgttatgaacttgaattggnttagtatctngtgtttatgtntnaatnangcctntntgaaatanacaaatgcaactnagaaggtaacaaggtgactgtttttgtgag

SEQ ID NO: 519152 - DNA, 929 bp, Homo sapiens
  misc_feature (929)..(929): n is a, c, g, or t
cgtgacgcgtgggtcgaccacgcgtcggagagcgctgagccgggccgcacccgccgagccgtgtgagtaacctctacctccgtaccttctcgcctgccctctcgagggaccatgcacccatcgctcctcagcggatggtcagtggatgggacgcacactgcaccctgggcgctcacgacgagtggcaggggactgtgtacacagcgtgtcacaccttgaccagcagaagcatctccagggacacctgtgctggcctgagccccgctgcacgcccttgagcacctgagctccagggcgtcccctcggactcaatggagaaaacaacacaccccgaggcacacgtggacacctaggacaccaagtacatctcctggaagggatgctttatagctgagctctggtggatgagaggagctagccttgacaaacaccttgatactgactggacatcgtgtgggccagaggcacgggactggttggctatgaccccgaaaaccagcatggcagcgactaacaccaagttccaggtggcacactggctgggtctgtgtctggcacttgtaactcgggcgctgactcagtcccttacaacgtcatcaagatccgtttccagactttccaggcatgagcgccctgtctcgcacagtgaccccagcgcaaaggtaccatggcattcctccaggcctctacggccagattctgcaggaggacgggtccgaccagctacccgtggcaacaggcacccgttccagctcaagacttcactccatagggctatcgcagcctctgccgaaagccattgcccattcgccccatcgctgccctgcacctaggtccacagaagagaccgccgttagaccgccccgccacatccccatgcacctcagacacagtgtagcccgcacgccgaacctgcccccatacacgan

SEQ ID NO: 519153 - DNA, 813 bp, Homo sapiens
aggagatatcgcacggcggtcggaggcggtacgcgagggagacaagagcactgcgttggacgtattggcgacagctgctggcgtgacacatgactctccttcccccgatagcatcgcgacgatcagtggtcgtcgcagtattacgtggatcgacgctgacccggcgagtatcaccatggccgaccttccggcggtcgcggaggtgatcgcacgcaccggggcaagaatgcttgagcttgctcaggctagtgccgacgctgctgctctcaaactcgtcgatgcccaccggttgttgtgcgctcaccgagaggggccatacggggtagacgagtggtctcagcgcatggttactgtactttcagatgtgttgcctggtgttggccaaggccggtgggttctcggcgaaactgcaatagtaacgcataacctcgcacaattgggagtcaataacggcgattgcggggtcatcgttgaaacaaggcccgtccccacgatagctctaccgggacccggtggagtccccagacggttgccctgttccctcatcccatcgctgcaacccttacaggcgatgacgattcacaaagcgcagggcagccaattcacggacgtaacggtggtcctgccgacacccgactcgcccctcctctctcgtgagttgctctataccgccatcacgcgtgcacgtgaacacctcactgtggatgggcacaacggactcttgtgcaagacggccactggaccgggctactcgatcgacgttctgggaatcagcgccggtgggcaagaaagtcgcacctcccgcctcagaca

SEQ ID NO: 519154 - DNA, 135 bp, Homo sapiens
aggctggtccgacctggagactgtaaggcaggcatgcctacccccaggcactccatgcctggctcagaggcttacaactgaatcaacaaggctcccacggcttcgtgttgtacctcccccctttgaacaggaggc

SEQ ID NO: 519155 - DNA, 119 bp, Homo sapiens
aaatcttctagataagcaagtgagatcctctgtccttaatcatcaatatactcaaatggttctgggggtctggctcttgttcctccttccttatttgggccagtttctcatccttggag

SEQ ID NO: 519156 - DNA, 513 bp, Homo sapiens
ttattcccgttgaagaaccaattaaaaaaaggggggctttttgattttttaggtgcacttgtgccctacaatctgacgagactccaaatacaccaaacaattcatggaccatgaattatgatgacactaaactgaaatattgccaatttcccatttggggcagtgccagagaaggcaacaccgctaccggcgaaactggaacaaggaccatctgaaacgtcactaggatattttctgccctaaggggcaaggcatccaacggggtcctttagcttatgtcctaaacaaaatgcttgatgcaggctggatcaactgtgagcattctttacaactgtcatactaacaccccctaaatcaatgacatacgagcttgggagagaattcttattgaacatggtccatgccacagatgagctgattgagccaaatgcagtgactgttccacacacacctgagggagctgggtactctcaagacattcatcaggcactgacagacgtacagaatatggtg

SEQ ID NO: 519157 - DNA, 478 bp, Homo sapiens
cggaccgaactcgatcaacaatatatttaagatgtacgtcacatatgctgggtgcggtggctcacgcctgtaatctcagcactttgggaggccacggtaggtggatcatgaggtcaagagatcaagaccatcctggcctagacggtgaaaccccgtctctactaaaaataaaacaattagctgggcatggtggcatgtgcctgtagtcccagctactcgggaggctgaggcaggagaatagcttgaactcaggaagcggaggtagcttgaactcagaatagtgccactgcaatccagcctgggtgacagaataggactctgtctcaaaaaaaaaaaaaaaaaaaaaacttttttgacaaaaatggacccagtcccggcccggttgaaaactggtggggaagggcccccaggttttctaacccacaaattattttaatagagccttagaataactctcatgcagggactctcagtgagt

SEQ ID NO: 519158 - DNA, 1699 bp, Homo sapiens
  misc_feature (1003)..(1003): n is a, c, g, or t
ggctagatgatacccaatctatctgtgtccacaggtagaccgaagtcggtacagatgtcttatctcgaagtcgctccctattattaactggtatccatagatcaaccgatcttggacgacattcaggattatctacaccaatcctagctgtcagaaccagactgaattaggttactgattatcaggtcgagggtaggacaaagtagaattcctctctggatactgtacaagttcctcgggataactggtacgtgccgcgtaggccatcctagcacgacgtggccatgatacgcaatcggaaggatgataggggtccgtggatgggtaaggacccttggccacgtcgtacacgaagcacgtcacacgacgtcgcgctttgtcacgcactctaggcaaggctcccggttgcgacgataccttatcgtcaatgcctatacccgagcacgtggcgcgcctatacgtacttcatatagcacaagcgtggagacttggcatatatatggtcccagatcaaggaacggaatcgaggtgctcgacctcgacgctcgaccagaacgtcaacttgtgggcacgcctactacactctgtgcactcgggggacgcgtgcaaagcatcttaacctttacaccaaactgtgccattcactacttcgttaacatagcaataaatcaaggcagaggagtgtgtgcccccttcgatacccaacccgggtcagggcagtgggtccccctgtgaggccctgagccttacgcgagcccccgggacggcgatgggacctcctccggggcgctcccgcatgcacctaatttgagcacaaatctaagccactagcggccaacaattttcacggcacttgattgcttcatcctcgcgccgccacccggtgcacccactgcgtcacatgctcgcgattggtcactgtggcggcttcccaccatttccatggcggccccttttgcgccacctcatggggcaccgttgtggggctccttatcgccctccnccctgtacggcgcaccgccactctcgggggccccctgggcgcactaagcgagggacctgcgttcggccccacctggaggccaccgaaaggaggtacagacaccagggaattccgcaacttccctccacagccgccccaaccttgcactcttggttccgagtaacatctggctccccaaacaaggatagagccaactgacatgcgctaacgtccacccccacagcacgagcccgggcactttgtttcgaccccaacacctgtgtgcgagacaacagacacgacacacgtacagtagggcgtgtcccattgggtccccaatagttagagcaccacaggcgagctcataagggcccccccgttccacacaaagggcaacaaatgtggagaacggcaaccctaatcggcacacacccacgccaccgccacactcacaacacaggcgcgctgcgcagacacctctcgactgcccggaacgagttgagggaaccaacaaagcaacggactagtggtcgaggatcagcacacaacacgcgctctcacacgacgcgcactgcaccggcagccacgcacctgctccctcgtcacaacccacgccgcgaccaacacataccgcgcgcagaccgccacacacgacgccgacgcgacaaccacaatgcccagcaaccgcacacgacccacgcggtcaccgccaccgcc

SEQ ID NO: 519159 - DNA, 295 bp, Homo sapiens
tcgtactctagaggtatccccgccaccaggcgcacttctccagcagaagaggaggatgcggcggtggccatctcctgctcgacgtccacggtcgacgtactcacagcttctcctctgcatgctcgcgcacgatttcccgtctcggaccgtggctggtgcaagctcgctagcctcagctcacgtgatggaatctttcatgacggtagctcggctcaggatcccggaccagcccaggatccagaccgcagagatggcgctgcggggatgcggcgtgaccctcgttagactgggcccc

SEQ ID NO: 519160 - DNA, 482 bp, Homo sapiens
gagagcctgcatggcttcagctgcggcacagcaacgcttcttaatagaacgttcattctccctgtcggtgctgtgctgtacgacccggattcctgggacgaagagaagcaggagtacacgcgcatcagtgagcctgcgcagtaaaacctagcactcccccgccgtcggggaagcgcccacacacatatgcacagaccccgcccgtgcatccagtgctggcggggttcttgcttttgaccagcaactgcccaagcccagcagctttaccttatgctgagtatgacccgcccctttcaacgatgacaggagaaccacatgcatctggcgcccagcaccgcgtgggtttggctgatagcttgcgcagtcgtcattctgtttttcccgctcgccgcgcagctcggcaacctcaaagggaagctgtcgagcttccacacctgggtttgggctatcgctctcttgggcattgtcacggcggtcgacgc

SEQ ID NO: 519161 - DNA, 581 bp, Homo sapiens
acgctgggctcgagtgaactgggccgtgctggagacatgcttgctggggtgctggcggtgtgcgtggactgatgtatgaaaccaagcgtccaacgttccccgctccatcttctggcggctgctgacgagctaggtcctgtaggctggggcttctcgacggagctgacagccagtagaggaaagcagagtccccatcctgccgaaccccgtaagaggcaaggctgcgctcaggcacacacaggcaccgtccgatgacccagcgttgcacggctggcgggaaaccgagctctgagaacacctgctcctggagagctgcaacagtgcagtgggggtggacctgcagggcaccgtgtgcagaggacgcggcggatgcggcagaggcagcgtcttcaagtgtgacctgcagcctgatggggccaggtgggaagcaggcctcctgaagctgaacactcagggccacacgatgctgggccaggacggctgccacttgggctgccccttctcgtctcccctgcaatagccgggccggctcctgccagctctctctctcgacagttccaggctcctaggaagtctgctcg

SEQ ID NO: 519162 - DNA, 145 bp, Homo sapiens
tgtaatcccagctgctggtggggtgggggttttggggtggggggaggtggcgggggtggaatcacttgagcccacccaagagggagctgagaattcgccattgcattttagcctgggtgacagggcaaggtcctgtctcaaaaaa

SEQ ID NO: 519163 - DNA, 164 bp, Homo sapiens
ggagaaaggacattgtaaccataacacactgctggccttgggactcaacaatccttaagtgctccaggtaatgtcaaccacctaatagaaatgtactaaatgatgtgatctagctatacttgaaaaccaaaccacggtatggtaagagtgaaatcctcctctac

SEQ ID NO: 519164 - DNA, 954 bp, Homo sapiens
gccatatagtgttcatcaaacctactaacgtcgtggtagttacacccataattgttgccccgcccaaaattttttgggcccgacagatccgagtatgtcccccccccaactatgggcaaaacagtcaaagatatctacgaaattgcatgttatctctcgcccttccacgattctttcccgccacgatatacgatgctccacctcttgttggtcccccaattaaccgacggcccaacattaattttgtaacgtaaacgggtcctttctcaacgctccgttcctggtttacctcgccctcccctgcctcagacttcatcctgccctccccctgtgtcaacgccagtatagggatccccgatagtaaattttgttaactacttgccgcccctccacgaatgatacccctgtgtctcatccgcggagcgacctattggcgactccaagccatattggattactcctggccacccccgatgtgaataaaccccgaccccctctccagatcctcccgagttagagtttcctcgattccctgtcaaaaaacaaagttctggcgcgaaactgtctaccggtaagaaaactagaaggtgggcgcattccttgccccgcctgttactcttgagcccttgctctcttcgttatcctgcctcacttacatccccgatctacccatatcgcctcaccctccgcacgcacttaatttttctcccccccttaagcccctccccctttatttaggagtccgcgactacgggaaacaactccactctgctttgtaataccccccagcattgacggcacaaccccctaaagaggtcaccccgttatccactcactcagtgacccacaaatctactgcccggtacataatcgacgccccaccgacatcgatatgcttaaataaccacactatttccccctacacccaaaaccctcatgggcccccaacataac

SEQ ID NO: 519165 - DNA, 504 bp, Homo sapiens
  misc_feature (1)..(1): n is a, c, g, or t
  misc_feature (385)..(385): n is a, c, g, or t
ngtttttttcttgtgtggtttgaagtcttattctagctgatcctgggaattcgctcatacactccacaaggatttttataaagagaatattctaaaagcatcctttccctgccccagcttcttacccacagagcaagaatagtattcaatattctaaggctattatatgtcatgatcttttaatctttatttacacttaaatgtttctatacatttttaaagcatgatttaaactttcaaaaatttaaaaattatggtgaaatttacataaagtgcaccaattttaagtgtgcaattcaatggatttacagaatgtgtatgcagccatgttactatcacccacatcaagatagaatatttgcatggtgcagtgacttgtgcctgnagtcccagttactaaggaggctgaggcgggaggatcactggagcccaggaattggaggtggcagtaagctatgatcacaccactgcactccagtccgggagacatagcggacctttctc

SEQ ID NO: 519166 - DNA, 154 bp, Homo sapiens
cagttacccgaagtctagaaattgtgtccgtgtcttctatagatgtaaatatgtgctgtatacacacacatacacacacacataaatatactttagaaatcaacagatgtggcattggtccaggattacaagggttggattctgggcatcctgg

SEQ ID NO: 519167 - DNA, 410 bp, Homo sapiens
cgatatcgctaagcgcgggcaaggctttcaggcaaggtttggatgcttcggtaatcgtgtcggtcatgcgttttctccttagcgatatcggatgacaagaacggggcaaacgggggtatctcgtcggtggaacagatgacctccaccacagagggaccgccatgggccatcgccgcatgcatggcggcctcgaaatcggccaccgtatcggccgaacggcacatcagactcgggaacatcgcggccatcccggcggcgatatgcgagggtgtgaaccggttgaagctgtactttcctccgtaatacagctgctcacgggtgacgcacatggcatgtgcgttgttgttgacaatgacgaatgtcaccggcagccggtgctcgatcgccgtgtgaatctccatgccgtgcat

SEQ ID NO: 519168 - DNA, 599 bp, Homo sapiens
tgagcgggtacgtgtgcttcctggtggcggctgtgagtgagcccgtgagtggacgcagcctgtgttcaatggcagggcgcgtgtgtggtcgagtggaggtgcttgggctaggtacagatcctgattggccatccttcctctgtgcgcacaggagtaagttgtgcaattagatgagatggactgttatgaatcctatcgtcttgttcagtactgagataatacacattagacgctgaagggagtggactatcagatgacgtactaggtcaaactagggttgtacccatatgaggcctgacatatatctggtgaatccaccagttagtgtaacattcataatagggtcatcgaggaggccctattccagagattgaggacaagacagataaataaagaattattgacacgccttgtttatgtgaacgaccatcgttaaacgcatagttatatacataataataccacacgaagaaaatagtatcatagatattaatatacagtctatactgataatactatatatatgaagaaagaataattacatgtcgaaataattcgatactgaacgcggaatgagaagagcacccacagcattaacg

SEQ ID NO: 519169 - DNA, 776 bp, Homo sapiens
gattacagctccaaggggattgtctctgttaggcaggagtgggggtcacaaggtgctcagtgggggagcttttgtagccaggatgagccaggagaaggaatttcacaaggtaatgtcatcagttaaggcaggcacgcgccattttcacttcttttgtgattcttcagttacttcaggccatctggatgcatacatttcaggtcacaggggatatgatggcttagcttgggctcagagacctgatattcctgtcctccagctgtaagagttatccaaagctgggcatctgtgatggtccagggggcttccaaagtcatctggcagcatcagtcgttcagcacgctaagctgagaagatccgatttaaaattggtgagatgttccttgggctggttggtctgaggagcagagatcgtaggtggatcttactcatggagcaaagagcaggaggacaggggattagatctaccaagggaggtccccatggatcgaagtgaatggacaccaaaatacagtaacgcgataggcatggtaagagcccagacactatgtagcgaggccaaaaggaaagaagaacacacattgaggaacagagaagataccaaagaaagcaagcacaagaggcaaaacacaaggacacgaataagctggcatatccacattaaaagccggaaggaagaccagaagcagccacaggcagatggccacacgcgaaaggaggcaggaccggggaacataggcctggcgacaactcagggaacaaatacagggacacca

SEQ ID NO: 519170 - DNA, 111 bp, Homo sapiens
gcggaggttcggtggcactcacttgaccggctctctttgagtttccacaaatacttgtatactggagacgtctttcctttcagacatctgcatagtccacctggtgcctgt

SEQ ID NO: 519171 - DNA, 214 bp, Homo sapiens
gtcatgctgttgttgatttatagaaggtgaatttaatgcaaaagtgggtaacactacattcataacaaagttttaattaaattttatacatttttcatcgccaattatgtcctaattgtatttatggggacatgaaccgcagcacatactgtaaatgtagcagttttctttttatttttatatggcttttctttccttgcaccctggaggttcc

SEQ ID NO: 519172 - DNA, 345 bp, Homo sapiens
taaccctgcgcccatcagaaagggaggagagagagatagagagagtgacagtgaaacaccctaaaggaacagatgcaccttatattcctatgaactgtaaagccagttagaaaagttaacaagtatgaagaatgttagttattctcattaaagacactctactcatagtagtttacatcttctatattgcatgaagaccataactgcctacaggagctaagaaggaggaataagagaaatattaagatggatcacaggcctatgaaagattttcagtcatcaaacttcttcaggtgacctaaaatttatggtgttttttacagcataccatgccctttctggtgt

SEQ ID NO: 519173 - DNA, 656 bp, Homo sapiens
tcaaatgtaaaaaaacaaaccaatttttttaaaaaaaacaaaacaaatttttaaaaaaaagagtgcaaaataaaaaaaaatagggctcttggtaaaaatattccgtctcttcttacccctaccctcttcctccttaaaaaacatttacttctttttgcccccttgccctttttcttttttgcccttttccccttttgcccgtgttcccttttctttgccccttttccccttttccccttttggttcccatttacccgtcccctgttccacatttttcaccttggaaatcctttaactctcccgttttcccctcttttgccccttttccctttttcccctttttcccacttgcccaaaggcccaagggccttccccttttccctttttcattttcctcctcaatgggaatttggaacctttaccttttcattattttccaatttccctttaattttttggctccttttttttctttttgccccaattcccgaatatgcccttattctcttttttaacctcattcccctttatagggttcttccctttttccctttgggcccattttccactttttgggcctctgcctccaaggtttttatgggtttttggggtcccagttccctttagtcccttaactttccttttccggggtctct

SEQ ID NO: 519174 - DNA, 264 bp, Homo sapiens
gctaccccgtaatacataggccatgtaatcaccatcgtcaatgtggtcaatacgcttcatccattctaggtcttcaggattttgatttgctccgggtaataggatacgaggaatttatgccaaagtactgttggtttgattaaatataacagatcgtatttatgccatgaaagttgtcaataaagagcttgttaatgatgattagtatattgattgggtacagacccgagaagcatgtgtattgagcaggtccttcaatcatcc

SEQ ID NO: 519175 - DNA, 455 bp, Homo sapiens
tgggggtaccgagaattttatctgaaaacaaaaacccgggcgacccagggtttacaaacaggattgtggactcgtagcaaaccaaaccaaaccaaaccaaaaagagggaggggggaccggtcgaaaaaaccgagggggggagcgagatcgaggaaggggggccggacaatatttttttcttctccccattttttttaaaaaaccaacacaagaaaacacacagcacacacaaccaacggtttgtccccgagtagaaccataattggggcagactcgaacattctggttcttctctcttccaagagaaaaacaaaacaacaagttaaaattaagggaaagggcgggtttaggaggtggtggcgcccccttaatgagaagccccctttcacgggggcgggcggggtgtaccaaggggggcgcgcccaaaaccgccgggggttttggtcacacacagg

SEQ ID NO: 519176 - DNA, 452 bp, Homo sapiens
agtgatcctcacgtgatgaacatgatcagatttcagtttcccccggaagacagaatggaatttgggagattattcagtaggaacatttgcaaaagctaaggtaggagaatgagggtatgaaccaaggctacagcatggagtggatacatagagaggatatacatattcggtcgggcaaggtcgggcacggtggttcacacctgtagtcccagcactttgggaggccaagacgggtggatcacctgaggtggggagtttgagaccagcctgacaaacatggagaaaccctgtctctactaaaaatacaaaaaaaaaaaaaaaaaaaaaaattagccaggcatggtggcacatgcctgtagtcccagctgcttgggaggttgaggcggaagaatcgcttgaacccaggaggcaaaggttgcagtgagccaagatagcgccattacactccagtc

SEQ ID NO: 519177 - DNA, 338 bp, Homo sapiens
ccccccttgggccccccttttgaacccaggttccccccccaaagggaaccggggaaaaacccttttttccccgggggccccttttaggggttttatccccccaaaaaattatttttttttttttcaaaccggggggggggggtgggggggcttcccccaaaacccggggggtttggttttttttttgggcccccttaaattccccttgggggtgggacccccttgggttatccaaactttttccctttttgccaaatgggcccatttggggggggttttttttaaatgggggggggttgggggttggggttttcctttttttactttggttccccaga

SEQ ID NO: 519178 - DNA, 219 bp, Homo sapiens
ctcatccatagctttggtcactcgagcacactgtattggcacatagtagacagttaagtagggtatgttatttacagacagcaaagagaaagttactgagactgggcgtttgagaaagttacgtggaggaaagggacaagttgaagacccttaagggcctcacagcctagttaagagaattcataaacaggtaagagttaaaagtatatcagcaggcta

SEQ ID NO: 519179 - DNA, 107 bp, Homo sapiens
agagttggaggccaagaaaacatttttatttttttgtttccagcataggaccgtcttattcaagagaccagatgggatggccccaagaatcgggcgggtctcacggg

SEQ ID NO: 519180 - DNA, 108 bp, Homo sapiens
ttttaggcctttttcaaagaaaaacccctttggggaaaaagggaaagggcaaaaaaaatttataaattttccttggcccccgggggaaattaggggtttttccaggga

SEQ ID NO: 519181 - DNA, 444 bp, Homo sapiens
  misc_feature (49)..(49): n is a, c, g, or t
  misc_feature (118)..(118): n is a, c, g, or t
aatcgagctcggccaagttagtcgggacggcaactggaatcaaatgtcntagactttgagtattcctgagcaagtttgatggagatagaattggacaagattttggccattgaataancacatccagagatagaaccacgcgtatcctgatgctatgattaatccctcattcctggccttggggtaaagttcatgagggccagacgctgggggctgtataccattcataaactatctcttaaggctcagggctcactgttaaagggaaatacaagcagtgcttggtctccggtgttgaggaagttaggtggttgtgagagagggggtcttcaaactcagctctgttcctggggtgacagaatttcagggcttttgaaaatcaaatacatttctgttgctcattctgagacgaaaagcgtttacatcccggtcccgacttaactg
